United States Patent 10,233,495 (METHODS AND COMPOSITIONS FOR SCREENING AND TREATING DEVELOPMENTAL DISORDERS) - sequence listing, part 196

SEQ ID NO: 1349 - DNA, 337806 bp, Homo sapiens
ttagaaaatactgtgatattttattattaaaaatgctgctgaaaagtttatacatatgtgtccggccatatatatcttctatcattacttaaggcaaaataaaaaacaaaactgcaaaataataacccaaggaaccattaaaccctgcgtgcctttgaagatcaagagtaaaagcctaggacaggatttttttttttcttacttttttctcattttttttcttttttctcttttttatagatagcaagtatattttttctcatagaactctatgaagattctataacttctttccatgtagaaataagatatcatttaagatgtactaaaatcacttttgatcataatcccctgtaaaagctaaagttattcacttaacaggaactctgtttttccttattcaaatgtcacaagcctgacgcgttactgtacatattgctagcaggagacaactggaaatactaaacaaatactggaattcacattacagacagacgaaaccaacatggatgccacacataacttcctttgtagtttcacagagagcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtacgcatttctaaaaacacttttcttttttctagaggtcactctcaaacactgatatatcactatagtttgagtgtagggattcagtaatcaaaggttgttattgcaaaagagccaggcagctggacaatttttatggggaatgtccactttagcggagagatttaagactggatttctagaataacccacaatggagccgaggaacatgatcttcaaatatctttggctactgtttcttggtaatgcaataatttttcaaaaaagtatccattgctactatgtttccttccaccttataacactcaaaactttcctgaaaaatgagaagagaaatgaaaaaatgacaagctgttggaaagacaaatctctgatccctaggtcaccaatttaaaatgggtgaataatttccattcaatgtcttctcagtgaagttatcctaatttcccagaaaacccatgcaaagcagttttaatattctatcctttcttcccccattcttctataatattcaccgtttggtgaccggatacacaaatccacaaaaagtgatgttttcagacaatcatatgtttgatcccataaatgatataaaagatttttaaaaacctgcttactgataaataagggaccgagtgcttaaacaaaaaggaaagacacatgtcttccttcaatctgattagctaagctgagcaggtacttcatcggccaaaccctcccgcagctgctagggaacacagagccgtatttactccaaggggcatagccccaccaaaggcaagctttcttctttttttggcagggccctgaaatgggaagcaactcttcctaaacatattcaaagggccagagctacagaacgggacttgtatttttgtttctccctactgattctttgtgtgtgcatgtctctaatttaacaagctgtaaatacactccactttggggacccatctctgtactgcaatttcatgaaggctaacacgtacaagtcaaaagtttttcaaaacagtggtctcctaagaatgctcttgcatgcacctgtgcaacctgacgggggaaataggccacacagaccgtctgggtcttctgtgggacatcacatcctcctacaaatgagaatctcatgtaagaaaatcccatgtctttgtttaccacaagtaattaagaagaaaagcctcttttgttggggaggaaacagaggtgatatgactaatgtgtgtgtgtgtgtgtatatatatatatatttatatacgtacagagcacaatgaaaagcacaaccttgctaaaagctctttcaaagtgaaaacaccaataaaagctttttttcttgtttgtctgtttgtggtttttgtttaaactcacagctatatacatttttcttttttacaaagtctcttaaatatagttcaggctggcaaaacacctctttgcacagaaccgtacagatttcgctgcacagtccattcttttaataataaatttctacgtttccttctctctggattacagctccatgtgctgggcaaaatctcattgactctttcttcacttaaggagagccatccattgtgtggcacagaaagaaatgtttaaacttccattgtaattaaaaaatatcaagtgtccttggctgagtttcagaagtgtcagctgcttccatgacgttggaaacacccggggccttgaaatggtgatgtcctatcacactaaacatcgattggagtggtagagatcttaaagcagttattttaacagaaatgtgtacttctcacatttcacagggtcagaagttgatcttgtaatactggaaaacaccaacgataagggtctgccgggatgggatgactgcctttttgcatttttgtcttaagtcagtgggacaaaaacattcctggtctggagactttctttctctctctctttccttctctctttccttccctcttctatgttgctgagcgggtagggcagagggataggaagggaaatagggcaaagctatactctagtggtggaatgtccgtggggtaaatttgtactgttttgtcctccactgaaggtgttaaaagtgtgcaaaggctgcatccccgtcagtgtgtttggaatcatggtgatggtgtttggcgtcataagtgggatgtcatctggcgaccggcgcagcgtgagggtgtagtctggcgggcaggtgagcctcagtgtgtcgtgtgcctgcagcgactcacactcgtgatcgtgttccagctgcttcatctgcagagacatgatctcttcgttctggatgtgagcgatatcatttgtggtgtttctctggggactggggcgcctgtgagtctcatggcgcctcttgtcctttttgtagtacagcgccgcaaaagctaagatgttgaggaagaggagcgacgccccgacggcaatggtgacacttaattcggtggaataatctcgtttggtttcaatgaggacagttgtgtcctcaggccctgttttgtgagggtccttagagtgtttgggattgttggcaggagtgattgctgggcgtttggtggttggccatatcttggcgggagatcgccgggtgccatagggaaatgatgtcatgtctggtggaggaacctttgtggttgttgaaacatactggaatatctcgttcaagttgtgcaaatgaggaacgagttccaaccagaaagccactttcgttgcccggtagtgatctctcactctgggtttcaagccaatatgcagatagagctggtctttgggattatacttggaccaggccacttcttcaaagcggttgggttttgtgtgaatgaacttggtatcctgaggaactggttgatttggatcactgaggatagaaggaagaaaaaaagaaaggtcatactcttccacatgtgacgtgaaattatcttaaaccaataaatcaggaagttacaatctgctcttcatatatatttatcaatgagcacaaaatacccaagcagcaaaggtacattctgctttaatcctagacctgtctaccatgttgtcttttcctttaaaaattgctcttatttttcttttaaatataaatcctgatagcagcattatgcaatttttataacatgtttactattttttaaggcatcaaatgatcttcaaaaataaagggaaagaaggaaaactaagtgtctctaggaaaaatttcagtatttcaagtttcactcttgtcgaactgtaaaactcatccaggactgatttgctccaaagggatatttggcagtatctggagacacttttggtttccgtagacgaagggttgttctatgaagggtggaggtgagggatgctactaaataccctctggtgcacaggagagacccccacagcaaagaagttatctggacccaaatgttaacagtactgaggttgagaaattctgattaagaagctattgtccaagaaatgggtattctctttcttgctcaagaattgcttttgaagtaaatgaataaatgttgcagttttagcaatgaaaattgatattaacagtagaaataaaaataggctttataattacaaagtgtttgtaaatagacatatgcaccatgtgtttgctctctatttgaaggtaaaaagatgaaagcacgctatgttagctgtaagaagtttgctaaaatggtacatatagttatgatgaggttaacatgtttaagataaaaaagacacccagaaacaagtcaagggctgttacagatgctaagttgtgcttggaaactatgagccaaagaattatcttcttattatttgcacaagtggtcacaggtagaaggagaatcataaaaatttggagataattcataaaacatagggcctttaataaacatctttgcaactgactcttttaggataacacttccccttcaaaaaataaattaccaaatgctcatttcttccattttttttatggcttgtaaagtaagctaaaaaacaattacgtcttaaggtttatttgttataaaaacgatttgagattatgcatggcaaaatgttatgtactagttagcactgagcattgagatgtgatgtgcagaaccaggcaagcagggagttgcaacatcctgatcaatggctccaggtgtgagctaagggctatcttccaggtaacttctccttggcgggacttctgtgaaactgcctccagtcattgcatggcctgcatggcagaaggctgcaggaccaaggaagatcatgtatctgtagccattaccagacactgtgcaggattcaaacaatatacttgagccagaggcgccacacttgctgaaggaagattttatcccctcagtctgagtctgtggtggtgataaaataaatcatttccctgtattcaactttctgcagctctggctagttaagagctgtgaaatcttaagcaagttttccagccagtattggccttaacttactcctctacatggctgatgaaaatatcagggttggaggtaagtgatgaaggttgaaagataatgacaagatgtctggcatatggtaagaattcaggaaatattaccccctctcttccaatataaaaaatagaacacctataatattgcaagggagggagaagtagggagtgatatactgtatatcagagtacatactgaatttctatattgtatacattgtagagtgcataaaagtatattgtatattacatactatatacaagtatactgcataccacagtttatactgcatactaactatatactatatgcagtatatatatgtatgtcatgtgtatatatgtgtatgtgtatatctatctatagatatagatattagatgtataacataatacaggagaaaaagaaagttgacctctaccctttagttgaatgcacactaactgctgtgttttcactttactaatagggtgagaacaaatatatataatctcataggttctaataccatgagttttcttatttactgataaacaatatatttgaaaagtcttctgctttttttatttattatgcatgtattcttacatggttttgaaaaaatgttggattcaatgcagcaactcatgtttcttttgctctttaagtcctctgaaataattttaaaattttcagttatttaacgtgtactgaaagaaaaataagtgaatgaatattttaggaaaaaaatccactaatattagttattgatttttaatattctaaagaaacaaatggaagtgaagattctacctttttttccatggatccaattttactgaattggatctattagatgtgtggctacctcatctattaagcagtgagcatctaggaaaaggagtattctgttcatgttgggtacaaggctattttcgaaggaactcagggtatatttgaaaggtaaagaaaacacattatattttgttcttgaagaataaagcagaggatttggaaaatccatataaatgagctgccacctgataccgtctgtctattaaagatctcggagatgcacagccagaattcttaaagccagataaacttgtggagattatgatagcccaagtcattctcccttaccaaaccctccagacagtgaggtctagatgtggggtatcagtgttttgttttttagactttattcagcctaagaagtgtttaaactcctgtgagtaaaattaaagactataatgattgaggacagaaacacaagttggtctctctagtaaaagactcaatgcatgtcttcctccttatcccccagcacctaacacagccatttccacctgtcctgttttatttgagatgtcatcttggcagcagagactcaagtgcctttctaaggtctagttcatttctttagctggagatggatatagtactatgatctctctaaaaatatctgtgaatcctctcagctgttcctttaagtagtacaggttttcctcatacccaaaacattgttcgcagttaacgattattaccggactagtttattatgcattcagtgactcctcttccacaccaggtggggatgttcattcattcagcttaaaattcctttttggtaataaaggtcgcctttacagccagaattacgctgcaactctctgtaacccatccccactaaatacctcattggaacttcttttttttcccaaagatttaacaatagttgaacgtaaattaatcataggataccagcacattcaaaagcagtgatggtagctgatgcaaacaggacagaaatcaatctgccgtacaaaccccagactcgatggaacaacataaaaaaatcaaaatatgtgttgatctgattttccattacaaaactctcttctcatatctgacttccaatagcacataaggtcttctattctatattataatgcattgtttggttactttaaagcactgttctttgtcataccttataaataaaccaagattccccactcctttttgtccatctctttccacacagagctcaaaatgaaagaatcctggatcactgagcacctgaatttcattgatcagcttggacgaaccctttttctcctattcccaaagtaattttccaggaaaaggactttaatgctctagaacccttttgaaactttagagttagttttcacttctccttgacactgcagctgatttccaaaaacggtctcaatctaccttatttctacaatgcctctgcatgtttgggctcacacggttctcttccagcatgattttagtcctctgacctggactaacattgaaacacctccttgctacaggggaggatccccctcaggcacaggcctgggcaactgcttccctattcaaaataataataaaaaagaaatagcaaggattacttgaggccctggcattcaatgatttcaacatcctttcttgatcaaggttttcataatttagagcctccgtagggacttcctcctcatttctactatgcgtactcgctgactccgcctttctaagatgggagagccctctcacctaatgctaccatgaaaatatacaggtgacataatttataagcaaagatccaattgtccctccctccctccttctttccttcctcctctcccccttccctcttttctctctcttaccctccttttccctgttttccttctttccctccctcccttcttcctctcctcctccattccctttttcctccctcttccttcctccctcccttccttctttctctctccctccattttttccttccttccctcgctactttccttccttcctctcttctttctcccttctcccttcctctcttccctcttttctctctttcctttccttccttccatcttttcttccttcctccctttcttcctttcaccttccctccctccttccttcccttcttctttccttcctctcctccccccttacctctttctttcctcccttcctcccttcctttactcctttcttgattccctcccgccctccttttcttttcctccctccctccctccttccctcccttcgttcctttgtctgaactctctttcctccattccctccctccttccttccttttctccgccatgcacatcccaacatcatttttctgtgctcatcccaaaaccaaaggtttatgtataccaggtatatgtgccttcaaacctagactaaaggtcagaaccatctactttgagatgtctatatagaagcatccagaccccatccacttcatcttggcaaacacatgcgccatcgagagactggctgtgcctgcaggtttagaacgcttgacttaacgcccactgagagtggtgaagtatgtcctggcacaatgcgatcctttctccacggcaccgtgtagtgacagacacgctgggagctattcttgtttcctcctgtcacctccagtgctggaagggaacagtgatggtatgcagaaatatgccctcctgttctgtgagtcatcatctgagtgtgtgctctgcaaaatggcgttaaacttggcagctcacaccatgacagcagataaggtgcatcccatactttctccttgcgggcatcagtttggttcattctctgcacctggtgaccagggaatccttctctgccctggagtgatcgggccaccacccaatttacaataaacaaataactaccaactgcaactgaagtccttgtcatccactgacgaatacctagctcaccagactgtgcccgacagtgaaattccccatttccttcttttatggggctgccatggaggtgtgatcacttaaactatttgtatttgaatccacacgttgcatttcacatgagatgtaagttctgagtaacttccttgaggaatcatttgagtcattctaatacctttccaatgaattaaaagagctcactgcattaatacactcagtgttatttcagggatgtttcccatgggcggaagaaacaaaaatagaggcttcagacggactgacattcgagctctgggtacctcaatgaactctctctacctgcagcttttgatttcagtagcatcagagcgtctctccaagttctagcagttattccttcctcatctcttccagccatgtcagggccttcatgaaagctagaagcaccctcaacacagaccatgaatggcaacgtgaatgtattccctaaatgcagggtggaaatcacaggctctaagccaagtgattttaagaaacagattcatggcattaaaagcactcaataacagagagatcattgtggtattctcttctcacggctctctcagaccttcgtgatgtcttggtaaaagcgtccatttggtgtcagcagtgataacgatcacctcatggaactaattaacttcctttatctttttctgtcttttttcctttttttttttttttatttttttttaataatgagagagccagcctcagtctcatagcctttggaagtcaggaagagctaatgagaatttaacagcattatttagatttcactattgttttaatggttccataaaatgtatgaggaatgattctagctttccacttaagataatcatataaagtttattttcaaatcatgtaaggaggaaaagaaaaagcatatgtttttaatgagagtaagtaaagagagtgtttgcagaccaagtcggtaatacgtttggatgccaatgtagcgaagattgaatgagtatagccatgttgggaaactctcatggaagtctttaggcttcaagaggatgaaattctctgcaagggcagacaccgcctatctcagtgctgtcacaaaagagggcctggccctgatttcacagggtattagagattgaatactgtctccccataaattaagatacgctgaagtcataaccccagtatctcagtatgtgagcttatttggaaatagggtaactgcagatatgactatttatgttaagttgaggtcatactagagtagggtgagcttctaatgcaccttggcagatgctcttatatgaagacggccatgtggagacagagacacacagggaggccgtaagatgacaaagacacagagtgggatggtgcacctgcaaggtaggaatgccaaagactgcacccaaacaccagtaactaagaaggagcaaggaaataccctccccctacagatttggagggaacttggccctgcaagcaccttcatttgcaacttctggccttagaaagcgtgaaccgatacatttctgttgttataagacacaccgtttttggtgctttttttttttttttttttttttttttttaaagataaaggtttcggtctgtcacccaggttggagtgcagtggtgcaaacatggcccactgcagccttgacctcctgagctcaagtgatccctctgcctcagcctcctgagaagctgagactctcggcatatgctaccatgcacagctaaattttttcatttgttttgtagagacggactctcactatgttgcctaggctggtcttaaactcttggcctcctcaggtgatcctcctgcctcggcctcccaaagtgctggggttacaggcatgagccactgcgcccagcatagccatacagttttggatactctgataacagcagtcccaacaaactaataaacaaggtttactttaaaaaaagtattaatttgatttcaatcatttcttcacacaaaaaagaaccgttgagtgatagacaagcatttgcatcaaatgtgggtccctcctctcttctcctctgggtagcctttctcagaccaaatctacaaagtctgattattgaaaggtggtatccaggtgataccttttccactccaaaaacatgctgtactttcgccaagggcacaaaacattctcaaaccactccctacccaaaccactttggaatctttgtacagtatgccagctgctaaacacgtaggcattgaaaccaccagcatccccagatcttctaaggattactgtgcataactcatgtgtggcagggccactgcagtctcagagcctcattccgcacgggaagatttaccctccctgggcgacaggcacatctttctctctcattcagtgtaaagaggctcagggtgatgatggaggcacacactggtagaacagaatgacaccccatccatttccacagttacattattagacaagagaaaatgaaaaaatgccacaatgtttggagctatttaggttgttttgggttcttttctcccatggtttgcagagaatccgctcagcagaatattggcagactctgttgtatatatgctttttgtatattttatattttctactatatttaggccaataaatgagctttcctgtgagatacacatgtatgtgtgtttgtgtgtgtgtgtttatgtatgcatgacatatagcaatatgatacaaatatcatatattttcattttctctctctagttatttatatagcagagaaaatacaaacgtatttgtgtatatatatatttgtatttgtatatatattgtatatatatagtatttgtatatatatttgtatttgtatatacaaatatatttgtgtgtatatatatacaaatacaaatataaatgtactatattatacaaataggaatatctatatttttatatagacattaaatatatataggaatatatatttatatttctttataattattatgatatttgttttcattcctatggccaggcaatcaacacagttccccaagtggtacatgtgctgtgatatccttgcaaattaacaaaagagatatggttgaaattagacttaaaactctgtaatgagggctggtgtgatggctcacacctgtaatctcagcacttttggaggctgaggtgggaagatcacttgagcccaagagtttgagaccagctcgggtgacacagcaaaaccctgtctctaacaaaataaaattagctgagtaaggtggtgtgcacctgtagtcccagctattcagaaggctgatgtgggaggatcccttgagcccaggagtttgagagaagcctgggcaacatagcaaaccctgtgtctacaaaaatccatgtaagggcatggtggtgcacgcctgtagtcccagctactcaagaggctgagatgggaggatcacatgaacccatgagctcgaggcttcagtgagctatgattgcgccactatactccagcctaggcaacagagtgagaccctctttctaccaaaaaaaaaaaattaaaaattagccaggcatggtggcaggcacctgtagtcccagctactcaggaggctgaggcaggaggatggcttgagcctaggagttcaaggaggctgtagtgagctactgttgcaccactgcactccagtgtgggcaacagagtgagactgtgtctctaaaacaacaaggacaaaaacaaaaccgtttaatcagctgttaacagaaccatcatatatgtatgagtcctgcacctgcaggtaggaactctggaattcccaatgggcaattagaactctagtaaaaatctggtttgacagttaagtgttttactcctataacactttaggagtaaagaaaaaaatgagttgccatagatgttgggggagaagctgcctgttactgctgtgtgtgtaagcgtgtgtctgtgtgtatgtgtgtgcatgcatgtgtatgtgtgtgtatgcgtgtgtgctcctgcacgtggcagtagaagcaacacctatattgaggacacaaacaagtggcaaggatagtgataccccaacacgaagatgaacgtacccagttttggcgaagttcgtccagtaggtcatgaccacggcgctgagcatgacgtcgttcttggaaaagttacaactgaagagctcggtgggaccgatcatggggatgccgaagacataggggacctcatcaccatgggccgaatctgcccagctgggcttcatttcgctttggcagtgatgatagaaggcatagaagtaggtgggggagccgtactgcgcgtgcaggtcggcggtggccacggcgggggccacccactggtggtcagtaaagagagccaccagggttttccgccgcgtctccgggttttccttatcggcccagtctgtgtacatgaacttgatagtctcccgcaaagtgtctttcccttcagggtagccgtaaaggttgtccacgaagttggacacggagaagtcaaagtcgttgggcgtcacaccgtcctcgttatccacgatgccgtccacgaacttcaggccttccccttggttgacgcccagcatgatgtcgtagttgaggaactcgccttgctccatcaggatctgggggtcgtctgggatgacgtcgccgtcgatcaccggcccgaaggctatgtggtaggtggccggggtgatggtctgctggatgagctccttgtagttcttgttccgcaggcattctaccatgtccgtggtgtccagcatgttgcagccgaccttgtctgccaatatccgagtgtacttggccggctggtagttcactgcccagctggacagggcggtgccgctctgaatgatggccttctggaagagacctgcaggtgcaaaattgtggacatgcaaatgaaaacccacaggacagaaatgcagcttttactgagcaatgaaggctgtgattgtctctcaggcatgtgagtttctggatgtagtagcattcagctctgtcaggggcccttttacccattttcatttccattcccccttcacccctcctcctgaacattcattttagggaatgttattctacacacacacacacacacacgagtttaaggaaatgaaaccacattgacacttctcctgcactggtaaaatacatgtgatttctttttccttccacaatttagtgtcgtttttgcttccttgcctccagatgccatatataaaaactccaagagcaactgcattccccatttccaagaaaaaaaatgctttaagctagtaccagttcaaaggccctcttgtctcacaagcaaaactaggtatctcttcattatgggaaaaaaagaaatccacttgaatcaacttcagagtgctaattcaggagcgcatttctacttctaccttgagtctaatgaagatattaagatttgccaattaaaataaatacattcagctagctatgcttaaagaaatcctcaactgggtgcccaagtaaggagtattttttaggtcacttctttcaaaactacatccattggaaactcagagatgtgtatattttattttgccacatataaaaatgctccacttgctgagaaacttgaaaaagcatgggcaattttaggagtaaaattctgtgtagcttaaaattctccatgagttcagtctactacacggatgtccagaagtataaaatctgtatttttaactacgataggacaagagaggtgcgctgtaaaaatcagcattccatttacacttgcttcctgccatttccgtgaatcccagcccgagtcgggcactaaagaataaggcattcagttgtgagtccagaagttcatgccctgtcgatttttaaggtcacagaagcaatcaaatatgaggaaaatataactgtcatcaggaagacgtgattttaaagactggaggattgcccaaagatgacacacaggaccgcaacttgaaaccaatatggctttgaccagtatgtcatcaaagccatcctgggaacgtttctgtcagaaatgtgcaagtattgacttgagtgcttggctctgaagattattttaaaatgtccaaaaaaaaaaaaaccaaaagagaaagtcaatatgtattctattggatactttcattagttaaaacattcagaattggaaaaaatgctgtgagaagttcctttcccgcccttctcataagtactggcaataatttaggcagtagtgtatataaagtaacatacataaaacatttatttgtatgttagggaagtaacagaactcctgataagactaaaatagttggataatgaaaaaaatcacccagaattcatactttaaacacaactcaccttagcgtaatgagtatgctaggagttcacataattcttagctctttccctccattcaaatgtctgttttgcatagctgagcccaatatttatatagctgtctaaactgtttttccagctgatgtatatcttaggtaaattcttaaattattattgagtaaatacatatggttcattataattttcctctccttttgatcttgtagcttttcatttcattctttgctacgatactaatactgtggtgaacatcttcataaaactatcactttccacgtgtactttgtcttcattagaccatataaccaggcaaggaattcctaaggcaaacagtctggctatatttatttttattttagacaaggtatcactctgctacccaggctggagtgcagtggcgggatcttggctcgctggagcctctgccttccaggctcaaatgatccttccacctcagcctcccaagtagctgggacaacagatgcgtctcttttttgtagagacggggtttcgccatgttgttcaggcttgtcttgaactcctggactcaagcaatctgcccaccttggcctcccaaattgctgggatgatagacaggcaggagcctcagtgcctggcttgtatttttcataattcgtgattatattgatgggctgtttagaagcatgccttgcagaaatgaccgatgcaaaagtataataatttccaacctattgacttaaataattaacacctccctccaattaatgtggcttacatgtgtttgattactcctgaagttggttctgactgctttctaaatctacaattgtgattatatcaattgagaaaagtgaaaatcgaggtattttcaaaaatgccatagaaatctctctaccaaatggttcatcagattcttcacttatcgtgtttttgaaataaagttaatacaaatatgagcctttcctctcattagcactagtaagaaatcaaaggccatttggtctcatgggcaaaacattatgaactaaaaactcaaggaattcagagtttggaggatttcaggaaaccctcatctgtcctatcttgccaatgaagacactgaggagcacagcgatccagaaacttgtccagacggtgccgaagtgaagaaagtcctgcagttactctaaagaaagatactttttaattttatgtatgtatgtatgtatgttgagacagggtctcactctgtcacccaggctggagtggaacctcacagctcactgcagcctcgacatccctggctcaagcgatcctcccacctcagccccccaagtaactgggaccacaagcatgcgccaccaggcccagctggtttttattttcatttttgtacaaacggggtctcgctatgttgaccaggctggtctcaaactcctgggctcaagccatcctccccgctcagcctcccaaagtgctgggataacagccatgagccaccatatccagctgataactttaaaaataatcattcgggaggtcgaggtgggtgggccacttgaggtcaggaagttcgagactagcctggccaacacggtgaaagcccatctctactaaaaatacaaaaattagccgggcacagtggtgggcgcctgtaatcccagcaactcgggaggctgaggcaggagaatcgctttgaatccagaaggtggatgttgcggtaagccaagattgtgccactgcactcctgcctgggagacagagtgagactccctgaaaaaaaaaaaaaattccatgaaggttttgagaacttcaggttcagtcagtgtggtgccattctgaagaccactgacaacacagaacaaattacaaagctgtcttgatgactgagacggctattaggaatattcacttgcgtgtggccaggcaacccagggctggatctgcactgcagattttcctgcctcttccttttaggccacagccaggaatttgtgatcctgcttccagaaccaattgcctcaaattcctgtggactcctctttgaagtctctcatcggatactgcagggagcctccttcacaaagggacagctgggaatccactgagtgagcctccggggaaagcctcaggcactccagcagggctcaggggtgtggctgcctatgctgaccattacttaggcagcataaccatctactgcttaggcgtccaagtgcacatctggttgggtacgggtgcctatgctgactacacgttcaagtgcacatctggttgaggtaacatgatgcacatgtgtttttgtggtttcctctttctccactttgccaacatcagctttttccaggttaatagcagggccccagggagggtttggagctcccacggggacaagcagaggacctcgtgctgactggcccagcaaggaggtccttcgtgaaagtcatatttgcaggagagagagagaggaagggagaggggaaagcaaactctggacactccctagtgctgcatgctgacctgaccaggaaggaggtcctttggtgaaagtcatatttgcaggagaagaagaaagggagggagagagagagaaagaaacaaagagagagagggacagagggaaaggggggaaagagagagaggaaaggagatagtgagtaagagagtggggagacagagaaaaggagagagaggaagagagagagagggagaaagacagggagagtggggggacagtgtgagggggagagagagagggagggaggagagacagtggaaggagggggagagagagggtgagagacagagcaaaagagagagagggagcaggagagaggtagagggaggaggacatagagagggagagagacagagaggacgagagagggaaagagaagaatgggaggggaagagcaagggagggagggagaccatcagggagagagacactattcctctgggtagaatctacttctacccagaatctacttctaaatgaatgcaccagacgtgtttcaatatttccagaagatttaaagaattaatatgaattagagagaggagcgacttcttaaaaaacatgtggctaaaagccctgatggttacaaaatctatacacccgcatcccttatcgacatactgtctctcttccatactacttttactaagttgtagctagaagttaataaaatttcaaatagtcaaatacagtcagaatggcaaaaaaaaacaaaagtgtcaggacttctaaagtagttattttgttccaatcattgtaaccaacacctaattgtcacacatttaaattaggagaaaaatattactgatcaagcatggtggctcacatctgtcatcccagcactttgagaggccaaggcaggaggatcgcttgagtcctggagtttgagaccagcccaggcaaacatagcaagaccacttctctataaaaaattttaaaaagcagccagtagtcccaggtattcaggagactgagatgggagaagccttaagcccaggagttggaagctacaatgagctatgatcataccactgcactccagcctgggtgacagagcaaatggaacaaaagctgagttaaaagacatgaagatggattcatttgatcttttgggcattttctgttgccagagtgacttctggtaaccaggacatgcatctgagatatgaactctgaccattcatttcttggttcagggtatttgcccgcccaccctgggggtgccattattaccttctgagtagtgggacagggtcaacaggctgacacaggaggccccagcccccgagccaaagatggtcactctcttggggtccccgccaaaggctcccacattctcctcaatccaccgcagtgcttgaatctgatccaggagcccatagttgccttttgctgcctggtcaccggtacttaaaaaccctacaaaagaacacaagatatttttggtggccaaatagaaaaagtgcatacgtgtctctgctatttgaaaagatatctcatagcttgtcttcttcattctctctctcctcaactctcacccccaccaattagaggaagaacaggagaaaaaattttgtggcagaaataattatataaataatggttattttaggttgatgttatgataccatggcatctttgtgtatatatgtggctaatagagaaggcaaaatgaatctaaaatattaataacatgaagcaatcccagaagacgtcgtaaattttactaggttcaaggtatcatttctgtgcacattttcattttcttttttgaaaaatgcaacagactcctacaagaaatttttcagggaaaacagtacgtgtgtgggggggggagggggcgtaagtgcacatgtgtgtctgtgtctaagaatatgtgcatgtatacaaaggcagtgtgcgcctgtctttctcactgaattagttattaacattttgttttaactcctttcaatgcttaagaaacaacgtaagttacagactccactagatccgactcgtaaatagtatacacctctattttcctacatagcgaaaatattagtcacatacaaaaaaatgtaattattgaacctcacccaaaagctaatgaatattcacatctccccaactgttcccaaaatatcaggaactggccttccttattttaaaaagaaggattctgtgagttgaggatctagattttactcaaggcatacgattcttaatttctccttagtagttgaaaaatggcaattttggtattaatgatagcaaagttatgagttaatctattttattttttgttccttctgtattgaaaaatagcttgacctggaaaaactgctttcttctgatgttttgaagtcaagtttgggaagacatacactctcctactcagattcaaaactaggaatattttctaaggcctcctgcaagtttagttcattgcataaactttaatccaactttatgtccaaatctgtactggatatgccttccaaaaagacaaagaatttttaaaagtttttttttttaaccattttcacgtccttatttgagccttccccaactacccaactatgatatttgccccttctatacaatttcttttttccaagagccatgtcattcactcatttcaagggatgctcagcacattattatggccacctgcagtcatgtttgtatgaagacaggctgctttaagccctaaaataacatcaaaccaattccctcaaagcacgtccctaaccaaagttgacggcattccaaggagtgactgagtgccggcttctacttttaaaacaaaaagagtagaggatgaggctgcataccaattgagtcaaccagcatttcttccatgagctttcctgagcacctgtggaaaaatgctctgagctggaaaggaggaaatggcctggctccaaagaaagtcacaggacgattttcgttcaacaatgacaataaaaactccaagcctgaatcgggagtcactatctcctgcagcttcaaagagaggcagcgtcgcaactgcgaggttggatacttaagacacatcctaccaatgtgatcttctttaaagttcagagggatgtgacgggagattagctacgattagtgggtgcgatcagacattacccaagcctcctcccccatttaattagcaattactaattagtgcttcatgccaaaaatgttctgcaacacctgtctccatcactatatctttgacacgatcgttcataaaaggcatcaggctttgcttgggagaaaagatcgaagatccttatatgacaatgacgaatcatgtcagtttaggtgccctataataccacagggcaatgctttcttcccctattaaagaaagaggtgattaattcctaaggcacgagcaattttctaacagaacgattctgtcttcagcacgtcttttcttcactcactgttctctctttctcaattctgcagaatgacttgttgacttattttgtttctgtggaggagtatgaagattttcaacacgcaggaaatcattggcctttcttccaccataaactcttcctccctagcaaaatcagagtgttttaacctttccaaaagcaggctaatgaatatcccctgccttcaaaaatcttagttcttctaacagcatcctattggatggtttgatctttgaggttctgaaattcttccaaatatcctacaggctggctgagggaaacgacaatccatggatctctgaagtttaacaaatcaatgtggtgttttgaggctggtgtttccacagtttctgccatggcattttcatttattgcaacatccagggattattatttttttctttttaaactatcaacaagggggagtgcctgtttcaggtacacaatgaatgcaataattttatgctctttaagagtatagtcctttcaccttgaaaccacctttgcaaaacttacaatagtcagacaattatgacagtgaaagagatctgacctaaccaactccatcttgcctttaacctccatactgttcttgatcattcctgggcacgggccaagctaactttgggagaaattgaacttgtagtttaaatgataatagcccctcttaaaactaaaccacctttgtaaaagtaatgaaaggccaccaggttaaagaatgagagaggcctgaattctgctaagatgtaagcttagttgaatgattaccagccattattccagaggtcacaagatttgcaacttccccaatcactagaagctaaaatttgcctttttaaaacttttattttaggttcaggggtatacctgtaggtttattatgtaggtgaactgcatgtcacaggggtttgatgtacaggttatctcattacccaggtaataagcatagtacagattggccttttaagatgtcttttcaggcttttgcatttctgacaactgattggtcctactaggaccagtgactcctctgtgtccccacatagaggccgactgggtgcaccagggctgttttccacacccctatcattgcatcctcaaccaatcagcagcactcattccctagcccctgtctgccaaagtattctggaaaaacccaagcctccaaatttttgggaaggctgatttgagtaacaataaaactccagtctcccatttagccagctctgcaggaattaaaccctttatctattgcaattcttctgtcttgactaatcagctctatctgtgtagtggtaaagatgaatctgttgggaggttacattgttttgagggccaaatcatgttttctataaatcagacttaaaaagcatgtgggcttactgatacagaattctatgagcccagaaagttagcatttgaaaataaaaagacctgttttcccaagtcgcctgatctgtgaaaattagatctcactatcaatctgtcttcttctttattcatcagcacctggccaggttttcctgtgaataagactggaggcaaggaacaggcagcacactacagctctgtgatgtgatggagcagggagagggaaggagggaaggagggagggagggagagcaggagggaggaaggaaggaaggaaggaaggcaggagggagggagggaaggagggagggagggaaggagggagggagggaaggagggagggagggaaggagggagggagggagagcaggaggaaggaaggaaggaaggtaggagggagggagggaaggaagtaaggaaggtgggagggagggagggaaggaaggaaggaaggaagaaaggaaggaaggaaggagggaaggaaagaaggaaggcaggcattttcctggcaaagctatcttcttaagtgtaaataaagagtgatcttaaaaaattctaatggtgtgattttttgcaagctttttgacaccaggaatcctggtatttattgtagcaaattaaaattaatatttttaggaatcctgcaaacctaaaccactgggttttgcctcctgattgtagaaagcaaaatgatggtagctcatcaacttggaaagagccacacatgataccaaagatgagtgctgctcctgagaagtcattcctcggatagatcacttaactttaaatatatgttcaaggtgaatgaagagaacaagctacttgattgtctaaaaccagagatttacaacaaatggctcctttaactgacaggtcctttaggctacaaactctctaagcattttagccgatgaaattttggtttctgagctttactctccctaatatgaagcttgtaatcagcaacctctcctccaataattgaacaacgaaagaaagatgcaaaagagaccatgtgaatgaatccatgttaatggctacattgatgccaagtttcatccagggtcctggaaggaacaacaataacaaatatacacacacaagagatatcaatagatacgttcagtgatctggtttggctgtctcctcacccaaatctcatcttgaactgtagctcccataatccccatgtgtcatgggagggacccagtaggaggtaactgaatcatgggggtgggtttttgtcatgctgttctcatgatagtgaataagtgtcatgaaatctgatggttttataaatggcagttcccctggacacattctcttgcctgccaccatgtaagatgtgactttgcttctcctttgtcttctgccatgatcgtgaggcctccccagccatgtggaactgtgagtccattaaacttcttttctttatacattacccagtctcaggtatgtctttattagcagcatgagaacagactagtacatttagttagtatggttatttagaaacaggtttcatggaaaagatgactaaaaataggaatcacagtttttcctgctgcatgttgactgaagtgaatatcatataaacatgaatatttctattcaggcttaatattgttgtcacaacagaaaagtttccaatttttattatagataataatgtagatgtttcctctcattttgaattacatcacagggcttaggagaatgactgcaggtcttttgtttctccatgcactgcaagtaaatggtaaggaacccaatggggtcagatattgtttttctttcaattaacaaaagacattgttacatgacgttaaagctgcaatccattttcttttaggagatcattccttgcataaacacagtaggcattttttggagacaagtaaccaggagataattaagtgaatacagaagttaaatatctttcaccatttcagtgtgtgtaattcacctgatatgtgtgtatgtatatatatataatatatgtatgtatatatatatatatatgcatatataaccatatatatgcatgtgtgactataaatgtatatgtacacagacatacatttgtgcacctttaaactaaagaagtgacaccaaacagaaaatgtttaaataaaaattcttcagtgagaataaacagaatttgtgttagatcatgcaaatgaggtcaaaaagaaatctgtttggttagaatgaaagcagaagcataaaaaacaaaaatcagtcaaacagatgcaaaactaatctttgacggttataggaaatcattcatgaaatgcatttattacaaggtgaacctttaactttctgactgaaaacatgtaggatttaacacagaagcacacattgcacaggatgggctggaagggagggaagctgatgcactgcattcaaattctgttgcctgataggcagggctgcttgaaattcagtgccttttatttttagtttttacttaaaaatggaatgagtactagcagaccattctccatttgtatcatgttatcacagcagtattgcacagaaccaaagtctatttccaatatcagtagagaaaatctaaaacaattataagagacaaatgatttttataccacaggtttccaaactctggggcctatgaactactactgagattccttgcagtattttcataaaagataatatctccacacatttatctagaattaagctgcataggtattttttaagtgctttagtttaaattacatgaaataaaaaaaaactgaaattgatcatattttaggaacaaaatataaaataataaatacagcttgtttattaaataataaaacatcaaaatctgaagataattgatacatgagtttcatgcaaatgaaaatttgggaatagccagcctggaaacaaatctctttgagtcaactttgagtctttttttgtttttgagacagactctcgctctgtcgcctaagctggagtgcagcagtgtgatcttggctcactgcaacctccacttcctggattcaagcaattctcctgcctcagcctcaagagtagctgggattacaggcacacgccaccacacccagctgatttttgtatgtttagtagagacggggtttcatcatgttggccaggctggtctcgaactcctgagctcaagtgatctccctgcctcagcctccaaaaagtgctgggattacaggtgtgaaccaccatgcccagccaactttgagtattttcaactgaacactttctccttagatatttctccagatttgctgctgactctcattcaattggctgtcacatcctttggttttagttttcaaagagcttgtacatcttgtccctccctgggtctgcatcctagtgtctgagatgagaactacagttccccaggacctgctcatttgggtgctacgtccttttagcttcctctgaatttccacaccatcaacatcatcatgatggtctccagtgtaagagaatgggtaaaacccaggaaaatgaaaattggaaacttctgacccaggagtcctaattctttgaatgctttctatgaaaatctttattctgatgcataaaaatagccacccaaggctccacaattcacacggattgtaattttaaaaacaaacaatagcagcaagctgaatgttcacaagtcagagatttgaatggattgtcttggttggatccatattatgagatgctgtttgtctgcataaagtgctaaggagtatttacactcatggacacagaaacacatctaaggtatctcaagaaaaaatagtgggctactgaatactacatatcatttattttattttatatttttatgtattttttttgagacagagtttcgctctgcttcccagactggagtgcagtggtgcaatctcagctcactacaacctctgcctcctggattcaagcgactctcctgcctcagcccaccaaatagctgggattacaggaatgtgccaccatttgctgctaatttttgtatattttgtagagatggggttttgcaatgttgtccaggctagtcttgaactcctgacttcaagtgatccacccgcctcggcctcccaaagtcctgggattaaggcatgaaccactgcgtccagcccatttgttttattaaaaaataaaatctggaaggaattcaaacagtggagggtgattatttcgaagcatgtgactatagggaatattcacgttttattgctaatatctgtttatatttagttcataatttaaatctccctttttagcaacaacaatcacacccacacaataaagtgaatgtgttggagaaacaaattcattactgggaatccaagggtcattctgtgtgggcccatgtgaccttctcaagggatgccctacttatgttctggagcctgcaaatccaccacaacacttgctagctatttccagaatatgccttgcattttgatatgcttgcctttttatataaaatccccaagatctagggcgccctctgcagggctgctgggcgaccataaattgccctgaacaccttgcctgagcacaccttcctgtgggctatggccgcacacaaagctgcacggctagctcatggacccagcaccatttgaaaggtcagtgtgacctgaaggtcagtctctgcatcttccgcaggggtcacctgcatactcaggtagaacctggccatctctttctaccaatgtgggcccctttccaaaagtgtcctgtgtgattatctttattctctcggcacagtaaatggctttcaatgaatttctgttacagaacgtatcactttacaccaagggcatttgcttggtgactgcttttggagttattgcttgcagtggattcagttggacatccttgtggtggaatctattgcaaagccttaagcacatgacttaagatttcaaagtcccactttctttatatgtgaaatggggaggagaatagtagccctcccatagcaagctgaggaactcaactggacaatgcacaagaaacagcattgcgcttggtgtggaatgtgttcaaaaatggttacctactagcctgctttcatgaatatcagaagccatgcagtttagttttgcttcatctacacatactaggaacaaagaaatgtccttcaaatatatgaaaggagtccaaagggaaaaaattgactgctggtcaaattagactctgactctaaaattatacagatggtaaagcgagattgtgtgttctctgatggtattttaaagaatgaattagataccatttatttgtgaataattttgcataaagggggtatgtatttattcaatctgcttactaagtgtttattatgtgtttaaagtgaaaagagaaagacaaggcaaaaaacacatcatagcttttacttatgctatgagatttacggcaaatgctcattcaacaatgtatgaagtagccatgatgacccaagcaaaatctgggggaaaatgatgcggtagttcagtgcatttccatagatatcttgaaaaattacagaaaaggtttttttttttttatttacgttttcatttgtttttaatgagactattttaaaactcatttgaatggaaagtaatatttttcaccatcaaagtatggagataaaacacatattaagatacatttttgtacttcagtgctattcagggcactgtaaaatgcacataagtaaaaagacaacttatacaacactatattagatgaactagaattcatattagatgaatgaaaaagtaatgcacatatattagacgaattagaacttaggtgtaatcacatgcacgctagcaaagtaaatatgacagcacataaaatagctaaaatcccagtggaatgcttagtttcaggaatagaaaggttattgaagaagacagacaatattttctagaattgaggaagggcaaattatgcatgtattgtaccttaagctacacactaaaattgtcctgctggcttgccgctttaaccaaactctctgcctctttaagttcttaattatttatactatttttatatgttctaacattaaggtttttcttttctttttgccacttttctttttgaagatagctacatcctaattctcatcttcctgttatcctcagccacaatgcataactgggatgtcttttctaagcctgaagtccgcaacttttcttacaaaacctgaaatggtggctcgattttgagactgcatcagagaaattagtgcaattctgttttcactaagcaggagggatgtttgatttgagagcagttacagagttccattatatctcttactatactgaagtttattgttagaattgccaatgatttgtcatttttggtaactgtcccagtggtgcttggaagtctttatttacggagagatttaaatagctggggctaagatttctctctgagaattaattaaacaaaaaaatgattaaatggatcacataccagagtagctacagtcaaactcatctctgttctaaaaactagattttaagcaaccatcatagtaacaattctccacttcagaacttttatctcacaaacctttataggctccaacaaagcaatcctcctgggcaatatatatatatatgtagcatagcatcttaatctctgtctgacgtctgtttcaccttcagctcttctattgttccaagcttccagtttctgtcttataaggatatttttattacactgagctcacttagatacttgaagatactctccccatctcaaaatctttatcacgtcagtcaagtccgtgttactgcataaggtaggatgtgaacatatgtagggggctgttattctgtcctctacagcaggggtccccaagccccaggccatggaccagttttggttagggactgggccagcaggaggtgagtggtgggcaagcgagggaagcttcatctgtatttacagccactccctaccactcacattaccacctgagctccacctctcgtcagttcagcggtggcattagattctcataggagtgtgaaccctactgtgaactgcacatgtgagggatctaggttgcctgctccttatgagaatctaatgcctgatgatctgaggtggaagtttcatactgaaaccgttcccctacttggaaaaaattatcttccgtgaaatcagtccctggtgccaaaagtgttgaggactgctgctctgcaggttgcctgacttatcattgagttgggagatatttttatatattctagttacaagtcaattctctgctatattagttgtaaatgttttctctcaatctgaagcttgctctctgagttcttcatggtgtctggaaggccccgtcaatacattctcttgcggttcttacattttgtgttctatgtaagaaacttttgcataaccctagctggcaaatatttgctcctatgttttcttctaaacaaagcctctctgaagaggtggaaatgaaaggaaatgatgacaacgaagcagctacaagatgatgaaagggaaacattcctgaaaagaattacgagttgcgaagtttcaaatgggaaatatgtttaaagggtgaggagaacagaaggagtcccggtgtagctgactcataattagcaaggaaatgtgaaagaacgttattccagtagtaggcaaagtgagttcacacttgaaagagagagtaaaatgttggaatttattgtaaagcaatgacaaggcataagagttggaacatggcagggatgtgataggatttatggtttcgtaaagctcacaggagccactggtggacaggactgcaggagcgtgcatttggaagaagtccactgcagttgtccaggtgaaagttggtcctggctttaaccaggttagtggcagtcagggtggaagacattcaacatcttctggacacatgttgtcagggtgcttcaggctttggtgttaatacaagatgtgaatatgtggtaggagtggggatttgatgtttgctctggtttgggttcatgataggtttggatacgtgtttgtgaagagtgcagcatcatccaaagagtgtcagttgtaaccaagttattgaacctgggtaggtgcccttgggatggggacgtatcttctgggattttcaccctgcctgagttacacacacattcaagagtcctaggactgtggccaaatgattgaatcaatcccagtttctctttctgcacactgggctttgaggttactgaagctccctctccctatgacattgaacaaaacgatgaatgtgaaagaccttcatgcattataaagctccatggaaatgtgagatgctattattatcttgtgcaagaagacaacggctgggtggtagtgatgattaagaaaaacgctaatagcatgttgtgtttacactgcctttagtccaaaacacaacatcttcattgctgaagcatggtgattcatgtgcttttgtatagaaaaaaggcatgtcaaacaagatcacatatggtaagtattttttatatatatatatacatatatatatatatatatatattagacatgtatatgtctaaaatgattccaaagaacagcataggcttatttcattatcactgcaacagtctcaaggtagccaaatttgacagacaaggtcagaaagagttaaaaatagagattcaaatgaaaacatattcactttttttctccgatgtttcaatctcttaatgaccctaagctgcttctcactgtatgactcagcggcattgaaaatgaaccagagagagagagagagagagagagagagagagagagagagagaggagagacagagacagagagagagagaggcagcctaatacttccaagcacaggggcattcctttatttccataacacatatttattaagagctgttctgcatcctgcaaggtgtttgcggggtaagtgagggcaatctctcccagcccctatggtaccaacagcctgggagggctgagctgtctcaggatatatccacaaaaccttgagttgtctgtaaaaatttaaactgcatagactcctccgctgacttccaaatcagaatctctgttggtacaattcagcagtaggcatgaaaactgaaaagttatttctatgcatattcaggatttggggagtgctgttttgggcagatgcattgggcagcggtagctacacggtgttaggcttttaagaataaacttagcacggcccaggtagtattttctagattcaagggtgaaggctgccgtgacacataatgggaagggtctgtctttagtgaggcggtctcaggctttcctgtcttactgttaatatcacaggcgaagctgacagccactgcagaaggaaagaacaaggaaccatcactgccatcttctccttttatctccaacatcataactgctcttcaccaagaatcagagggaaaagggagaaggtttctcttgccggaaatactaatcccagaaccaattgtttttctctctctttttgctttatctgccagaaattgtgaggtaaaatttatgctcaactccagtacctgaatgtctttgttccttttgctttgtgtgtcagatttcacctcttttatttcttcgtggggagggggggaaacaggagaaataggttctcgtgttccatagcactgcagggtgactgtagttaaaaataatataatatgtagtttcaaatagctagaaggaggaaattgaatgttcccaacacaaagaaatgataaatgttttagataatggatatgctaattacttagatctgatcactgtatattacatgtattggaacatcagtatgcaccccgtaaatatgtacaattattacttgtcaattaaaactaaataaatgaaatgtggggagtactttatgctgtactgcctcaaactgtctttaaattaagcaaaactaatattaaaacctatatgaaggcagggcgcagtggctcacacctgtaatcccagcactttgggaggctgaggcaggcggatcacctgaggtcaggagttcgagatcatcctggccaacatggtgaaacctcgtctctactaaaaatacaaaaattagcagagcatggtggcacaggcctgtaataccagctacttgagaggctgaggcaggagaatcgcttgaacctgggaggaggaggttgcagtgagccgagatcatgccactgcacaccagcctgggcgacagagggaggcaccatctcaaataaataaataaataaaataaaaaaataaaaaattaaaaaacaagaaaaaccatatgaagatatctatgtatatctatatctatttatttgtgtgtgggataagtttgccattttgatcattttaaaatgtacaattcagtgggattcattacattcacaatgtggtataattatcaccactacctatttccaaacctattcatcactacaaacaataaccctaactattaagccatatgtccccattggggaaatatttttttattttttgagacaggatctcactttgtcacccaggctgaagtggcgccatctcggctcactgcacccttgagatgcattgggcatctctagctcaagcaatcctgtgctcaagcaatcctcctgacccagtgtccccaagtagctgggaatacacacttgtgccactgcacccagctaatttttgtattttttatagagacagggtttcaccatgttgcccaggctggtctcaaactgcaaagctcaagcgatctgcctgccttgccctcccaaagtgctaggattacaggcgtaagccactatatcagtccattttcacactgctcatagagacatgcctgagactgggcaatttacaaaagaaacaggtttaatggacttaacagttccacgtgcctggggaggcctcacaatcatggtggaaggtaaaaggcatgtctcacatggcagcagacaacagaagagagcttatgcagggaaactcccctttttaaaaccatcagatctcatgagacttattcactatcatgagaacagcacaggaagggcctgcccccatgattcacttgcctcccgctgggtccctctcacaagaattcaagacgagatttgggtggggacacaaccaaaccatgtcagccaccatgccagccttttggggaaatactttgaatggtgttcatatgttgagttacccataccctgagctaaatctgcttgattatgtgtgatgtctgtatttaatgaccaatgtgattgcaccaaccattcctacaattgatcttgttgaccaggacacctaaatatacatgtctccaagagtaaacattcaaaatagccctcaacttcttaagactcttaaaatcatgttgttggtttgtaatctacatttacataagtaaatcaattgtggattgtgtttcctttaattagcagtggggggatatcggcaagtgatggaaaacagaatgcattttatctaattctacaagattgacttgtacatttactaaaatcttccactctggaaagacttctggtcagcgaagatgtatctgggtccacagcaatttgctgaatatggaatcatggctaaatttcaatgggatgcctccaaaacccaggacaatgttcagtttccaagaaagatcctattaggttcaacatattgtgttttacaaaatgaaattatatattctcatacttctaaatgctttcaaggcaaacataaaatgaaaaaaaaaaaacctctctaattgaccacatttaaatagaaacttcaaaaagcacctaacatctttatgcaaaatgccttacaatttttaaagttcttttcacacattacctcatttcctttgtgttcctgaaactaagatggctttcagtaaacaatttttctagtgttctggcttatgttcgtggccaaacacacacattattttaaaagcattgggtcacaatgtggaaccaacccaatgcccatcaatcaacgagcggataaagaaactgtggtacataaatatatgatggaatgctactcagccatacaaagaaatgaattaatggcattcacagctacctggatgggactggagactattattggaagtgaagtaactcaggaatggaaaaccaaacatcttatgttctcattcataagtgggagctgagctatgaggatgcaaaggcataagaatgacacaatggactctggggactcagagggaaagggtgggagggggttgggggataaaatactacaaattgggttcagtgtatactgcttgggtaatgggtgcaccaaaatctcacaaatcaccactaaagaagtgactcatgtaagcaaataccacttgttcccctaaaacctatgaaaataaaaaaaaaaatttaaagtcccaattcattaataataagttgttttgcaagtagacagctgcttatcacccaagttctttcactgccttcttctcctggccccaaactgcccatctcataagcttggtgaaaatatattctttctacactcatcaaccacactaaacacttagtgatattttaacaaatactgatgcctatgtcccagtggaagagattcttaatgagctgttttggggttagtgtataggcacatgtatttcaaatacgtatatatatctgaatacttttaatgaaaagcaaatcttgtgatccacacatttaaagagaaagcaagtgaaaatattgacaccctcttttccataatacaattcttcttctcattttcttacatcgttaattccttatggaaatcaatgaaccgtcccatcaaattttatcaagcataaacatcacagatgggtttgggaaagaaataatagtttgcaacccacaccctcaattttagattcaggaagcctcctcccaggtataggatcttaaattttgcatttctaacaagttgctgctttgtgaaccacattttgaacattactgctgaagaacaccccatgttctagaattaacagaatgtttcctaatcacatcttgtttttcttccttagggttatggtgccctttgtaggaaacaacgcacccaggaactgctctgtactttatactgaatttaataaggacttacatgatacctgctagtgttacttttaattatcttaagagtggttgataattacattcagttggtaatgaatcccaccatatatatatatatatatacatacacatatatatatatatatatatacatacacacatatatatatatatatatatatatatatatatatatatatatatatatataaacctgcgaagcttttcaaataatcagagataatttcctagatctcttattgatatggtttggctgtgtccccacccaaatcccatcttgaattgtagttccatggccacatgttgtgggaggaaccaggtggagataattgaatcatgggggcagtttcccccatggtgttctcgtggtagtgagtcagttttcacaagatctgatggttttataagggatttcccctttcaatgggcactcatttctctctcctgccaccaccatgtgaagaaagacacgtttgctgccctttctgccacaattgtaagcttcctgaggcctccccagccatgtggaactgcaagtcaagtaaacctctttccttaataaattacctagtgtccagcagttctttagatcagtgtgaggacagattaatatacttacttaatttggagtttcacaaaataatgattttcagatagtattgttctttctgcatatattatctgaaattttacttgtaatcaccaattttttagttactctgaaattcaatatatataggaaaagtgggaaaaaatcatgattcttttattgatcaagattcaggaaaatgcgatcgtggcctagtaatataaccagtgagttttattctgggtgtcatgatgaatacatgaacttttatgtctttatcattttaaatccagtacaaatattcttacagatgttctaattgtcccattacagctggtcagtttcttctggttgatatttgggcctttgtgtttttattgtttctttgttttatacatacatacacatgcataagtctctctccctacagagagatatattctacctctagagagcatacacacacacacacacacacacacacacacacacacgttcttatagactgtttcctaatcatttgtctagagagagagaatacagatattcttatctatctatctagagactatatctctatagctctaacatatctctatatcttctatctatctatctatctatctatctatctatctatctatctatctgtttcacaggtttgctctctactccgggccccagagtgctaagaggatacatgtatgtacatatgtatgtatgtaaactaaattatcaacaatggttttcttttgttaaaaaagatttttcttctgtatgatctttgatactgtaaatttatagcaatgcagatatattgttttggcaatcagacaattagaaaaatataaaagactgtatttaaaggaaagaagatatcatctgaaatgggatacagaaagacagttcacacaaaaaaggtgttttatggccttggaatagtttcaggaaggaacgaaaatgcagtcacaggactgttcttgaatccctacagccaacgtttgatcaattgtactttctgtagcatatctcagaaacgactgggagcaaattgtatgtggagatgtagaatgtgtcaacaaacttgaagagaaatcattaagtattacgtttggagttcagcccaaagcaaatatttctgtattataggttcttctaacagatggatggtataagtggttcaatactattcttgcctaggtcctcataaaagcaccagagggaacaagaatgcaggtaaaagagaatttactttacttcttgcagcgctaaaaccagtccttcaaaaagacactgcattccccatgcatctgcacaggcattaggactcacatcccccgtgtgactccaccacacatctggtaatgatttctgcctgtaacttgaaggattttacctgggtttcagctctaacttctcccatgcttgactaagtcttccaccactcagatgtcttattcgagcctaaagctcagtgtgtgctatattgagctaaacatctttttctcattcaaactcgtctcttttcttatttcccgtgttaatatcacaagaatgtatccagctatacaggttaaaacacttgaattcatatttttaccatggcatctctttgtagaatcccagtatatggttaatatttggggctcactgattagtgtttaaatcggttatcacacccattacttccttttcattcctacacgcatctgcaactccagggcaaaaatctgtatccactttaaatcactgcctgccagttattcctctgcgtctaaacttttcagaatgcccagacttggtgttctatcttcatgctaagtctcaattaaaatgtattttacgcaggaaggtttaatagttgtgttatataaacaagattaagatcctaggcttatcttccaaagccatacacacaagctttgttcatctaatatttgtttagtatcttccttctgctcaatcagaatagtcttttgaactctgtgttcttatattcacagtatgtctgtcttattctttcattacatggacactgaataaatgaatacaagtcctcttaggtgacaggtggcctcagggacaactctattccaagcaatcatgtgatgaggacgaggatgatctcagcttgaagtcttttccagcggaggggagggagatttatagtatgatagaggtgtttacattttataacagtgtacaaatattttaggcagtttacttgctggattcatttatctttcaatagacaataaatagcagagcttttgaaatgctattcatcaatagtgcaatcatatattatttaccaagaatgtgtaccctactttccgctgcagtgacttccatgtgaaaatgctgtcactgagcttcatggaagccccttggtgcccttccaaccatcagaaaagatatcatacggatagaacttggtacattgaaatttaattcctctgtcaaataaaatcaccttagccctgtcatacagttatagaaagacttatttttttttttaatttttagtttttttttagagatggtatcttgctatgttgcccaagctggtccttgaactcctgggctcaagtgatcctcctgcctcagtctcctgagtagctgggactatagacatgcaccaccgtgcccagagaaagactcattttggttttagttgatctgctgattaacctgttagaggaaaatgcaatgattattatttccaaagctttgttggaaagacagaagcttgttcattttgaaaaaaaaatctacataagatttaataaactattaattatttttaaatagactttgctaaatatattttacaagatgtattatgtgccggcttggcgtggtggctcacctctgtaatcccagcactttgggaggccgaggtgggaagatcacctgaggtcaggagttcgagaccagcctggccaacatggtgaaaccccatctctactaaaagaaaatacaaaaattagccgggcatggtggcacatggctgtaatctcagctactccagaggctgagacaggagaatcacttgaacccaggaggtggaggttgcagtgagcgccactgcagtccagcctggacaacagagcaagactctgtcacacacacacacatacaaaaatgtatatgtgtatacgcatcttataaaatatatatgtgtatatgtatatacatatatatacacacctacaatgtagtgtgtgtatatatatgcatgcacacatgtgtgcacacacacatatttcacacttattactttgatattctagaagcttttggttaagcttacatgtataactagaatattgttgaataatataagggaaaagaaatatcttttcttcctatcttagtttcatggctgaggcccctatgacaaaagacagattaagcaaagagtgcacttcatttaataacagttttatatgacacaggagccttcataaggcaatgaagacccaaaagaaacagggaaacctgtggatttttgtgcttagatacttaggtttgataaagagtggacagtcattggaaagtatgattgaagtaaaaatgtttattatctaatgggaaaaaactggggagaacttagcaaggcctgtgtgttcagattctcctctgtgtccttttgtcctcagagataagaatgttctattcctcttggtatagagagtcacctctcataggagggtcttatgacctggctttaggggagaaggatggggagaaggtcagagagaactttcctgcttcttctgttttttcaaatgctaaggtgccatatttatgggtggtatgccccatcaagaatgctcattaagtaggcttctctctgtagttatagactgggataaattaattcttagccctatataggacagatacatattttatgaaaagagtaactggcagttgagcaacaataagaaatgtagataacacacaatcttaatgacatctgatgcttctgtgcagtagcacttaaacggtgtgcccttataccagcagggaccctactttgtggaaagcaggtagatgcacaaatcctcacaccctcccctaaagcaacagaacacaaattgtgggggatggaccccagaatgtgcctttcacaagcccttggtgtcattcttttaaatgcaaaagcatgaagagtatcctggtagattgcatggatcacagaaacaactataacccaaaataatgaattccaataaatatatttcaaagccaccaattaattggatccagtgtcatctgctagataaaatatgtatgcaagaatatctccaggcttgcaaataaacatgatgcattatattctgtgctgccaaagaaactggggtgctccctctccccgctgaatctgacatttgcatgaggtctgtggaagtgaactgtggaatatccacctttgcaaagagaaatatctaccaggtgaggaatactggttttatcttgatgatagcataaaaagaattggctccaaatatatgtatcaccctttcaattgctctagctcatccttccctgttgctgtctttcctgatgcattcctaggtcctggatcctattgatttaccccatcctgtctgccacagttctttaaacttccagttcagctaccacttatcataagggactctcatggcagtaaatgttccatcactttcatccataatcaggggatattatatcctttgttttaatacaccacaaagaagtaaaaaagctccacaatggatctatatagtgatgggttgggaggcagagtggggaaatgtagtggatttgctctctggagctcatacaagtctttggttaaaaattcatattgcaataaaaaatactcaaagaagttctaatatacccttcattgtccaaattgtcattatgaattacttaatattttggcgtctatagtcatagctatgatatacgctgataaatgagctgtgatattcaaaaccagaacattaggaaattgttcctggaacatttgggattctttttagaaatagatgaaagccatttagaaagttttgacaagtaatgaaataagtatatatgttgcatttcctgggtaattttgttaattggtatattagctaactacatctgatgtggtctgtgggaatgaaggaagctatcaaatagttaagtatttcaccatttctcaatcctcttcagtccaaagtccaggggcaggtggtggcacagattcatttggatggtttagaatcctacctttaatgagaagcatacacaacgtgggaaaaatagtaatatatccaagaaagagagttatgcttcttttgagatggtgaatagaacataatgccccttcctccacagaaatctacttttgaaaaactacagaggataagacgaggcatcaatctgcggaaagagcaataatagaacatgaaatcagtaagctataagccatcccgaggagattacaagctgatgaatcatgtatatatggtgaatgggagtggctgcaccttctggcagagggtggaagtggtaatagaaagatgctggtttaaaaacaaagtattaagttcactcttgtctcttataaagaatgccttgagttaatcattgtctaatctccctcccatcttctcttctccatacaacttagaactcgagggcagccatcaggtagtgggactctggcaagcccacggaaaactcagctgcgttgaggagctggttaaaaactttcagggccaccagtcacttatggccactatgggcttttcctgtttcacccccttcccctccacacccccaggaatgaagctaaagaggctgtttcttcctaatgctggctcctttagagagtttaaagccaaatctcaaatttcaaacttcttcagtgcgccagagtgatctaaaagtgtttgttgaatgttaatctcatagaagaaacatagacttgggtctgcccttaggtcccatcacatgcgtaattacaaaccagagtgatggatgagtttccactcacctaaggagaacacaggctaaatgtttaacaaagagctatatacctgaacatttacaaaggtaccaaacgctctctctcaacagaaaaaaaaattcttctacgttaaatataatgattggaacagatcaatgaagaaattacaatagacaaaataaatatattcgatcacctaagggaatatatttcaaataggagattataataagaagtaaaagagaacttggtaaatatagtaggtatagaataaataatagtaaagatgaacaagaacctaatagttaagataaatcatagaatgaattaccaaattggaagatcagatggaagaaattcccagaaagcatcaggaaagaataaaggagagaaaggcatccttggaaaaatggatgactttgttagagataccaggatcaggtaacagaaagagaaaaaaaaatacagaggaagaactaagttgatgaaagaatgaaaatacacttgaaacaaacaaaaagaacaaaaaccttattttgaatgggctcaaagagtgccctgaatagatatattactaagaaatttaagaacatcaaagacaaacagaaaattctaatagccttcagagagaaaaatgggtgagctatgaatgaataggaatcagattgacatcaaacttcccagtcatagcacaagacattagcagacacaggagtcatatttgaaagtttgaagaaaaataactctgaatttaaaaaaatttaatactataggccaagttaaaaaaaaagatcaaaaagagattcaatcattttgctaagcaaagatttaaagactgaaaattatctttgagaaaatacttatcaaagaatataactaatttggtaagaattctgaaaaatatatgaaatgcaagcacaaccaataactataatttctatttggctaaaatgggtagaaaaaggaagacaaaaatcatatatggataatagcccagaacttaaattcttggaaatatctacttaaatagcactaggggtgggactaaaaaagatgcatgtttgaaaaaagtttatcttgttagaaattcccagatctgtcaatgaattccttgatgtattctatatatttttgattttcatatagaaattgaacaaaattggtataaaccaatattatgttgttaaatttataaaaacaactgggaaaaataaacagcattccctgtgatcagttatggttaaccatagtaaggataaaaaatagataacagagttttaaataactatgtatttaaatatctattaaatgacaggtagaaacttatgttttcaaaaacaaaatgtacagttacgcttatcctgaagtaactaaattgaacatataaaacaagatggcagaaataagcatcggtaaaattaacgttcaacaaacataaatggtttaaactcatgaatttaaaaaaatttccagacaatctcatgtttgtaacaaaacctaagatgaagaatgcatccaactcaagagacaaatttaaacccaaaagatatagaaagactaaaattatcaagaatataaaaaatgcaagcataaataagacctaaaatgctgatatggaaatcctaatagctcaaaaactagaacataggaacataatattataagaagaagaaagatgtctatgcctcttgaccaaaattcccccatgaacccaacttccagtccctgacaaccatgagtctactctctgtttctctgagtttgacttctttagattccacatataattgagatcatgcagtgtttacctttctgtgcctggcttatttcacttaacataatgtcctccaggtacatccatcttgtcacaaattacatgaattccttcttatttccttcttttttaaggctgaagaatagttcattgtgtgtgcttatatattcacaatatacatctcaagtataacacagatatgatgaaaatattaggtcaaactttacataaaacagagaaaaccccttgtttaaagcataagaataaatacatatgaaaacctgtaacaatctgacgatgttgtaagatagaaagaaagcttccataagactcgaatgatcaatatgacaggaattcaccctatgaatctaatgtggtaaaatcagaagttagtgcaaataattagattttaaaaatctatatgttgtgatatattcatccctacagcacccagaaaggaatgcagccctgccaatctcttgatttcagccatgggagaccctaagaagaggaccaagctaggctccactgcaccaggatttctgacctacagatccctgatgtaataaatggctattcgtttatgctgctaaatttctcataatttgttatgacagtttagcaaaatgtatatagcagacagacaaatgcagaaagggaacataatagagtgataacagacatgtgcagacatacaaacatgtttttcttcatatatacaagaagtcaatatgtaatgtagtccacaaatcaaggaggaaataaatgatggttttaagtacaacaaagaaataatctgtccaaggtggactgaatggcaagtctaccacctattaatgaatgaataatttgtgtttttatatgaactctcccagaaagcataaacaaatgttctcttactctttctacacagctactattagtcgatgctaaaaccagggaagctcaacaaagaaaaattatagtctatcttgttttgtacagagatagaaaaaaatgattaatatctaacaacaaatacaaaaacagtattaaagaagatactgaatatcaagctaagtttaacatttgaaagttaagttatttaatttgctacatgaaaaaattaaatgcaaagcaaggataatcttacaagataaagaaaaatgccttgaaccaatttatgattgtatgttatcaaattaaggaaagaaataaacatttctttatctgaaaatggtagtttatttatatcttacttcaaacattatacataatgatacaacattggaagccttttgtctaaagagagaacaaatcaaagacagctaatttcatttctattcaattttggattcagtgcagtgaatgcagagaggacagggaactctgatactgttcttgggtgaataaaactgtccaaccacttaaacagtttttaacctgagagtgtatatccaaatatgcacataaaatatggtccagtaaatacatttctagttggagaaacttctgcattttttttcaacaagagacacgcacagaatcctaatagctgaactctttacataaggccaattcaaatttccagcttctgaaagagttaaatatcttgtggtataaccatcgggtgaggttccatatatcagtgaacacaaataaactacagctccaagcatcttcatggttaaaatcaaaaacatactattcaatgaaaagggaaatgccaggtcaagaagaacataggatgatcctatttataaaagatcaaaagcagagcgaacaatatattctttgggttatgctggtcatgacaattttgcagaaataaaacttaataaaagaaggaaataatgaatcagattcacaaaagtggttatccttaggacaggtccaaagaaatacaatttataaaaggaactgaggggaatcccaaaatcttcgtgttctaatcttaatttgtgcacagaaggatgttcatttaattcttcacatccatgttatgaaacattatctgataagaaaaaacaaaaataaatgattaaaattgtctatggaagttggaagcagaactgcacaaaacagcttgaggtataaaaaaatgatacatccttgcagtaattttaggtaaaatccagcagtttaacaacgggagtgattactaaccttaaaatttctaatcctacgaaacccaggaatttaagtttgtggtcaaataccagataaacattaaaataattgtttatctggaatgaagaaaattatacgtgttctaatttttcccagtcttgtgctaagagatctttcattaactggaacaaattaatctaaataattaagtctcaatatttataaaggcattttattaaaatggtttttaaaactaatgttctaccattctcagttgctgtgcctggagaaattattactgattataaattttactggtggtttccagacaggaatgaacacgtgggagttgttttgcaagaaagttcccagctacgtcccctgagagttctgatgtattggctatgttactggaattggtacatagtaattactcaaattgcacgcacagctaagagacgtgataaagcttctaaaggagttccctcgtgtatacaaaactattttaacagcagcacacattattttaacacagagaagcaaaactctttttcaaaagagaactgcctttcagagaattatttgttaaatcacgagtggcagagggtgaaatccaaaaacaagaagtgatggtgaatctgctctagccgatcagtggagctgagagttgtagcatccagaagaatatttcatgttaggatagccaaaaggtagtcagcaaaagggcgagatgtttaatttaaaaggtttatttttccctcttatcccataggataaaatgcccccaagtttctccccaaatcctcagttaaatctaataaacacctctctctctctcttacacatagttgaatgaattttttttttaagcagggtctcactctgttgcccaggctggagtgtagtggcatgatcacagctcactgcagcctcaaactcctgggatcaggtatcctccagcctcagcctcccaagcagccaggactacaggcaggtggtaccacacccagctaatttttttctattttttgtagagacaggatttaaccatttggccaggctggtcttgaacacctgggctcaagcgatcctcccacttcgacctcccaaagtgcctaaccttgagtggatttctgaattgagaagtgacccagtctttcatgttgatatctgaggtggaaaacacatcatctataaaggacaataggtaagacgggctccaaaaataaccatattaacctgagtcatcacccatcctctgaaagtaatcggcggacatgtttggacagggtttggacttccagagcgactaaagttcacatttgagtctagattatttctttatttaccttatttctttattacattcattatgaggatgccaattccatagtcagggattccagaagcagggatctgggatgcttttgcttacggctgcctccaggaacccaaaatggtccctggtgcactgctggtacaagtaactattggttggatgaacacattttcagggatagggaaacccacattatctcaacataatacaattttgtggctggaaatatcacaattccaaccacatgtatttcaccctgaagtctgtacaaacagagattatggatgaaagtttcaacatcttgttctctaatggttgcatccttttttcccaaaaatacgttggagattttgtccaagtctgtggtgtccatagtggctgcagggctgcaaacaccacatctaccctacgggactaagagactcaaatccccaactttagaatagggataggttttgtattcagatttgtaattgggtagggtcagggtttgggttcaagttcaggtttgggtaacgattcagaacaaaaaagattttgagtgtgtgtatacattttagtccaggctgggatctcacagtcaggagtcaaggagaaaaataaagatcaaaggtcaagggttaggatagctttcaggtatggaggaaggttcatgttaggatttgggttcaagttcaggttgtggtatggttagatcactaattgaatgtcagggtaggagcaaagttcaatgttatgatcaagggattatattcattattagggacagtgatcaaaagtcaagattaggatcaaaggccatgggtcggagaatttgggggatgccttcagtgttcagatcaggggtcaagagtcaagggctactggcaaaagttaagggtaagttcaaaggtttacattaaagttagattaggtgttcggttggctttgcttttgagtttagaattgagttctttttcaaagttgggtaggattaggtttcatatccagtcactagttagggtttgggttcaaatttgggttcaatttctcattctctgttcagggttatgggttaactcaacggtcaagaagcaatggtcaaaggccatgggttagtttaaagcgttcaattctgtttagggtcagtattaggtttagagttagaacactacatgggacccttatcactttcacctttatgatagaaaatcataatcagaaaaacacaaggagaagggaaaacttaataatctatgcatatttttaggagacataacagttgaaatatatcagtaattaataattattataataagcttcaatgtggcacagggatatttttagcacaaaagatattaaccctagacaatcccaatctgagctacagagattatgtgtgtttgtatttgtgtgtgtgcgtgtgtgtgtgtgtgtgtgtgtgtgtgtacttcataccactgatgtcgaagcttggttttgcattatccagctcactcatgtggagacactattggatgaggatggatgcatgtcacagatttagccacctctacgaatgggaaacatatagattgaagatagttcccagcagacattccatctgcatggagaagggaacagaaagaggagtacctcagccatagagctctgggggtttgcaggatgggaacagtctgataggaaatttgtaaaacactgcatgtggagggagggagaatgcaaacatatttaatataataaatgtctaaatgcttaaattttggaagtggaaaaatagagagatggtgaaaaatcaaatcactcagatggggcaaacacacacacacagaagcagatgcacacacacacatacacatctctttggctccaagtggtctggtttagggttaatgctaatgtgcactcttagctacaaagaggacatgacatttgaattccatcaaataaattggctgaattactatattataaagtgtccattccatgattccttttctgctcaaaaaaaatgttttactaacccttcccattctaaactgattttatggttcatatctttccatatttttgtcttataaaaatatgtgtaagatattaagctttcccttttccaagcatctttcaaattatgattttcagtcataacaaagaaaagagataagggtcccatgtagtattctcagttcccagttatgttccagaattaaaataacacaagaaaaaaataaaaatgtcaggaagaaacacctaaaataatgtggtttacttagcaacactaagtcttcaggatgtggtgtatccgcaaattgccctatttttaactacctggaggttctttctgcgtagatgttaattttttaaactattttctggacctaaatgtcttgccaaggtaaaacagcatttaaatactgatgagagcccagactcacctgagaatgggcaagaacgtgtggaaaaatacaaaatgtcatctcatcacttttagtgcctcagctcagccatctgcaaggctactgagatcacactgttgcatattaaatatgctgggatacattatttctcatgcatttcttatccagtactagaaaccacatttcatcacggaaaaaaaaaaagaaaacaaaaactaatttctgatactggcttattgaaataaagccattattttccaggactaaatcagtgcctataactttattttaaatgtatactatcccttaaaccactggcagatttaaaagacacttcatatcttataactacatttttcttaaaatttgtgttttagtctattcattaaactgcaatttaagagagaattttggaaagctaaatagatgaggcaaactgccttagagtgtgtcttcaatagagactgtgttataagaaacgaattttgctgccttgagtaaaatcacctaatagctactgtgctgctgatgaaccccagccttgtgaagatctgatgctgcaaaaataccccattaatgctcaatacactaaaaggaatatgtgatacagtgaacactgtttggttctattctctagaaaaaaaaaaaacttttttttttttagctaagcaaaatgagatccacattcataaattactttaaaatgcctttcttctatcacttattataacctatcatggtagcagagaagctgttaaaacatgaagagctaaaataataaatcaccaaagccaggttatggcttgaaaagtctgcctgacatagcgtaagtcaatgaaaatctcacagtcagtaaaagaataaaatgttagggctgggtgtggtggctcacgccagaaatctcagcactttgggaggctgaagcagaagaatcacttgagcccaggaattcaagaccaaccaaagcaacatggagaccttgtctccacaaaaaaaaaagttttttcaaaattaaattagctgggtgtgatggtgtgtgcctctagtcccagctacttgggaagctgaggctggaggatcacttgggttcaggaggtcgaggctgcagtgagctatgagggcaccactgcactccagcgtgggtgacagagtgagacactccctcctacaaaaaaaaaaaaaaaagataaaacgttgttctggatcgtatgctagggggtgtgtgtgtgtgtgtgtgtgtgtgtgtgtgtgtgtgtgtgtgtgtgtgtgttgaaagacagactgcttcatgttctaaggaatatttcctaagaaatagcaattaaaagtcctagagtggcctaagcaagaatttaaacctgcaaattaattcaaggaaaaacaaacaccagaaaatttccatggatcagattgcttctgacaactgaactcttcctacggagctatctcaggttgtaaaatctctttgaataaagtaagttgggatacaaataggataaaatgaggtgctgactctgaatttcaggaaaggagcactgtaaatattaacagttcagacatctggggcagagaactagaaaaagtcattgcacctttgtagctaagaacacagattccaaaggaggtaataaatctcccaagaacttcccttgttctttgatgtgatcgcaaactgattaaacattcaaatgttgccaaatggctgatttatgaaaatgaatgcacctttcactgactgctgaaaactgatgaaggaaaaaagttaacctgtgattacccaaaggaatggagaaagccagactggaattcaagagcacccgctcactgtctctgtaaggtaaaatgaaaactgtatcttaattagaaatattaaaataacaactgccatacaagtagagtgggttgatttcaaggagcaggatgttaagaaaaaggaagctcttaatgcacaaggtgaaggggtaaaatggtttctacatgttgagtcttttaaattaaaaaggacaaataggccaggctgggtggctcacacctgttaatttcagcactttgggaggcttaggtgggagaactgcttgagcctaaaagtttaagaccagcctgggcagcataacaacatcctgcgtcaacaaaaaatttaaaaattagtcatgcgaggtgacatgcacctgtagtcccagctactcgggaggctgaggtgggaggatcacgtgagcctgggaggtagaggctgcagtgggctatgattgcaccactgcattcaagactgggcgacagagtaagaccctgtctcaaaaaagaataaataaataaaaataaaaataaaaatagacaaattatttgcagtgggggcgagccacatcagggaggagtggttcactaattctccataactatgtgcactaccatctgaggattattacccagacttcgaaagggcatgacatgctgggcatggtgattcatgcctggaatcccagcactttgggaggctgaggcaggtggatcacctgaggttagaccagcctggccaacatggcgaaacctcgtctctactaaaaatagaaaaattaggtggtgtggtggcatggtcctgtagtctcagctactcgggaagctgaggcagaggttgcattgggccgagatcatgccactgcactcctgcctgggagacagagaaagactctgtctcaaaatgaaagagaaggaaaggaaaggggagaagaggggaggggagagaaggggagggaaggggaaaggaaaagcatgagaataatggcgttatcttccttgattgggcttttcctggaggagcccactggttgagtaaagataggaagccagtgttctgggtactcaaagtcagttgtaaggggcctgtccaccaaccttaagattagtttatagacaggaatgtggtaagcagaattataaagtcatccacccaagattctcgttcccctggttattaaatcaaacatgaatctaggtactgttgtgaattgtctttgcagatataattaaggttactaggcagctgatgtcaagataagctgattatcctagaatatccaagtgggtccatgatactgagaagcaggaaaatggtaatggaacaatcagtccagacaagccatgcaacttgggaaaggagacaagaggtagaaaaggaagtcggagagattcagtgcattagaagctgccactgctggctttgaagggggaggaaggaggccaggagtcaaggaatgctacggttctcaagaagccaaaatttgccctcagccaatagcctgcaaggaagcaggaacctcaaccccatggaactggatgtagccatcaacccaaatgttcctggaagtggatgcatccctggagtctggaggaagaaacacagcctttctgccaacacacagaaatcacccttgggtgatgatgaagagaaaccatccgagctactcacacttcagagcttcagaatggtgagataacaaatgcgtgtgttttaagccactacaggttggataatttgttacaggaacaataagaaacgcatacaaggacatgcaggcagtgtgaatcccctggataaacttgaggttgcaaaggatgggatttggagaaatgagggtttgtagaaaatgctcaaaaatatgcttacatgaagtctgcaatgctcagtacccacagggtggtaaacttgccttctaagttaaaggaataatttgaacacagagtgaccatttcttcctatgtcactgtgccctcctactagaatatccacattaactgaggatgaataccagccatatggcagcttgccatgatcatttaaggatagagctgccttgttactctatgcctaactgggaatccccagacatctttaagaactgagataggccagggaggtttgggaggaaactgtaactgtgggtgccatcttcaaccataaagtttataaatgcatgattctgtatctctgtacatgatggagataacccagaagttcaataaagagacccatctattttggggacaccctttttgcctcaccaaccctggatctggaatgaacaagggtagctcagattacctggcttggacatgaaatgtctgttgtgttataatgcaaaaagttgctgccagtctaaccaggagtgggaggcttccctaacttcttgcagaactcacagacagtagtattctaaaattcttgaaacagttacaccccctctgctgtgaacagcaagctgctttattctctaagaaacttgcatatcttcctaaccacccccaacactaagcagtgccctatcactgacattcagagtcagttcacttcaaaacacaaatgaatagggcataagagtccacatcaattagaagatacccaaattaaggccaggcatggtggcccatgtctgtaatctcagcactttgggaagtcaaggagggaggaatgttcaagcccaggagttcgagaccagcatgggcaacagatcaagactgtctcttaaaaaaataaaaataaaaagtagcctgacatggtggcatacccctgtattccagcactttgggaggccaagagaggaggactgcttgagcctaggaggccaaggctgcagtgtgctatgatggtgtcactgtgcttcaacctgggcaaaagaaccagaagactctgtctcaaaaaaaaaaaaaaaaaaaaaaagaagaagaaattgaaattaatgaactactttaaccttggaaacctctctggtctgaaagaagaaatcagccaaaagaaaaatactatttgagttctattttgtcattacttttgacaagataatagcaaatagcatggaaagaaccatctgtttggagctagaagacagaatttagatccctaattttatcaaataatggctaagaaatcctgacaagttatgaaaccatgctttgtcgtgtaaactatgaagttaataatagtactttcatcacagaactgttgtggaggataaaatgaaagaaaaaggtagaacacatacccagtgctgtaaagcctttgaaagtagtgtctaataaaacaaaataataagtaacactaataacaattaagaaaagtatacctacatttatcttgttgtagtgtaaccactggggatctcttttgaccatccaatatgcaagagtcacaataagtaatgataaataccaagaagagagaaaaatgggagctcataaaaagtgtggaggttctgcaagtagacaagtatagcagtaaaggctttataggaagaaaagatggatgggacaggtcagtgagtaccccatacgagaaaccatgctcaggaagcactgatagtgaacttactaaaaacaacactaaaacagatgcatggtgtgattcaaactcccagaataaaataaaatggcatatgcttctgaaaagaaaagtgacatatgattcattttgtgaaaggtcccggcataagaaagtaggctgactgaatgccttgttggtcagcctggcgggatcacatttggaagcgaacttggcgcagtgaaaaggtatttcacattaaaatccaacagcatacacataaatacatgatttcacagccatggcgcttgtctggaatcaggaaacaaggattcccaggaaagccaggaggtgctctgttgtttttaacatagaagattctaaggataatggcctccagctcagaaaaccaaatactgcgtgtcctctcttataaacggaagctaaagtatgagaacacatgcacacatagaggggaacaacacacactggggcctacttgagggtgaagggtgggggtagggagaggatcaaaaaaataactaatgcgtacttggctcaatacctggatgatgaaataatctgtacaaaaccccatgattctaggaagccacttgcatgatattcgcctctttgctccaagctgaggtttcacaagcacatgggcagaatattcctcatgacttccatagaaccaagggtttatttcttccaatgatcatttaaaacaatctatcacagccatatggaaaaagaggcttcaagctatactttgtgctcatcagtattactctatacctgggttgctcaatctcatcgatattgacacatgtagatgaaagactctttgtcatggggggctgttctgtgccttgtgggtcccttaaaagcatccctggcctctgtcctctagatgcaagtgatacccacccccatgatctagctgtggcaaccaaaattttttccagacgtcgacaaatgtctcctgaagtaaaaagctcgtgtctttgcaaaaacgtccatacttgaggacggaaaacaattaagacacctatgtatctattacacttcttttaactgatttttccaaaatttacttatcatttattgtccatattggataccattacacaactcaaaaaatattttgtacagtctctgtacaaatcctaaaggaaaaataagagaatatggcaccattttatgtagagaatcaaattagtatgtggagctcctatagtttatttaaaaatcaagtagaacacataggaaacagagagggggctaagacacacacacagagctatcattaacaaatagtctaaatagtcataacttgaattttaggagtgtttctctgaggtgaaactcagaaagaccgcccataaatgtagtggatactggcattctttaaaacttttattttaggttcaggggtgcatgtgcaggtttgttatgcaggtaaactagtgtcatgggggtttgttgtacagattatttcatgacccaggtactaagccaagtactcaatagttatttttcctgatcctctccctctcctaccctccaccctccagcaggccccagtgtctgttgttccctactatgtgatcatgtgttctcatctttagctcccacttataagtgagaacatgcagtatttgattctctgttaccgacatagttggttaagcataatggcctccagctctattcatgttcctgcaaaagacatgatcttgctcttttttatggctgcatagttttccattctgtatatgtaccacattttctttatccagtctaccactgagggacatttaagttgactctgtgtctttgctattgtgaatagtgctacaatgaacatatgtgcgcatgtgtctttatgatggaacaacttataatcctttgagtatatacccagtaatggatgggattgctgggtctaatggtagttctgcttttagctttttacggaatggccacactgctttccacaatggctgaaccaatttacacttccaccaatagtgtataaggattcccttttctccacaaccttgccagcattgatacaggcattttgtttaggattaaagattcatagggatgaaggaacgtttgcacaagtgttttcaagtctgcagttcaaaatgcacgcaaggtcaggaaatttggggggaaagtggagtcaggtattttgtttagaattcgttaaaaattcacagggataaaggaatttgtccaaggcgttcaaagtctgaggcacaaaatgcatacaagttcatgaaattttgaggaaaaaaatatattctgaaattctccagagaatcaaaagtagcttcaagtgatttagagcctggggataagttgatattggtaacagaggatctgtgccttatacaaggaaataagatatattacgtggatgtaaagacatttctgatggagctgtcattttcccgacatggctggcatttctgtgagatgtatattatgcacacatgggtgtatgtgtatgtttgtgggtacaaaatttcaaatatcaaagtaatagatatttagaaaaaaaattctgaaagaaggcatagatgccctttttaaatgtatgtctcatccttaaaatgcaggcatttgcagaatagcatgagcacaaaaatggaaatatgtgtatttaagtaggaaatgatataaatatatacggaacctaaatatatgttaggcagatagagactgaaaagaatttaaagggtcattgccaactttccaaaaaacgttcaagagtaggtgggaatgtattgaaccaaagaatggaaagacatagtaacagaaaaaaaagaaaaactagttaaaatttcacttttaaaggaaagacatatacaaactgtgtgttttataatttgttctttcctgtgggaatatatgctgcaaaatttatactgtaaaaatagatttaatatgacccaaacaatagaaaagtcatgggatacaatagaaaataaaatggtgttcacaatttacatttaagtgtaaccaaaagaaattttaaaagaatatatttctgtaattatatccttgaccttttgctatccaatggaaattatactatagtaagattataaataacatacgccagtgaactttatgttaagtattatgcttattaggaactactcatgacaaatgtgttctttgagatgccatctttctattttaaaggacaaaatccagtttgcttgcagttgcacagtgctaaaagttacttctcgtcctgtaaggctgtgagtgagtcattcaaagagttctctttgtccattccatttccccagcctccaattttcttcccttgttcttcaagcctttagtcttgccctatggagggtccaacaccaacaccatgtactttaggtttctgttgaaacagaacctcacttccagtttcagtgcctgctctggttagctaatgttgtgtaacaaacatgcccataatgtggggcttcaaacaaccttttatgaggatctcccatgattctgtgagctgactgggcttagctgagaagttctctcttgagatctccttagtcagctaagggataggaagagacaggagtcctcaatcagctgggatgtccacaatgggtgactcacatggcggtactaatggttgtcaaccgggagtgaagctaaagctactgactggagcaccatgcatagcctctccatggggcttgaacactttgcaacatgagatgtggtttccaagagagaatgccctgagggtcagtactccaagtgccctaaatggaagcttaatagcttcttatgatccagccctggaagtcccagtgctttactcccagaacattctattcaagaagacagtcactgaggccagcacaagatgcaaagacaaagggttcaactcaatttgcaagagcatctgcatccatttctatctatcacaccctttatcttaaacctgattgatcaggtgtaatgattccaatagatatggaagagcacactacactaaaagtagtatcctacatagaggggaagttgcctcttgactcagaaaaacagactgctgtgatcagttggtgatgccttccagggataaagacgactgtcttatccactgaagacacttattctcaactgttcccttcacatacagggaatttgagaggctcagtacaaataaatgactgaccctcaaactgccccaaatcatacatcagacatcaaatcgcacatacagtgttgattcagaatcaagttatcatttgtgttcaaacattacataaggcctcaatttcaaccatgttactgttgaaatattatagattaatttctacagaagtaataagaatatagatgaaaactcgcattatttaaacattttaaaaatgatacatgacaaccacgtgagccctcagttacacttgcaggtgcaattgttcacacattaattcaattcaatcgatggagtgctttatatgctgtgttttatgtcctcaatgaggtttgatggattggtgcatgtggaaaaagggaggcatagtgtatgctgtcatgaaacttacaaccaacagcctacgacagatatacaccacccagtaaatgctgagtacaagtacagagtgcctggagtgactgcattagactagaaaacctggaatgtagcaaatgaagggaagatggcatgacaagagggaaaaacggcttagcaaatcagacgggtttgggacctgaaggccatgtgtaggaatgacctactataatacggtgatcagttgttctccctgaaaggcaataatcaatgcccggaaatcaattagaacacagttgcccaggagtaagtgagagacaatggttgatcatggcaggaagaatgcattttctagcactgtgttttccaaaatgctagccaataaccacatgtggctattgagcacataaaatgtggcttgttcaaaccgagatgtgttgtaagtgtaaaatgtactctgaatatcaaatatgtagtaaaaaatatgcaaactatattttgtctctattgtctgctgacttagtactttataaatattgggatacattaaatgtatttttaaaattggtatcaatggtttcttcgggcactcttgaatgcaactactagaaaacttaaaattacacatgtagtgcacattacctgtctatgggatgtggctgcactggaggaaatttgtggctcttaggtattttgatttgttatggttttctgtggtttcctcacataaataaccaaattcaacaggttaatatgtgtcatataatagtgggcagtttccagaaactttctgtacaaggagatgaaagtgtataaccataaggactctaaatgttacttaaacaccacgtcagtgggaaccccaagccctgatgtagcagtcatggaagacgttcagcagagaacagaggcacaagttctagtgttcaatcactgtgaccttgaaactccttgcctcactgtgaccttgaaactccttaccacagcatgaactatggaagcggctggaatatattcccagctgccttcactcttgcaaaacccttctgtcattctcaggaagtaggacggagaagaaacatccccaccacaacatgattataagaagggtcatatggttgtggttcctttattgcttttctcttgaactgctgtggctacgaatcagaataaacttgttctgagaacaataatcatcttcaataattaacattcacctacatccaaaatcatgtctgtttctttcttgacaatgaaacttacaatgattcccatggtttttaatgaatttattcttttacagaagacattatcttacttcacaggagtactacctgcctcaaattctcaggcacaagaaatgtcatatttatttatggctccataaaataagaactttcttccagtccaggaacacattgggatctagtcttctgtcttttctttttctactgcagaaatccatagcggccctttgagccatttttctgacatttgagcaatttgacaattggtcagatgaactaaaaagaataaaaatataaggcaatctgtctgtcataactgtgtgtagaagagcatcgaacctggaggaagtaagccttctctttcctgctctctctgctgggaggacggggggttggggagcagtatatgattcagggtgtttgtggacatctccattccttcccaacatgccctatcttacctcttttggctgctaaaacaaaagactgcagaccccacggcttgtaaaaaaaattgctcacagttctggagaccggaagtccaagatcaaggcatggcagattcagtggctggtgaggacccactttctgggtcatagacagcgccttcttgctgtgtcctcacatgataaaagggacgagggtgccctctggggtcccttttataatggtaggaattccactcatgaggctccactctccaaataccttccaaagccccacttccaaatacctacacagttgaggagtaggtttcaactatgatttctagggggacaactaccgcaaatgctgcaggataaggatctggaaatattgccagagcaagtagtatgaagccttggagatatcctctgcattcagcaatatttcatttccctccagagtgggaaaaaagttggtcttaaatgctttttcaaagatgaaactcttttccaaaaatagaggcagtggagattcgagggaaaatgcagaatggccattttttagaaacattaggaatagcaactccacttttgtggggcctaggatgcaatggtataattggcaagaggagtctggtgaagtggtgaggctatatactgattggagtgaatttaagaaaggataggtggagaggagttgagatgtgatcggtgaggactcttggaagacgaggagatggttgccagagaaacaaaaacatgcagccacatcaggcagagaaagtgaaggtcaggcacgtatttccaaacgggataaacaaaagaatgtggatgtgatgttaggtgcgcccagtggatataaactacaaaagatgtagatgttgggaacaacgttcttgagtaggtgtgagaaggatggggtttcttacgtaagaccctctatggctgcttctcatttcctgtatctattgcctatttttatatgaggctgtggctgtgaataggtctcggtgagtgggtgtgcatttataacatacacaccagatgacgaattagactttagtgttagttattcgaattccaatttttctaaaaataataagtggtactaatgtatatcaaagttctctgctaaatttgttcaccaatataggttaaatttattaaattgatctattttaaggaattggctcatgcaatgtgggagctggcaagtctggaatctgtaagacaggctggctggctggctggcaactcaggagggaggaaatgcagactagaggccgaatgccttcttctgctttgggggccctcaggttttgcatgccccgcagtaaaattgtacatgtcccgcaccttatattttaatttgcaatgctctgatattaaactgaaaatctgatgagcatcaatgtaactttctctgcttatacattaacagagaaacagacagcaacctcagtgtattcatataggtaacacaaggtccctggtcaggctggtgatatttagagagatctttgcagtatctcgttcactatccaaaatctttgaaagcccagatattgggaaactccatcaaaaattcctatcagccgggcacaggttcacacctgtaatcgttgcactgtgggaggacaaggcagggggatcatttgagctcgggagtttgagaccagcctgggcaacacagtgagacctaatctacacaaaattaaaaaaataataattagccagctgtggtagcatgtgcctgtggcctcagctactcaggaggctgaggtgggaggattgcttgagcccaggagattgaggcggcagtgagctatcatcacaaaactgcactccagcctgggtaacaaagcaagaccctgcctcgaaaaaaaaatctactatttgatagcacaccagagtgactatagtcaaaaataatctgttgtatattttaaaataactaaagagtggatttggaatgttcttaacacagagaagggataaatacttgaggtgatgaatgccccaattaccctaacttgattattacacattgtatgcctgtaggaaaacactgcatgtgccccatacatatatacatctattatgtatccataatagttaaaattaaagtgaaagacatcattgtgtgtatttgaagagaaacacttgagaattcaaaatcaagagccttctcttttaatttaaaggtaccatattctgatgcattcgtgttcgcctgtaatatgctcttcttttttcctagttttgaactgcaatatgcatcgtgttcatacaagcagcaaaaagatgttggaatatttggcctgggtttcaccacagcattattggcaatgataggagatgccccacggaagcccaaggcaggctgcagccttgaaggcctctttttccttatggattgtgaatttgaatgaaagtgcagaagctgcctctgccaacagactagccccatggagggtctcctggggctaaaggccatatgtgctcaacctaataaagttataatttatgcccgccctgtgaaacccagagaagagacagcaccagcattctgccagggattccaggagatgtggacagctgttgtcaaattctgagctctattttcccctcaattatctgagaaatttaggagaaaaacaatcaagttttggaaggttgcaaggcttctggggactaggcaaggctggagagtcagcatatacatagtacttatttatttatttagagacagggtcttgttctgtcacccaggctggagtgcagtggtgcaatcacagctcatttcagcctccaactgcaggactcaatgatcctccagcctcagcctctcaagtagctgggactacaggcaggcaccagcatgcttggctaactttttttttttttttttttttttttaagagatgaggtctcactatgttgcccaggctggtctcaaagtcctgggctcaagtaatcctcctgcctcgacctcccaaaagtgctgggattacagggatgagccaccacgccagcctcatacattgacactttgtagctaaatggttcactagcatcatcccttggtccctggcaatctctgtctctgtctctgtctctgtctctctctgtctctgtctctctctctctctctctctctctctctctgtctctcttgctcaatatttctcagatggtcaactgggagttaaacaaattgcaaatatctggatcttgcccagaatctagcacttccagggtccttgggggtaatttatactctcccactccccactcttttgaaatatctggcttttaaacttttagtttgacattcacatgtttctatgacagtaaggctccagcattaaaggatgttaccataactagtatctctgaatttctgtccactgttgatcaccatagttattagctagtctctgggtggggctttattttaaccatgaaaattcaggaccagaatgtagcatgtagatgctcttgaaattgatgaaagtgtttattaaggtaaatcagatacttaaaaatataaaatattccatttttttaaaacttgcaatgatatatctgacttcacaatatcgaaagtagtccctactattatcattttagcatttctaaaatccttaccatctggtaacacctcagggtttaagccaaaaatatccggatggtggaacagcaatacacttagtatcatgagagagccctttatttcttcatcagtaagtgatatagaaatagttcactggctttagctgcagtagctgacgtgtcaggtaagaaaataaacatatccatcaccaatgagaattccaaaccctgctcttttacagacagatattgaaagctttcgttttatttaaaacgtatctgaccataaaaagaaatatattctttagaaagtaaagtttctttttttcctgaaccagtagaaaagaattataatttccactctcacagggaagaaaaaaaattcagggtcaggtttaatatctcgaaagaaacaaggacctcagtaatgagtccatggaaatgaaaaccaattcccaatgctggaatcaaaggaggttatggaatagtaatgtaacataatacaaagtggcaaaataatgacagaaaaataatcagaacattaacaaaatttaagaagtatttttttttcagaaatgcattgtatgacattaccccaggaaaatgataggaaactctcattctccataaaaaccagtattaaaaattttaaagtacttcaatatttgttagattaaaggaaaaaaggagaaacaaccacactaaaaaaaaaaaaaagacaaaatcctgtataagaccacaccaacacaccacacagatcaacgagattcaagaaatgctgcttgtgtagtatatttgtttggaaagcaatgcaagatattcttaaacagtcaacaccataaaaagcattcaggaaaaatgcaagtaactaattacaaccatgtgtcttctaaatattccacctgagctgtagtgtcaatatgcaccctttcctgatatcaggaatatgaatacaaagtcctgcaaaactggaaatcaaactgtagaaaacaatatgactaatgaaattaaatatagataatatatatttaatctgtaatatataatatgaaatatatatatttaatctatatgtgtgtatatacacacatatatataatatacacacatatatataaatatataattttgactctcaagaaaaaaatgcatgtatatttatatttatatctatatttgcctgggagtcaaaatttttaagatcatagcactaaagttaaagaggcataaactggtttgtatgacaccaattatattctaagacatacacacattgataacttcataaaataaggaatagtttaattgtgaagttttggaagaaaatttatataagttatgcactgggtagaaatggaaaggctgagaaaaatcagtattgctggttgaaactgtggctgcctaagtttgcaatccaaaaaccacccaaactatctctctcattgtgtttccattgcctgaaatgtgtagaattatgggaactgagcagatcactttggggacaatcatctatgccccagttcaaaatctcttgtcagggcgcacggcatctctgagcaccagcacgtgcatcaccaacccaaagccagggaggcaggaggagggaaaacatttgaaaactgacagaaagctaagaaaccctccactcactgggcatttgtttcaggttactacataatgtaaacatgacaaaatgtatcctgatctgttgtcctcttgtttctttgatatgtgagagacaatagaatagaaagccacattgaaagaaaagaactgccagttttacaatctgattattggcattttttattggtgttgtgtgttaagaagttgggaatattctgtgtggtgtctgtgtgtgtgtgtgtgtgtgtttgtgtgtgtttaaagggaaagagaagcaaactgagagagagagacagtcagagacagagagagacaaagaagaaaagaaatgcaacaatcgtagtggacacccaaacatatatctccagaaactctttctcatacatccactaacatccttgggaatccctggtttttaacaaatgatagttactgatagatatttaataccctccagaataacctgcattacgtgcaaatagatatactattcatatgtaccttttttaccctttatttgcaatggatcctcctttccccgactgctttatttgggacagtccactcctcctgtatcaactttagcatctgagttccagaaaaaacggggagaggagaccccagattcgggatttaagaggttttcacataagcacgaatcagtacctttcacagcaaatatatatgacataaggatatgcctttgcatcacagtggatatttctgcttgctaacaaagacagttgtcattatatgaaatatttattcaaatatccttaactccacatctttcagtatctccatgtgtacgtcagagcagccattggtcaccctctgcctgatctctagatactgttagttgaccagggaaagttactggtgaagtaaaattgcaggacttgcaaagattgcaacatttcatgcatttaccaagacagctggtatgtattgcctggtgaatctgagaaatcaacgtgtaaggaactcaccaattatgcaatcccctaaaaaccacaccaagagcaacagcgattaagcagccctgaatcactctttgttgtccacatatttttatgtagtttcatgcctaacataaatttacccagtataaaataaactttgttccatcattagagtttaatttttgcaaaagcattaaaattttttccctattgtgtaggaaagtgaagcatttctgctttattgtattttttctaaagacttccttttaaattggccttttctttgtctttatcaccctgcagtattgagaaaatttttatgcatttaatataaaaagttgtcatcttctcccagcgaacaaacttctatttaaccaatcttgtgtaggacatctgatggacatgtggaatggagttaaataatagctggtgagaaattcccagatattcagggtttgttgatgggggaaggcagggagcagtgagaacaaaagttgaacatttccacaaaaaaagcatagatgaatttgacaagggtaataattctgaaactcatagagatgtctggattaaaaaaagaatatttcatcaaatttatcagagtaagtttaaataggtactgtcatgcatctttttgttaaaaaaaaatctgtcattaagtggagactgaggaagaaaatccagaatttttttctgtaaatttaagaatagcaagtccatctccttaatactatatactcacaatttcctgcttgacactcattaaggggtttagaaagtgtttctgcctgatgtctgaggaggtttgctaagcctctgagctatgtggcttttgcagaccacctgaaatgcttgacatattactgaaataaggtgaaaaatggttttccaaagtaaaaagctcctgaagttggtaatggaatatgagtacttgtaccatgtgggctcccattcaaaactgccatcttatcccttccctaaaatatctctgcacatcattctcttcttcttgctgagtcatggtttatttaagatttgcctacagcaaacacaagcagcatttccctatgtagaaaccaggttgcagaaaatgtagagatacaggctatcgcagttttaatataacctggctgagtttcattaggttcagcccgtggggctcccctaggtcaaactgtaaagtcaatgttgcaagctacctgagctaatttgttcatgcacaatttttaggttcattttagattacagttacctactgttaggtaaggtaacagtaatcgcagaaaaagaaggagaccagtgatagtttgtaattcctcccctcatcatgtgtgtctcaggcccaaatgtgttacacatataggcagtcattcatctgacttccacagcagacagaaaacagttcatatgtctccttccataaacttgtgagaggtacaacttctatcatgtagctctttgcctctcaagtctttaaggacaaaacaagtggtgttcttttatctttctcagtcagcatcaggtaatgagaaattttccttagtccatggctgagcgtaggactaaagagacttcaagttatgggcactggagcaggtcaaaggcataggcatttctggatttttataccttcatcatgccattgtgaacattttctctaaacgattttagccaatttgtatgttttgaatattttaatgttatgggccaatgagagttcatgctaacattcaccatgatgtaactagtaattcctttcatgaatgtagtgcatttctggcatgctaatgacaaaaggctgtgtggattgagatgtgaacagctgaagaactaagatgtggattttctgatgcaggtctagcaaaccactccaggaatgtggacataaggttaaaacaattttatcctcctcaaactgaagcgcaggtacataatagcatattatctattctattttcctacctcaatttccctgtcagccagatacataccgtgcatttgacatcacaggatggatggggtgggcaaacctgtcagttcttgctttaaaatttaattactgaaatattattcaaatactcaaaaccctcatgaaattgtttttgttgatttcttcgtggtgatgctgtttgttttggttatgatttagatttctacaccagggccctggcaactctgaatgagtaagatgcatttgcgtttcatcaatacgaaaagaattacccctggaaccctgagttaattggcactgtatgtctaacttattccactgacattataatgtgtctttgaatttgtgatacgattgcatcacaatcggtgtctgattatttatagaattatcataaagctgcaaaagtagaaagagggttttacactgcagtgttgtcgataagtgttccaaataacagtgaggtagtttaatcagttatagtatatcaattaagttcaatcaatattacacaactgcttgaaaattaacttcagtcaatttccatattaaaaacagtaaataaagcaagttgcagagtagtataattaatatgatgccaattttgcaaaaaaaaaaaaacactaaaaagaaatatgtgcaaatgaataaatgtgtgtgtgtgggtggtaaagttgtagaactgctgtttgtaattcaagaaagagctggagaaaatacacagaacacactgatggggaaatttcactatattatacatttccttatttttaaaactttaaagagtaaacatattttaaaagcaatatttcaaagaacttacttaaatactttcacaaaggaatttaggtataatgagctgcaggaaagcaaaaaaagtgccctattttgactgaaaataaataatttatcttttttatgctgttttctcttacacatcataagaaaatatataaattgtgtgtgacaagcttaattaactaccttttctaattagtactttaatgaatagccttctaaagatattgttccttaacccgaaagaaaactctaagtaaaatagcggcacatgagaggaagaagttttaggaaggcaggtggatagtcatgtattttttcatgatataaagtagttccttattcttcttaatcagtttgccatatgatccaataattagttcatttttagggcaaggttctagcaagttcgtgaatgttatacttcaccaccatattttccataacttacaatattttttacaaaattattttcttctaaaaatgcttaaaatattcacattaataataaatttcagacctcggggggagaatttatttattcatttacttatttatttactttattttatttttatttatttatttatttatttgagacggagtctccctctgtcgcccaggctggagtgcagtggcgcgatctcggctcactgcaagctccgccttcccgggttcacgccattctcctgcctcagcctcccgagggagaattttttatctttaaacaaagatacaataattctgtagaatgttcattgtggaaataagttaaaattgtgaataatgctttttgtaatgagagattggctttcagaatctaacagatattttggtagacttgtaataaaggcagtgaaaagattttgaagctctcagaagaaatctattgacactccattaacagtctgacttcttacagttcttatttaagtaaattacaataattccttcagaatttcaattttgttttcaacaggtatatagatttgccttcatcgacatgctaagttctcaaatttgaaattcgcatatacacagaaaaccttgcacaggttggatgggtatcaaaagctatattttaacaccatatccctttaagatctaaaaatgagaatgttaacttgttttatattaggttccatgacattttctggaatattcaattccataaaagtcagcacagccatttacataagacacaggagcttaaaaagaaaaagctaattctgatttactaaaatgtcaatgtcaatttgaaatcctattaaggttggaaaagcagttctttgccgtggatactaaaaaatgtgagtcatttcaaactttaaacatatttttacatttttgcgaacccctgaggtatcctgaagaggatttatcacctgaaactcatacaacattaaaaaatatatgattttgaactgctcaaaccgagttttcaaggatgttcttatttctactgcatgtaagaggacatctctctacgatatgtgataagccaaacaaagaaaaattgaacacattcagtctcatttcccttcatggcatcttatacctgctttttcctgttttgaatgaggtggttctgtctccatgttactgtaaatgtgaatcataaagctcattttgtgttgagttctaagagaaggcagttacacacagtcaaatgggaagagacagtacttatccatattagctagtaaaaagatataaactatttgacattaagtatgtatgtatgtttccataaaaagggctatggagtcaaatggattctaataacgcctaaacctgcagtctcaaaacatactctgttaaagaacatgcatactgcatgcatcattgggcagagcatcctataaggcaggtagagctaaggtcattttagtcactttaagactcaagacaacaagttctgagatatttggcagctttccaaggtcttatgaagtcagagaggagacttatagccaatgcataccaacacttttgcaaaaaagtcatggaagaattaactatcactatgtacgtttgttttctagatgaataataacaaagataaagtaaaatatgtacaccaaaaatgcacttgctatattttaatcaaaacagtagaagagtttattgatttctgtagttttcctatactatctccttttatgggctgaatgttggcattctcccaaaattcaaccttgaaatcctaaactcccttcccccaggagatggtattaggaggtggcatctttaagaggttgttagatcatgaggatggagtactcgtgaatgaggttagtgtccttcaagaaaagatctcaaagagctccctcaccctttttccatgtgaggacacagggagaagtcactgtctgtggaccaggaagtgggttgtcaacagagactgaatcttctgctgccttgatcttgggcttccagcctccagaactgtgagaaataaatgtctgttgtttattacccccccccacccccacccccagactatggtattttgttatagcagtctgagtggactaagacagaaattggtactgagagtgtggtgttaagataacaaatacctaaaaatgcagaagcagctctggaactgggtaataagtagaagccagaaaagttttgaagtgtatgctagacacagcctacgttgccatgaatagacctttgaaggtgattctagtgaggggagggctcagaaaaaaaaagagaagagctgtacagaaagcctcaatcatcttagggaaaatctatgcaattttgaacagaatgacactagaaatatggacaggaagctccatttttatgagctgtcagaggcaaatgagaaatatgccattgcacaatgaaagaaaggtgatctttgctacaaagtggcaaagaacttggctgaactgtgttcatgttttagtaatttgtggaaggcagatcgtgtgagtgataaaagtagatttagctgaagctatttctaagaaaagtgttgaaggaatggcttggttcctcctgactgcttaaagtaaaatttgagaagaaaaagatgtattagcagcccgaacagaccaaaacatctccttccctctaagtaacatcttcaaaacaacaaggtaggagaatttcatcttaaggctaacacaactaactgttcttaatactcaaatcctgggattactagaaaggttcagaggaaccacactaattccccaatgactggtccttggaaaagtttaaaagccacttgcatgtcgattatcaattctgctcactaaacaaacagaaaggagaccagaacattcaactttgcagagatgttctcttcactaatttttaactattgaagcctaagcctaatttgtaaagttctgctcaaatgcaagagtttccatgaaacattctcaaattatcgtttctctccttctataaaaaacccaagcatttgctctttcctgcttcggaatatatttacttttattactcttagtactttattgtacattcattataatatggtctatttcttgatgcccctgtatgggaaaacaatgcaaagtgtatgagagttaagagaaaggatgtaaaattcaaagacgacttcaggcagttcagtgtatttaagttaggtcttgaggaaggtgtaaagactggagccagtcaggggtgggttataaatgttcagggaagactatcaacaggatgaaacagtgcactcactcccgaataatttgctgggtatgcaaaaataaatgagaagaattctcctcctaagataaattctccatttagatggctagtagtacatttgactgaggaaagtgtctgacatagataattaaaatacaatgcaaggagacaaaaataatagtaaatatactatgtgaatacagtggtatttattctattcataagtattctaaaaaaagattacaactaaaataagaactagccgacacagaaagaatgacaggaaaaaaatgcaagtaaagttaaatttgaaaattaatgccctcaaagcataatgcaatcttgttattgctttttattttattttactcacttgttttctgaaacatggtctcactctgtcacccaggctgaactgcagtggcatgatcatagctcagcgtatctttgaactcctggactccagcaatcctcccaacttagcctctcgagcagctgtgactataggcacatgccaccatgactggctaattttttcactttttgtagagacagggtggggagggagggcttgctatgtggtccaagctagtcttgaactcctggcctcaaatgatcctcctgccttggcctccaaaagtactgggattacaggcatatgccaccacctggcccatgctttttatcttaaatgtgtatcgtttctagtcagatacaagagatagctcctatagctttactaatgctatgcaacttcaaaaagaagagaacctcttctagataaggttttcatcataatagttaaaatgtataaaatatgagctttccctccttatctatatgaaatcatctaatatacatagaacacggaacaggcataaagaaatgatacgcaactgtcttaggtggatcgtggggtagtgaatatacatgctaagtttaaagaaaagctgggcattcagagaacaccctattaaattgaatggcttatcaaaagcagaaagagcaccaaaacctgtcatacacacacaatgagcatctagagtagtttgacacacctggtgattaacagtcataatcaggcaagcacatgcaagcatcaaacgtttcatctgcacatccacctggtcttatttggagttactctaaaggccccacatgagacaagaagtcgggtgcaggtaaattacttggaaggtgggatagtcaataaatggaccatgcacaagtgtgtaaccaatgtggccaagttgggctccattcttcttgaaaaccttggaggcactctatagaatgtgcacatcttcgaggcactctatagaatgtgcacgcttcagttatgcctacacatggcatggtcctcagtagcttcagagaaagcacttctaagagagactgtcaagacacatttattccaagaggaatgctgatgaaatgatggtggaatgcagtgtttggaactgtccgctgtgcaggttctgaaaccagagaacccaggagataaggacagaccaccattcttcccagccacactccttatgtgataggcatattctcattggataagagataaaatagaagctggaactagctaagccactgacacaaggtgacacttttattaaatgagaaaacctcatttcaaagtaaatgttctacaacttcatgtaacactgacctcactgggcaacatatatataagtggttggatatgttcaacttgaatgagaggaaagtttctttatgtgttgcccaaaccccataaaaaatccaagaagcagatcttggtaactttatcactagactgcaactttaacatcattttcatttagtagaaaatgaatgtctcattgacgttccaccttcagggaaacatgtcacagtataaagagaaacaagtcacacatcggggtccttgcaaatggtattgatcattgatcaacttctccatagaaacagataagatatggctttgaaattttctttacagtcattaaaaaccatagcatgtgttcattggagctcctgaaaaggtagaacatgacatatactttatttatgcttcattgcagtgagagcaatattaaagataatatcctctcacaaaatagtacagacagtttggcaaagtacagtaacagactatgagtatgaatatgatgttgagtcatgtgtaaacttagcttaaatattaataaacacttagtaaattcatcactttgatttcttactcatatggcttaacttttcaagttgtactttgctgtttttttacaaagctcttctgttcctgtgtctcacaggacatgagaattcacagagtgtgatttgtattacatagtctgtaaatattatgctaagcgcatatgtagaatagtcaatgactactgtaaactgaacaatgaaaagtagtgttttacctcgtaccactttgcctgttattattagtaagtatacttaaaactgaaaaaatacagacacatgttatatgctttaatatcgtatttaaatatcctccccaaagatgcttttctgtgtttaatcttgagggagatacaagcattgcaactacacataaaatgtttactgtagtttcattgacttgagtagaagataggtcattttgtaaaatgtcaaggcttcactgcatttccagaatgcaaatgaaaatcatttgggaaattggctttaacacaaactggatgtcaggaaagattgttttgaaacttgattacttaaaacttggaagaggaaatacagctttgtaaccaaacctacaccagatagtagatgacaactctgtaagatcatttccatttctactatttctataaaattcagcatcaatgtacatttttcaccattaccctaaatacagtaggtggggtgggagcaaatgcaataaagatccttatcaggctggggataaatttggtctgttgtctgagaaaaagctagcaaagcctgtagttgacagaatgaggccattttatcatggggggaagagattagattctactgatgcaggcattggatgcaatgtaggtctcacatttactcctttcttgtgcctctatccatgacaaaatactaatgttcacaccaaaatttactgaggactcatttttaaatatttcaaaaatgatggtcagcgcaactccctttaaatttttattgcacagtttatttttatgttattttattggaatcaaccatctaggaactagaacatgctttggataggagccctaggtaggggcaatataggagaaaggtgtctcttttctctctgtcttggccctgtctgatttttcctgctggttctgtagcagcacatgagagacctcttataaaatcctgagaccacaaagctaaggaaggtggaaggaatttagttagaagctgagtcattccactacctttctgcttctgtgcatgaacctttgctgtcacattgtcttgcactggggagaaggaaactggtagctgggaaaatgcttctagtcaaaggttatttttttaatttgcatcagcagtgccatgccgggatgatgtgcacgggagagaagtatggacacagactggctccctttcctttaagcctcaagaatatgcacaaagaaaagcacatgaaggacacacaggaaaggttacttcctgtaatatttacaatgctggtcctgtgataccaagcccctgcatcctttctgctcaccctgcaggtagtgtgcagtccctcccccatcatggactataaaccttcttctctttatcatttgagctcctaggggtcctcaaatttagagtcttgaaaactgatttctaacctgggttggatgtcaaggaacatttcatcccatgcttacctgcagattgcagaaatccatttatagattttcctccacatcagactatgtgctgactccttgagagcagaagccacaagctaagcggctgatcaatacttctacttttttcaatgaagtaacaaatacttcatactgaaaggaaactggagaaatccgtaatgcaatatttttattacaactctcagctcccttttcgatggttcgttcttctctaaaaggaatgtgaatgagaattgacactcttaatgggtggtggggaagaaaatgagcagagtggaaaatggaaccttcttcccacttcctccattaaagggcatgctgtggatgtggctttgtgtattttcaatttgcctgtgtgttctggtacttttctcactttgttgctaccaattggatctagtatggctgtctttgattgtaagtacccctctctctctctctctctctgtgtgtgtgtgtgtgtgtgtgtgtgtgtgtgtgtgtgtgtgtgtgtgtgttggggtgctatctactaataatgtatcaatgtgtttgaaaagaaaatcaactctcatgaattaattaatgtgtgtgaggaatcatggtggtccctaaacagtttataaaatcttagtaccaatcatccacgaaagagcagttagttattttaaacaaatgtgcatttttaatgacatagtttttctggaccattcaccgtccagtgcttgagtcttgacttaacagaattgccccgatggagctgttgcagggaggactttcaccagttcaacactccagacttactcaaactcctgtggattgctgtgttcaatgtctcccccacctatttcttccataattagcttggtccttgtggtcaattcaacactgacatttagtgatttcacatgattacaatgattcagaaaaaaactattttcaattcctttccagataacaatgattaaagtctggaagaagcttagtcttctaccagtctcaacttccttacaccttacacaaaaattaattcaaaatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaatctactcatctgacaaagggctaacatccagaatctacaattaactccaacaaatttccaagaaaaaacaaaacaaccccatcaaaaagtgggcaaaggatatgaacagacacttctcaaaagaagacatttatgcagccaaaagacacatgaaaaaatgctcatcatcactggccaccagagaaatgcaaatcaaaaccacaatgagataccatgtcacaccagttagaatggcaatcattaaaaagtcaggaaacaacgggtgctggagaggatgtggagaaataggaatgcttttacactgttggcgggactgtaaactagttcaaccattgtggaagtcagtgtggcgatttctcagggatctagaactagaaataccatttgacccagccatcccactactgatcatatacccaaaggattataaatcatgctgctataaagacacatgcacacgtatgtttattgcgtcactattcgtaatagcaaagacttggaaccaacccaaatgtccaacaatgatagactggattaagaaaatgtggcacatatacaccatggaatactatgcagccataaaaatgatgagttcgtgtcctttgtagggacatggatgaagctggaaaccatcattctcagcaaactatcacaaggaaaaacaaccaaacaccgcatgttctcactcataggtgggaattgaacagtgagaacacatggacacaggaatgggaacatcacacaccggggcctgttgtggggtggggggaggggggagggatagcatttggagatatacctaatgttaattgacgagttactgggtgcagcacaccaaaatggcacatgtatacatatgtaactaacctgcacattgtgcacatgtaccctaaaacataaaagtataataaaaaataaataaataaatacaatagtaataatgatttaaaaaaaaggagataacctaatgtaaatgacgagttaatgggtgcagcacaccaacatggcacatgtatacatatgtaacaaacctgcacgttgtgcacatgtaccctagaacttaaagtataataataaaagaaaaagaaaaaaaaaggaatttattccctgcaggactctaagcattttccatgagaaccagtgacatgttcattcctagctttctgcaaggcctttgacttagaattcctcatttagcatctttctaggctgccattaccaatctgaatttttcctctgaagcaatttttaaaatcatatctcctctctgaaacattttttcttctctggatctaaactgttggaatggggatatactttcatccctacctcaagaaattcattcttcttactctccaactttaggtaacatgaataacatagttatatctaataatgtgggtgtctcttgcctacccatgtgcttttattgtcaactggtaagctcttagaaggtagggccataccttaactcagttaaattcaacctgatacagtgttgtaccaatcaattgatactatattcatcaactgatactatactgtataattcaatgtagttgccaataattagactaatgatgacagggaattggtacattaaaggcctggacttttaaaatctcagaatggcagggaatcacagacttaattcaatccaacttctcttataatatggaaatcatctctgcatgtcttgactactctcggtatagatactgtttaaactccttcagtaacagagaatccgctgttccctgaggaacctcacccaatagccatagagctcaattattaggaataatatgactagaaataataaatagatataactaataattattggaaatacattttctattttcagaaataattgtaagaacccatttgtcagaccagagtttctcaggaaaggaatgtcacccatgttcaggtgaataataagcatgttgaacaatgacatttcaccctacattaccctccctgggtaccagtcccaggagagttctctaactcagatcccatctgtgcctaactccatgcttggcagactggctactaaatttcaagcctgtgtttctggagcccaggaagatcatgatgaattctgtccactgagtctcagtgaaagccacaatgatgcatttgcaatacttttcccttcttattcacaccagctccaagaaaccttcagtcatcagtgtgaatcatcaccccttctctgagtttgaaacagctcctaatagaaggatcaagtcacaactgatcccaagacaattcaaggtaattttcacttcagagaaatgccttcaaatggtagatgttcattcaccacttttgtcttatcagtaacaatttcctcaacaatactttcctttttgcaaggagatgacacatttctttaatgaatttcttctctactgctcaaatcctcatttggacatgcactgcacaataacacacataatggacttggggaaaatgatactagacaaaactgggttttatatgcagccttcctgttaggcaaccacggtatgttctgttctggataagagggacaacagtattaaatgagtcataacgtgttttcctgaaagcaaagagcatcctagtgcatagaaaaagtgaaggatgacaatatttcaagacagaaactttaatttttaaaaaatgatttccctacctccagacatgggcttatccttaaagataatgaattgatttgtgctgcgagagcaacttttaagtaatggtaatctagtgtagtgcattttctcaataaagaatatctaacgaaaggggaaagtgtttaatatgcagaaataatgtaaacgtaacatacatacacacacatgtgcacacacaggcacacacacatatgtatatgtgtgtgtgcatgtatgtatgcatgcatgcatgtgtgtttgtgtgtgcatgtgtgtgggtgtgtgtgcattccccatcatctcatcctatttacttcattcactctaaagtattcaggtttaagacataccaatgcaaactaccaaactatgaataaataatttgcaatgtgtaccccatttattatactgatttaactaaggaaaactatgccccaaagcttctggttactccttgcctttccaaactatccctgttattttgcagtgactcatggaaacttgtattttgtggctaagttcttattgtaatccttctttcactaagaaacaatcaaaaacaaagttgtcactaaaagttctaaaaattgcctaccaaattccttacacatactcttttactaaacaaatgaatgaagcaaacttggcaaatgattataattaatacaaaatgaaaaagattcatacagaagttagtctattgcatctactgcatagtctatgaaaatgtgactacaagattcttgtcaattaccatgtctacacaaggtcaggcctgctggtttacaactataatcccaacactttgggaagacaaggtggggggcgggggcggggtgggggcggggatgtctcttgaagccaggagcttcaagagtgctgggattacaggcatgagacactgtgccttgcagatctaaatgtttttaagagtaactgttacaacccaaggtaacataatttttacttggttctatgtcaaatagaaatttatcagaaagccaactgttgcaacagctaacagatcaattatttttcagaatatataaaagtaattaagtttcaaatatatagattgcttttaataaaccaacaagagaaagttaaactgcattatgcaaaatgagcaacggatgtaattaacaggaaaaaaatacctaagtagatttttaaacagatgaacagcctaactcatacaaaagaaacaaactaaagattattattgttgttattagatagaccaggggtcagcaaactatgatccaggaagcaaacctggccaggacctccttttgtaaatacagatttattggaagagagccacaccactcatggacaaatcatctattgctgctctcacactgcaagggcagatttgagtagtcaggacagaaaccatgtggctcacatttactatctggtcctttacaggagtttcactgacctgagacagacaaaaatgacatgctttataacacactctgttggcaagaaagtggccaagatgcatttataggttatgcttggaagctaaattgtttagtcctctaaaactcaataacatctatatacatttaaaatagatatggaatcctacccccactcaaaggtgtgtgaagggctcatgcctgtaatcccagcactttgggaggccaaggcaggcagatcacaaggtcaggagatggagaccatcctggctaccacggcgaaaccccgtctctactaaaaatacaaaaaaattagccgggtgtggtggcgggcacctgtagtcccagctactcgggaggctgaggcaggggaatggcgtgaacccgggaggcggagcttgcagtgagccgagatcgtgccactgcactccagcctgggtgacatagctagactccctctcaaaaaagaaaaaaaaaggtgtgtgaaggaagtttcactgcactagggtttatggtagcaagtatttggaaacaatcttcgtgtccaaccatggcagtccaatcaatgaattatggtaggtccatatatgtgcctgtgacagaggcttcctgaagaatgaggtggatgtctatgtgtcaaaataggacaacctcaaagttatgttattaagtggaaaaagcaagatgtaaagaatgctctgttgcactggcatttccatggctgtttagtcacgtctctggaaggattctcaagccacaacaaagaaaggtggtcgctgaaacaactgaatgaaggggtggggaatggcatggtcaaatggtgtccctgtatgccttttgttatattggattttttaaaccacatgcacaattaactttcaaaacaaacaaaaacaaacgcttcactgaaatgaaacatcattcagtaccagatatttgcagcacatttgtagatgtaaacttgagaaatagcacattgaagaaaaacaagatggagtttcatccacagtcatggagttagaggactgaggagacactgcagttggggaggctcaagcgaaaggaagaggagaaaactctaaaccatgaatttaaagaggaaacacaaacaggagtgtccctttttccaaaagcatattgactgacataatgaaaaatttaacattcttctgcagaatagaatggatcaagcatttaaaagattaagtggagggcatgccaactcaaatttgccagaggagaaaaggaagagggcgtgaaacagatcacaaatgaatcaaaatcccttcaaataaaacacagacaataggagtcctccgttacccacgggggacacgtaccaagacctgtagtggttacctgaaaacacagatagtactgaaccttatatgtgctgtgcattttcttatacatagatgcctatgataaagcttaatttatcaattagtcacaggaaattaacaataatagctaataatacaatagaagaattataacactatgccagcatcactactcttgcactttggggccattgttaactgaaataagggttacttgagaacaaacactgcagtaccatgacagatgatctggtcactgagcagactactaagtgactaagggtcaggcagtctctacagcatgaaaatgccagacagagggaggattcacctcttgggcaggatggattgggagggagcaggactgctggagacttcatcatgctactcacaaccaagggcaatgtaaaactgatgcattgtttatttctggaattttctgcagaccatggttgaccgtagataactgaaactgcagaaagtataactgaggacaaacgagtagtactaatgaattctgtcatcttttgtagaatcgaagttatgcacttgtttaggaagtcatcatgtagaccaacctggccaacatggtaaaaccctgtctctactaaaagtacaaaaattagctgggcgtggtgacatgtacctgtaatcctagcactttgggaggcagaggtgggtggatcacttgagtttaggagtttgagagcaggctggccaacttggtgaaacctcatctctactaaaaatacaaaaaaattagccaggcatagtggtgggtgcctgtaatcccagctactcaggaggctgaggcaggagaattgcttgaacccgggagatggaggttgcagtgagctgagatggcgccactgcactccagcctgggcgacaaagcaagactccgtttcaaaaaaaaaaaaaaaaagcagtttaaaaaataagcactttgtattaatatattagaaatctacaggtctgttttgtactttttatactgttggatacttataataaaaacttttactagggtactgaataaacctagtcttattagaaaattaaaaaaataaaataaaaaaataaattgcttgacaagagataatgttggttatatgtcaaaaagaaaaagcctgatattttctataccttagctgagtcttcaatttaattttttaaatattaagatgagacaccaaaggaagaaaaagtagtctcctacctgaaggctccatctctcttttcttctcctaccttccccaccttttccttttgccaccaattcacaaagcagattccagtctccttattgagcctacaactgaaatgtttcttttgggaaaatatcttggcaaaagaaaggactggcagttaaactccagtcaacacaaagcagcatctattaataatcatctgatttcaaagtatgggcatcttctgttttagctatcttctctgactttaataatcacaatattttcaacaaacacacattctaatttttttggatgttccttgtttaaattgcaaatgcatgcaactaccttttggcaaagagaaacggactatgttcttcctagtgaacaaaggtcaccaaatcagactagaaggctgaaatttccagaaggctagggaagggaatcttccagcaaaatgaataaacagaagaaaaatatagaaaggttatggctcttgcttctaaagatcatgcttctcattctgtgaaaatatatgtcagagaaacctcattcagtgactaatgaaacttcttgctgcaaatatccctctctcccgctgtgaaatcacttaactcatttttcaagtgggagtaatctgctctgaagactcttacccttttgttaatgtgtctttctgctctagtgttggtctcaaaaaatgaaaataaatgcaccgcttttacagctgataggcatattttctatccctcgaaagttgaacagagcacctccaatctcaacacactttattttatgtttttcgagatttgtacatcagtgtgtttacactacaattaagcctccgttatctgttcagaaagatgtttttaaaaatagtagaatctgtccatgccccttgaccagcagtttacagagacaagccctatggcagaatgttcacattgtgcgtacttctcatgatgataattgagagatgaccaactcagtgtcacttctgaatttttcccacttgctcgtggtattaactaaatacaaatgcagtcaacagcactgcctcatatctttctcatgagcatgaggaatattggtaaaggaattttaaaacagatctacccttttttaaatcaataattggtctcacatactggagcattaaattcatgtaaggaagctgaactaaagagatacacgtttagaagtttgttgtaacagtttgaaatccttgaaggataaaaacatggtcaaagtaggtgattatcaggtatctctcatagaatacattctttttttcagttcaagagcatttagcttatttacttatttttattttttagagaccaggtcttgctctgtcgcctaggctggagtgcagtggaaccatcaatagctagctcactggagcctcaaacacctgggctcaagtgatcctattgcctcagtctcctgagtagcttggactacaggcacatatcaccatgcctggctaatttttcattttttttttagagatggggtctcactatgttacccagactggcctcaaattcccaggctcatgggatcctcctgccttggccttcccaaatgccaggattacaggcatgagccactgtgtccagccacttattattaattattattattattattaatctgtaacaatgatttttttcttattcattttaattggcaaaaacggtatatatttatatactggtatctggtgggtgtgaactggggatgctattcaataccttaaaatgcacaggacaaccccaacaaagcatagatttatgcagcaaatatcagtagtgctgaggctaccaaacctgactataaattaggtagatgtggctcaaaaactgaaagatgagcacggtcttctcctcactgcataaaatgatttgcttcaaccctcagtcttttccatgacattcaacagaaggactgtgttggacacaaggaggtcctccagcagatggttcagtgtaccatgcatattgctaacactggtttaaagtcagtcttgttccctgagcaggtgctccgagaaagaaccctctctttgaagacccatctctaggaaaacggctggtgcattgctcttgcaggaagctcatgctttcaacatgtctgtggacaggattggacggaattggatggaattggatgggatgtatgcacagctcataaatgggtcctcaataactacatgcctgattgaaaaagaatcatgttcagagacataggatgcaagttaaaaaaatcaatttaattgacacttcattttttccccaagaatattctagagagtggaaattttataactaaagctgcttccaactggaattaaaaagacaggcgtctctttttttctttctttctttctttctttctttctttctttctttctttctttctttctttctttctttctttctttcccttccttctctttctttctctttcttctctcttttctttcttctatctctctcttcctttcctttcctttatcagctctttaaaaataatctaaatcacacaaactagtggaaaataacgtgacaacagatcagacatactgaaggctcttgtctaatttacatgtctgagatgccataaggcagaattagtaggcaaaacagactttgcacaaaatcctatcaaacattatttttatctgataaaatactagttccccattgttgttaaagggaaaaatgagcataaggaaacagtgaggtctcacagtggctgagagtaattattaacttttttaaaatagggtagtgggtttctgaagttatagttgtaaaagtataaactgtacataaagtatacagtataataaatgttgacttatgtatacagttatgaagccatcaccacagtcaaggtgacagaaatatcaatcacacatagcagggcgtggtggcatgcacctgtagtcccagctactggggaggctgaggcaggagaactgcttgaacccaggaggtggaggttgtagtgagccgaggttgtgccactgcacttcaccctgggtgatagagtgagactctgtttaaaatatacatatatgtgtattttatacacatatacacacacacatatatatacatgtacatatatatatatcacaccccaaagtttacccatatccctttataatctatatctcttgctcctcctcctcatctcaggcaaacagttatctgcttacagacaggcattatgaattacagcttccaaaatattaaaagcgaagtaacagaattacggtctcttcattgcttggcctcttaggcttggcataatcattttaatattcatgcaggttgtagcatgcaccaacagttcattcatttttactgctcagaagcattccagcctatgaatacattcaggttcttggtcttggtatggacatatgctcctctttttcttgtgtaaatacctaggagttaaatggctgaaccacatggtacttgtaggtttaacaacaaaaaaattgccaaactcttctcaaaagtcctggtttcatatcacttccccaccagcagcttggggtggactctagctcctccaaatcctcaccaagccctggcatagcgagtcttgtggcttcagccattctcagatgtgtagtggtatttcactgtggtttcatttgtgcatttatccaatgactaatgatgctgagcacattttcattgggctattggtcatatgtatgttttcctaggtgaactgcctgttcaattttctgtccaattgttatggggtggtttctttttaattctccttttagaatatatatatgtgtgtatatatacacacatacatatatatgtgtatatatacacacatacatatatatgtgtatatatacacacatacatatatatgtgtatatatacacacatatacacacatctatacacacacaggggtaaattatatactatattgacaatatatatgatacagtatactatatatactatactgtatacaatttagtatactacatgtgctatatatataaaaaacacagtattttaaatatttattttatttaaataggcttttacattttcatagttcacattctgtaatttttagtaatagtgatactcagtatatcatatatatacatatgtgtagtatactgtatggtaaatatatgatatattttatatatagtatacaatactgtatcatatatactatatatgaatattgtatatatagtatataattgtaccagtacgtgtctatacatatatgtctaataccatatatactatatatttataggaaactgcatcatatatatgtatgtatgcatacatttatactggtacaataccttcatccgatatttaatttgcctatcttacctcccagtttgtgaattctctttacattcccttagcaatgtctttcatgtagcataagcatttttttaagttttgatgtagtccaatgtattaattggttcctttaaaaatcaagcttcttgttttaagtaagaaatatttgccaaaatctaaagtcacaaaatttttcttttttttttttttctcctggaagttttacaattttaagctttacatctaggtatttgactcacttttcagttgttttttgtacaaattgtgagttatagatcaaagctttttgtttactttttcttttcttttgtatatggatacttaatgtttccaacaccatttcttgaaaaaaaaatcattcctgcatagaattacctttgaatctccttggaaaattcattgtccatatatgtacagttctatgtggtgtctctagtctatgatattgatcaggttttacatctttatgtcaataatacgctgtttcaattaatatagctctatactaagtcttgagctcaggtagcaggagccctccaagtatgttctactgctacaaaaatgttttggttattgtagatcttttgtattttcattaaaattttaaatttatcttgttaatttatgtattttctaaaagtctactgttattttatttgggattgcaaagagtctgtagattaatttgtacaaaataaatatcttaacaatattgtatcttctcaggagggtgttgtgtttgtgaacacagtctgtctcccagttgcttaagccttcatcagtgtccctcagtgacagagtatagttttcagtgcatagactttgtcagatttactactctatagttgatatatgcatcaaccaaagtacgtttgtgacggattggaaataaataaataaaaatagcaaaagacctaattatccatgacagaccaatgaaaagtgtcatgctttgagatttccttgagaaatctaaacattctgaaacttttccatttctacaatatttattaacattctgattacatcttagtttgctcttcagtttttcaatggaaatttgataaagtttaattcccacttcaccaagatacaggcatacagagtatacatagtatacaggatttatgattgtgtacaagaaattggtgtgtttcatgtctaccaaattcaaattaattactagtaaagcctactagataatgagattttttaaaagtagacttgcattaagatctactcaactaaattttgaaaacattccagagtcaaatattaaaaataataaatataaaagcctaatttgcattaacagaaaatatatatttttgagtacaccaagaaattttaattttgtcttaaaatctaccattattctttcctaatgtgtctagattttaaaggtaaattcactgctctaagactgattgatagataaataatcacaagggtattatttactgaataattatagtatacaaagaagtttgctaggccaattacatacattgtgtcttatttatttctcccagtaactctccaaggtagctagcgttattgctatgttgtagattgattgcagacatactaatcaacagctggcactaaatccatcatcaatctttaagttgatgaccttacataacctcatgcatatataaacaggagcattttcattaaaaaaattaaatccctaaatttgaaacaaaacagtggctttagtaatttgtatttaaaacactcatgtttatttctaaaatggcttttaatcatgcattttcaaagatcaaacactctcaaaaacaccaaaatagccaaacatacatttcccaaggaacactcaaatattgattgaaaagtgtaaagaaacttgcgaataaacaagagtatgactcagtgcttcagagagaaatgttaatgaaaatatcttttcaaccacaatgctaccagtaacataaatcctaattaaacccaagttgcataggctgtggtgtcaggtgatgattaactgtctgaaatttctttgaagtttgagttgttaggaatgagattgctgatttaatttattttaatgcctgtgaaataaagtcacaattctttgaactctgaactgctcttaagagaatacagtgctaataaaatatttgcattatctttataaactcatgttccacctactcatttctgtaatatattagaataaatcagaagcctacatctagcagtaacagagtagattattcaaaccaaccttcttattgaaaatggattgtaatatgtgtgatttttttaagtctcttaaaaacattttagtgctaaaatcatatttaagattacagcttcaaaactgattatcacagcctgggcaacatggtgaaaccttgtctctacaaaaaattttttaaaaagtggccaggcgtagtggcacacacccgtggtcccagctactggggagggtgaggtgggaggaagtcttcagcccaggagttcgaggctgcagtgaaccctgttcgtgccactgcactccagcctggatgacacagtaagaccctgtctcaaaacacaatacaaacaaacaaaaaacaaagaaacaaacaaaaacacactgacgaccaaatgatgatccagctagatgcccagcacacaaagcagcctttgccctagtgcactgttccaatctggaagaaactgtgggagttcttgcagcatcaccatgtaatggggcaactctcagaccctagtcacgcctgaaggtcccaatctaatatacttgcctttaacattttcctaccttcatgggtttcaccctcaaggcaaacatgaaacaaaactaaattcagtcttgcaagtgcttgcagtctaccttcataacatctatgaacaattcagggaagagcatggccccatggatgaaagaacctagaatttcgctacccatgggttatctgctttggagaaagatgccactaatccatttgcaaatacaatggccaattcacaatgattaccaagcccatgaagaaagaaacaagaagtcaccaacaagagccagcagaaatcccaaaggaattaagatgccatgaaaatatatacatgataaccaattttttgaagaatgttcaaaaagcttgaaaacaaaaagttggaaaacatctgcagggaataagaaagtattaaaaatgaaaaaataaaaatcaaatcaaacttctagatcagagaaataaacaaaatgagaaaatgaatgggtccacctaagggcagattaaacaaagctgaagagaaaaatggacaaacttgagaagaggtgagaagaaacgatccagagagtatcgtggaaatctgaaaaaagctgggaaaccgggtgcagtggcccacacctgtaatcccaactattcaaaagactgagttagaaggattgcttgaggccaggaattagagaacagcctgggcaacaaagcaagacctagtctctaaaaaaattttaaagtataaaatagtagctaggcatggtggcatgtgactgtagtcccagctactcaggaggctgaggcaggagaatcacatgagcccaagagatcgaagctacagtgagctatgattgtgccactgggcacagagcacaacctctccagcctgggcaacacagggagctgtcatatacaaaaaatataaaatagagagttagaaataaggaaaacaatatgagaatatctaatatatgcataattataatacttagaccatgaagatattagtcaatgaaaccaaaaagcaaaaaagagaaagaaacaaaagggtgattgaaaaaaatagaaatacaaaatgcagactttaaaataactaggaagaatgcattccagaaaatataaaattgagaacttcgaaaatgtggaaactataagaagaaactaaaattaatccttgaaatgtaatgaaaatatatatcaaacataaagatttgatgcattggtttaaccatgcattagatacagtagaaaagagaattaatgaaatagattataggtcttgagaaaaagtaatccagaatgaagcttgaaagtaaaatttaatacaaaatacaaaaaaaaaaagactaaaaaaggagccagagggagaaaatctaaattatgtgcaaacagagtgaaaacaagagaaacagcaccaaaatttgaagaggtaatgactattttcagaatggaagaaaccacgattgcaaatttcaaggtcatcaaggaattccaatcagattaataaacccctaatggtatcacagtgaaacggcagaaactcaaagaaaaactatcttaaaggtatcagggggatatagacaaactatctgcagaaaatatattatttttaaaggagcaacacttaaactgacagctaaattctccataccaataatggaatccagagaataggagaatgatttctcagatggctgaaagaagtaattgcaaattaaaattcaatgagaatattgttcaagaagaggatgtcataaagacacatttagccatgcaaacagagtttccaacagcttgttagctctgaaaatatattttagatcaccgatagattcttttaagacaataatcacagataaaagtaggaggtacaaaaagtaatgaaacataaataaaatagtgtaatcatcagaaaatcaaaattaatattgaaataataagataagcaatcatatctgaaaaagattcctaaaaaacacaaaacattgaaaggtactaacagcaagtaggttaggtcataaacatggagctaaaatacactgactactgggtattttcagagaagtggaaaatgtattaattaaaattagtgattatattaaggatctgtgttgtaatttctagggttatttactaaaactagtacagtcttttaacatctagtgtagagggagaagtgggagtgaaggaaatggagtaatgttatttgtcttttatttctttattttctgagacaggatcttgttctgtcatccaggttgcagtgcagtggtgccatcataggtcactgcagccttgaactcatgggatcagactctcctgtcaactcttatctctggagtacctaggactacaggtgcacaccaccacacctggctaatttattttttttatttatttatttttttttatgtttcatagagatgaggtcttgctatgttcctcaggctggtcttgaactcctggaggattctaaagtgatcctcctgccttggtctcccaaagtgctaggattacaggtgtgagccactgtgcctggcctgaatgattttttaaaaagcaattcaagcaagatgtagaagtgggatattagtagcacaatttaggatagaagacttaaacacaaatatatcaaaaataaaagtaaatatcagtggatctgcggttgaaaatcaaagattatgagacccaaatagacgctatgtagaaaagactcaaaacctgagtcaacagaaaggcctgaagtaaacacatgggaactatacacaattggattactaacaaaacaaaggtaatgttaacgtcaaactaaacagacattaaggcatgaagcaccacagacttacagaggatcactttataatgagaagaaccttaatttgccacaatgcaataaaaattctagactgtatccactaaaattcataagcatataaaatgcaagaaactaaattttggaaaaatatacgaaaagattttaaaacatccataaacatcgtgggaaaatttaatagacctattttagttactgaaagaatatgtaaactaccacctggaaaactatatagagtatgtgaacaacatacttcaacagtttgagatattagacatatagcacattgcaccaaccatcgcaaaataaacacttttctcagggatgcaatgcatattggcaagaaataaacaaagtataaaaatataaattgcggattattataaaatcatgaagataaaaatgtgatgattggcacagaggtagacaaagagatcacttgaactttagtgacatggatcaaactgtttaaaataaattgtattgtgatattctaaggaaaaataaactagacctcttacagaatgcaataaatatattccctgtgtggtttcaatatgaaagataaaatattaagcttttttcagataaaataaaaggaaatcttcatatctcttggtaggaaaagatatcctaaacaaaaattccaaagcactaatctgaaagaaaatattgtaaagtctataaactaacattaagaactttagcttatttaaataaatcattaaaaacatggaaggaaaatcagaagatatttgcaacatatataatcagtgaagcactctaatcgaaatacagcaataagacacacaacccagtagaaaaacagatcaaaaacagacgcttcaccaaacaggacatatgaatggccaagagatatatggaaatgtctcaacctcagagtaaacacagtgaacacacaatgggtttccatgtacacacgctagatcagaaaaataaaatagaacttttatactgccacatgttgaagattgcacactcctggtgaaaacaggcatttctgtactggaaaacagttcatccttatataaactatacagttgaagatttgaaccagcaattccataatggtatatgtctcagaaaaccaatgcttgtgagaaaggagggtgcctgaaaaagaatgttaataacacgaatttataataacctcaaactcaaaataataaccatatctattaggaataaaatggacatagggactgtggtatgttcagactttagaacactatacaacaattaaaatgagtggaatggatgtatacacagcaacacatatgaaatttataaaacagtattatgcatgaaaaaaacacaccagaaagtaatagaaagttgcattcatttagagtctccaaacaagcaaaatttaattatgtgattcagggatgcctttatcattgggaaaatataaagaaaagcatggaaatgagtagtaaaagggaataatggttatcacggaggaggataaggagatagaatgggaaaagagcatgcactgctttgaagatggaaactatatttcttcacatgggtgttggttatagaaacacttgccttaagctttcacattgcatggagcattgataatataagataacagaacacacagaactttggtttctgtgtgttacacttcaaatggattattttttttaatcagtgtaaatctaagttcagcataaatgttgaccagttaacctcatgcatctattatattgtttcatatggccctattatttgtggtttctaatggttgtctttatattgtccatcttgaaaataccattagaaaccatgaacacatcaccagagagtgattcatgctaatgagaaaaacatgctgcagaatttctgttttccacttcctgttaatttaaaaggtattgaggctgggcaccgtggctcacgcctgttctcccagcactctgggaggctgagatgggaggactgcttcaggccaggagtttgagacccacctgggcaacatagtaagactctgtctcagtgaatttatttaaaaaaattagcttggtatggtggtgcctagttgtagtcctagctactcaggaggctgaggcaggaggatcacttgagcccaggagttggaggctgcggtgagccatggtcacaacgctgcactccagcctgcaatagagttacaccctgtctgcttttttaaaaaggaggggtactgcaaaagccttatccaatctcccagccccttctgcaacttctcaatggacacacttccgtacagtagcagcagctgatgaatagtcgtgaattcacttattcctagatgtgaaactccaataggaactgagccattgatccgtccatcacaggcccatcctcaggtctatagcattgtctgaggcttaacactacagttattctttctgattgcacattggcgtgtgcaataatttattaggaccctctaagtgtctacaccaattgctactgtactgcaatttacctatttatctagccacatgaaatattcagttagttgtatggaaaccacattataaaacctttaattattcaaagacattggcgggtgggaatgttctaattcagtagaaaccagattacctagaatttaacatgaagcaagtaccttcattggttattagggaaggcagaactggcaaaaaatgacatgggaggtacatgggaaagttagaaaacattccactaaacagactttaaaaggtgagactatatgatgggcattctaaaaatacatagaagacaacacctggctgcacaggaatgacatccttcatggcaagtccatttggaaaggcatatgcctggcatttagctcaatgcattttgattttcttttcaatgtgccttaaggtttagttgaggctgggcgcattggctcccgcctgtaatcccagcactttgggaggccaaggcgggcagaacacttgaagccaagagttcgagaccagcctggctaacatggtgaaactccgtccctactaaaaaaaatacaaaaatcagctgggcgtggtggcacgtgcctgtatttctggctacttgggaggttgaggcaggagaatcgcttgaacctgtgaggtggaggttatagtgagccgtgatcatgccactgcactccagcttgggcgacagagcgagactctgtctcaaaaaaataaaaaaaataaaaaaaataaaaaaaaaaataaaaaagagttagttgaaacaagctcacctttatttatagctgttccttgtctttgaattaaaattgtgttatacaatgtggtcactgaccttactcaacagaaccctggctgtatccaaatataaatgcctccttaaggattaagacttgcctcagcaagatattaaaaataaattactatgggctctgaaacgttttaaagtgaggagaaataaagaagtttccagcagtcttaccttattgtaattagtgtactgcctctgaagtgactaatttgaatataataaagctcattttgggtatatgatttctgatatccttgctaaattatatcagcctaattacgtaacagtcagcacccatatacctttatcatttcactagttttacttcttaaagtgaagttgctcagaacactgctaggttaattttgattttcatatgtaagaatacgcattgctaaacttttgctattgcaacttccatcttaatttcctaaagtccattgtgaagtcctttaatatatgagatatataagatatggtttttaataacactttaaaaattttcctattaggttacaacttgtatgtttttcatatctgtttagtttctcctctcaaaactggagtagctcctccttaccaggggcagtgagggatgctttccaagacccccattggatgcctcaagctgtggacagtaccaaactctatatatgcaatgttttttcctatacctgcatgcccatgataacgtttattttataaattaggcacagtaagagattaacaacaattaaaataaaatacaactgtaacaatatatactctaataaaacgttacgtgaatgtgatgtctctttctctctctcaaaatatcactgtactgtactaacctaaccatgggtaatggaaatcacagataacgggggttggttggggggattacatatctctgtctctattttcctctctctctctctctctctctctctctctctctctctgctatatctaaatccacccaaacaacaagcggcgaagacaaaataccagtgggcaataagaaggcttcaagaattttctgaatactaaaagcaactgaaaaacattataactgacataataatgttaaaaagaccaagaaagaaagagaacgtcaaggcactagatacagaagctcaagctggtcagaaggaaacagaaggattacaagagtaaatgagaacagaatcacgtgctgcagaaaaagtacgagcttgcagagattagcaaccaggttagctgcacagagacaccctgggcgggaggctgcaagatgccttttagagaaacccatggctctctgcaaaagcaaagacctgcatatcacgaatgctggtagtttatactaataatgaggtatgtatgaagaaagacaggcagaagaattatatataacaacaatacaagaatacacagcagccaaaatattcattttttcctttttcatgcattcactatttcacccatttattcctttattcaactaattttttttgtgtccctactacattccaaatactgatttagacagtggggataaagacaggctaccaagtgatcaagttggatgaaacagactaagggcaaatatacagtatgctaagtacgataggtggaggggaaggaggagagggttgagggaccctctaagtcagaaaagtacctgatactggatgcatgagaaataggcacacctctagccaggtaatacggccccacaggtactcagcttgcagagtgtatctagggctaaatttcagcctccattagtcccttagccttcagccttgcaccacgcaagctgtacaataataccagcacatgcgtgtgtgcatgcacaccttttattttgaattgcaagaaatgcaaccttatttggattgcagaatggtttccctatccctgaaacaacaagtctaagatggcttgcaacaaggacacacgcacaatagggcatttctgacatgagaagacatggcctagcatttgggggtgaaatatgtggccgccttctccctgtgagattcaaatgtttgaaggtggcattgagattctagggtagaaaaagtaagaaaaaatgaaaatatttcctttcctttttttttttcccccaaaggaacaatatccaatgagacattgttcttcttaggggattcctcctctcccttccccccacagcataatcaatgaaaacatagcagaaacctccctgtctaagcccagagaagtgagaggactgtggagaattttctttccacctctaattccatcctcatttctgaaaggggatgctgacttgcaaccccatggtgcctgcaggtgcagctgacaacgatgcttgcagtttccatgagccagtgtgttttctgctgagtgagatggaaataggacaggtgagggcctgacattctcttgcctagaaaatccacgaggaaataaggcccctttctcagcatgcagtgttcagaggaagacatgaagattacatccatcagtgctaataacagtaaacaagtgtgaatgatgccaacacttgatttaaacaccacataggcaggggacatctatcgtgggctggtaacaccaatgagttataattgaaatcagcagtaaagacaggataattgcatatccaatctgaagacagacttcttcctgtttgttttattttaccttcactttaatttcctcatagtgtcacaatctaattccatttaatgaagggggaaaagggaaggaaaagaaaaatttaatacatttctacgagtaggattatttgacaacagatgggctgcctcctgatagaaggagttttgtgtgtgaagaattctaatttaggccttttcctgccatgttagtttcatgctaaaagtttcaaagctaaaaaccaagtcatactgacagaataacactcctggagggtttactcttggtaaggcacccctcttaactccatttatacctataattttactatctttagagttggacctaatgaggaataaagacagaaacaaacaacaggtttagacacaaagagagattacataacttgtctaggatcacagacagatctagacgtgcccaaagtgggacttgtacaatgtcttactccatatgcattgctataacggaatacctgaagctgagcaatttataaagaaaagacggtccaggcatggtggctcacatctgtaatcccagcactttaggaggctgaagcaggaggaccgcttgaggtcaggagtttgagaccagcctgggaaactcagcaagactgtccctacaatttttttaattaactgggcatggaggcatgcacctgtagtcctagctactcgggaggttgaggtgggagggtggcttgagcctaggagtttgaggctgcagtgagctatgattgcaccactgtactccagtctaacagagcaagaccttgtctctaattagaaaaataaaaaagaaaagaaaagaggtttatttggctcacagttcttcggggtgtacaagaagcatggtaccagcatctgcttctggtgaggcctcagggagcttccacttatggtggaagaggaaggggagctgctgtgtgcgcagatcatatggtgagagaggaagcaagagagagaggagaggaaggtgccaggctctttttaacaacctgatctcctgagaaataatagagcaagaactcaggcatcacctggaagactgcaccaagtcattcatgagggatccggccaatgacccaaatgcctcccaccaagtcacacctccaacactggggatcagttttcaacgtgagatttggagaagacaaatatccaaactatatcataccctgtgagtatgtcttcaaagcctctgcttgtcttcaaagctgctttcagatagcaccttagggagcaccaataagtatccccatattctaaaccaaggtttttcaaccttaatactagtggcattatgaatgggataattccttgttctcgtgggctgtcctctgcattgcagtatattgagcaacatcttggacttatatccattagatgccagaagcatcaccaatctccagctgtaacaacccgaagtatgtacatgcatagtcaaatgtcccttggagaggaaaacttatacctcactgggggctaatggtttagctagaggaagcattttaaatatgagtaagaaaaaaacattaacttagagcagggtttattaatgtcagcatcaatgacatttggaatcagatcattgttatggatgagtgtcctacgaattgtaggatgttgaacagtaaccgtggtctccaccaactaagtgcattaacacccttcaaactcactctgacaactggaaatgtctccttacattgccaagcagggcacaactgcccatgactgagagccatggttctaaatcaagaagtgtgtctaccaaagcaaggcctagtaacagactgtggggctggccacaccatacttggcccatcagccttgttcaggccttatggggcacagcaaagacagtggtgaaggatgaagatgccggagggttggccctgtcagctacgatggtgatggagccaaatgtgaaccacatagaaagaagtgctctttggtcatctagaaagggactgtgccctggtctcacctctagagaacaggtgaggatcacagaagaggttcagctgaagtgatggagggaggaaagagattcaacccaagtcaaatgaactgcagtgggtggaacttgccacagaaaccctggaaatcatatatgcctccaaagtaaagttcaactgtgtacagctgctgctcccagaagacagtagcatcagactttaactctaccaccagccacgcaagaagttgccttttcctctcatggcccctctcctcttagtgaggaaagacgtcagcttcacactcctttctcactgaatggttgtcctgtctgtggctttcccaggaaaggaaagtgaaaaaaatttgtaatggaggagaaattgcaacagactgaactggatggttaagatccttgagtggccagaattcctatgctttatgcacgttagtcagccaagggtgaggataaagaaggctaccgattagattgagatgtaagaagcatttgctgcctatttgtgctttattgaatccagccagtatgtactttactagaacctcttagtgggtagacaggagatgggtaattacctaatgagacattttacaccaggcacttgctaagattgagggcttggattaaacaacttaggaggtctcttcttatgttatttttaactttcttttcaacataatggtctaaaggaatatgcatccctcaaaccaggggcaaaatggtgaaaattttggatatattctgtcttttgccatgaagaactacgctaccaacctacccactagagctagtagcatgcaaacaatttcatgtatctttcatttcttctctgagattcttagcagaaccacaaggaccataacgatatcgcttattgggaagagcctcttacttcctggtcaagccctatagaatgcagtgatccctaagggattggcagacaactgttacctgtttgcaggccacaactgtgatgcagaagttcggcagaaggatattcaatatggcagagggatattgaattcactatgttttgcaacccttgtggcctgcacatactcatacaactcatataacttgactaccttaatcctaaataagtgcttgaaggtgtatttacttacactgataagtagttagtaaatcaatgtcaaaacatataccttctttgatgttagtcttgcccaatattttggacattttaaaatacgtttgagaatacttttggcaatattttttattttgctttggttgctacaatctttgtaacagctcctctaatgaatgagtcaatacttttaataatccctctcaatgtagctatagttttgcaagaatttctccacctctcacttggttaactgaagcaaatgctctggttaagtatgcaaatcctatttaagagaaaggagtttcccatgaaggcactgtcctcttcttcccttggggagctttatacacaaaattgcctctgtgtgcgaagagcacaggaacagacagacagatgagtcagggagaagcgaagttgatggaagatgttggtatcaaaacagctagaacttgatttggagcattttggttatttctgacttattcctgacctatacagcaaagccagcaacgaagccatatgactaatgcattttgtaaacaagacactgagtcctgttacagatagctggagacatctgactggggccaggcaagatgttgaccaacatcaagacttgaccagattttaggaactgggagcacactgggctttacctaatggttcaatgtaggcttaagaaacagctgacacatgtactagtgctcaggcacaaagcacagatatgaattttagtagccatgacagacttctaaggagtccttctcaatgaggctctacttcaaagatgccatgtttgaggggccatcgagatggtgattcactgatataagggcaagggtcaggcagggtttagaatgaaaataaaagtaccctgttcttttaaccagcaagagaccctcagagttcactgacatctggatccagtgcccatcctcactctttcttttctgacattttgtatcccagtttatcactcaagagaaattcagtgagcacttactgtatacacgtacgtatccataagtgccattcatcagactgtgaataaatatgaaacctagagccctttgtcttacaattaaactttttttataagcccagaacacacatttctgtacaagatgacacatgaacagatacctaaaagtatcctcaaccaagtgaaaaataattagggcatcaaagccatccaaagatagctggatggtcacagtccctgaaaggattccctggaaagtcagatccagcttagtcattcaaagcagcgcctcccctgatgaaaagaagagatcacaatgcaatcagtcaagcttatctggggtccagagcctttgcagaatctcagcctgccagcctgtggctcaggtgtgcccatctagataagagtccgactttgatatgtgggatcacaactttcctctcatccttgcctttggggcgtttttctgtgctaccgagtttgattccactgatttttctccctgccggggtcacctagggactgcaagataacagaggcacagagcctccacttacacagagcaaaggaggctgtgggataatgaacagccagccccttgaagctctgtcagagggactcaaagactttcccatttaccggtgcagtttctgaggaatctgatgctgtgtgggcctgcccacagaaataacaatcctcacccttttcacctttttttttttttttgagacagagtcttgctctgtcacccaggctggagtacagtggcgtgatcttggctcactgcaacctctgcctcccgggttcaggagattctcctgcctcagcctcccaagtagctgggattacagggatgcgccaccatgcccagctaacttttgtacttttagtagagatggggtttcaccatgttggccaggccacttgtactccttccctcaagtgatccgccggcctcggcctcccaaagtgctgggattacaggcatgagccacttatgcccggtctatcctcatccttttttaaaaaactgaagtagaagtatggagaacatggctaattcttgcgtagataatcaataataccctcttaaataaaaatcatatttacaacaaaagcacgaaagaaaaaaattgtatgattagctaatgcggtcggaagttagtagttccatttgttgctcctatataaatcatgtggaacttaaaattcctctatttttagtttctgcttttttgggggtggggttggaggaggttagattaacaaatgcagacacactgtgatgattattcatatgtaatacaaatatgtatatatatctatatatataaattatatatagatacaaacatatatatgaagagttagtaatttttatgttttatacatacatttataaactcagaagagttacatatgttatatatattaatacctcatatgtattgatattctccaatgaatcaaagggattttaataaaggttgattggggaatgactttcaagacctataagcaaaataaaattttcaaaatatggttacaaattaaaaaaaaaacaataggtagtatatattacatgatctgtatttcatagttttaatatatatcacagatttacatttataatacaaaaatttataaattatacacatttaatatataaaattacatgtgtgtgtgtgtgtgtgtgtatatatatatacacatatatatatacacatatatatatatatatacacacgtatatatatatatatataatagcctttccatgtggcagggactcttactagcactgtttgtacagtaactcttttgatcctcaaaacaccataagactcatttattttaaaggtgagaaaaatgaggcccagagaggttaagtcaattaatcaacaacacacagctcacgaggctctaatacagcactggttttgccataggtagagaaacctgaaagaaaacattgtgtgatgtgccaatgtggtcagtagttagaactcccatctgttgctcatatacaagtcatgtggaaattgaaattcctctgcttttaatctctacttaggtataaacataaagtggaggagatgcacatccaagctgccttagtctaactttgcttaatacaacatctttaagccctttgtatttttctctgatatttccaggtatgctctctcttgtttaggaaactctctcaatttatgaaatgtaattgtgcatctttaggccgggcgcagtggctcacacctgtaatcccaacactttgggaggccgaggcgggtggatcacctgaagtcaggagttcaagaccagccaggccaacatggtgaaacctcgtctctactaaaaatacaaaaattagctgggtgtggtggcaggctcctgtaatcccagctactcgggaggctgaggcaggagaatcacttgaacctgggaggcagaggttgcagtgagccaagattgcaccattgcactccaacctaggcgacaagagggaaactccttctcaaaaaaaaaaaaaaaaaagatatataattgtgcatctttttatcatgtcccctatggttcctttaagaaaacaattttattcagacacctttttcagcacctagcaccatgtgtatgaaacacttggctgacactatcacaagatatgaaaatgattttgtgtcatgttaaattgttggtagaatgtgccaaagaatcattcccagaagctctgatgactcagacatacaaccaaggcatagtagattattttttccaacagctaaaatggcacagccccatggcagttgcattttaaacactggggaaaaaaaagaggaaaaaaagatcattctcttggcctgcttgctttgaaaatgtggcattctttagacaaattaaatacaaaatataagtagagaaattgatacggggtgcatgttttcaaaacttttgtccaaaacaggacttcaaacattttatagggcatgtctgcaatgtgcagttgaaatgatcacagtttcattttaataaaatgcaaatgcatggattggtgttaagtagattctactgaaaaatctgcacaatttgcccactcggtgctgtagaaagcactgcacctctctgctttgtactcacgcactgtcatctcccttgttgtagaggaagcttctgaacagccttttccagcaatgagcctgaaagcaaactaaaaccccagttgccaccaagacgacctaggcctgaatacccccactgatcttttgtggttaatcagtcacagttggttctgaaagagaagaaataaccatttttttctttctactgttgcccaatggccttaagttgcagcttgaacactcttgtgcatgcacaagctctcccagctggtttaaatgctgtaggattaattttcaacctaaataaatctaagtataattttctgtatctaataacccaaaaagctgtcaatcatcttgttttctaacctgtttctcttagaatctttaaacatattttgaaagctcagccatgctgtcactttaaaaataagtatgataactttggcttgctcacaacctttttaaaataagcagtatgcaatcatcagaaccaagaaaatatgagattaatttgttaaataaggtttatttgtgcatgcttctggctctcacaaactagaatcacttacctcttaaaaaaactaaggttgaatgcatgaaaatcaaactcaataattgaaagtaaacgatgagatatcttttgtcaatatttttcttttgcatgtcatctggttcttcaaaccccaaaagaacaaatgcacatgagtttatcccttggtgtttcaagggcatgtattagatttgcactattatcgctggctagctcttggggaatttcagaccctactcctgaatgtggcttgcacgttcaattaccattggaagaaaacaagaagtaggagcaatattgttctacggagtttggctgccacagaaaatgtcattactccgcaaaaattaacctaagccctttgttctaggaaaagatggccacaatgatcagaatcagagaacaaatatatcagtgtggacaaatctgaatcagccatacagaatgtaacaataaaaccaagagtcaaagacattaatatgggccatccctatccaagccaggcccatggacaaaagtcctaggctataaatggaattctcccatccttaagatgcctgcatctctccaatggagatggtatctgctgactggccacagaagatgcctcccagtatgtgagttacacaactcctcttttttccagctttcctgaattctaaagaacctgattaaaattaactcccactgaagattgtgttgaccacaggatgtcccttttctgcaacaaataaaatattggcgtttggtttcttagaaaaaagcctggagattaatgggctagactttcccatatagtctatgttgagactccagtattatctccaaccctctgcaggatttgaggcatgttacttagtttatttaattctcagttactcacaaaagagaaaagcagcccctgctggtcagcagctgacctggtaatgtaccctaagccctggcaatgctgggagttggtctgtgccttgcagctaggttgtgccatcgtcctgttgaacataaaaaaaaaaatcatggaacaacaacgccaggcaaaatgcctccagtctctttggtaaaacatagcaagagtcacctttattctagttcctaacaagttacccatatcaatctgagaccacctcagcctggacttcattgtccatatcactatcagcattttggtcaaggccattcaacaagtctctagaaagttccaaactttcccacatctccctgtcttctgagcccttcaaactgttccaatttctgcctgttacccagttccaaagtcacttccacatttttgggtatcttcacagcagcaccccactctcagtagcaatttccattatcatgctgctattaaagacatacccgagagtgggtaatgtataaaggaaaaaagtttgactcacagttcagcatggctggggagtcctcaggaaacttacaatcatggcggaaggggaagcaaatatgtccttcatcacatggtggtagcaaggagaagtgctgagcaaaaggaggaaaagccccttacacaatcctctgatctcatgagaactcactatcatgagaacatcatgagggtaaccaccacaggattcaattacttcccactggctccctcccatgacacatggggattatgggaactacagttcaagatgacatttgggtgaggacaaagccaaaccatatcaccatgccatctagtaaaatggtcaggcaagtttagacatacaaaagtgactatgtgaactgtataaaccaagtcaaatggagtacaactaaaagagagtctgtgtttagtgtagaatcagtggaaatatgtgaggttcaatcaacatgcttactaagaaacagcataatttaaattacttcttgtgatgcttagaaagagacacattctttagagcaaattgctgacttataaatcactatcatagacaattgttggaagaaaatttttcacctgcagaatgaagtgtgctcatgaaaggtacacctactggttttagatcggtggggtttgaaataaaagcatttaatttttcaatttcaaaacaatcatgttgtggaccatttcagaaagaactagaagaaactgagagcctgggagcttattcagagtcatttttttttttttttaaatatggaaaccactaaatgtacattcaccatcaaatcctgcccgagctcttgggaaggtaaataagctactgataaaactttgttgcaaaccagaactctataaagaaataaaggaaaaatccaagatagaatacattgattttattttctaatagtagaaacatttaaacattgttgttgttgtgttttaatctcatttgaaaacaaatgcaaatttgacaacatgagcacttgccactaaggggtgtagaatatatctaattggttacctaagacacttgaaagaactagtaggatctctctttaattcccatgttagggtagaagctcccctaaaatcaggaaacatgtgtaatgacttcctgtggggggtgcatggcaacatattcaagctaatgtagaagacacgtgaggtcgaggcatggaaaaatactgaggcactgtgtgcatgttgtttgtgcatgagactagaactccttgtccctgaaaacaggacagggagtagtatgtgtgataaggagtgctgaacacagcctcctaagaatgtggtttgagtgttttttacaaggtcatatgtgcctcatgacccaaccgcaaagagccacctggtggatgtcttttgttcatctgaactgtagtttaaacaagctctctcaataaatattcaggtggatggatcttggggcagcactctctcagaagagctgttccccgccccgttcagctggaattgtttgagtacttcattctcagcattcactgcagctataagctgtacttgcctgtttacatctgagctcaaaagacattcattaaattaataaaaggagattttaaataattaaacgtttttgaacttccacacaaacgtgcctcttgcatacctaaaataaatacaaaaccgatagggacagaaggcagggaaattctgggcagaagagagcgggttcccggtaagtgccccaccctcaagccaaaaagcaaccagggcccaaagtgagaatttacattcctgttttcccactcgactgctgccttttccaaaaccacccatggcctgccctgcaccacatcctgtgcccataaaaactccaggcatagcttggaaaggggagaagcagctggacatcggaaattatagttggacatcagagagaagtggcttgacttcagagggacagcttgatggcatagctttggagaagattctggccggggatgacgggactcctggggaagattatcttcctgctccatcccgttttcagttccccttcctgctgagagctactttcaaccagcaataaaaaatcccctgcatttaccatcttcaatttgttcgtgtgacctgattgctcctggacgtcagtctgttgcgggatcaggaggaccagagagagacctcggggtgtatacaggaggatatctttattattgagtgcactcagacccagcagactcaacgtccaacgactgggcccggaacaaagacagcacttgtctttcatacacacttaacaaaagggggtgggctagcttgaagtaagcttacagtggcgtgaaagcagggatacagaggcaggacaaactcaggaccgcatatgaccattgccaagcaatccagatgtctgttacctaggttttgctctaaagtgccttgcactggtttatttcataaccttcactatggtgcccaagcagctgtagttcaggcctaatcaggcttctcatgaccttcgttgtactttttagataaaacagaatacttgaagtcattagttacagagaacaggaatctataaactcattccataaaacaaacgaaaatttgttttccttctccctatgttgagggagtgctgggagagtctccagagcacattagataatattatcaagacttttcctgggtctgggctgtgcctgttgctgcctctgggaaaagtcagcctaatacaggaaaacttatttctctttctttttgattttatttttctttaatttcccacctcaggacaaaaacttgcgtgccatgagtgtgggtgcaaaaggctgtcacattgaccctccactgagctgttaacacttacggtctctgcggatggcaaagccaaacaggcagtgtaacacttcctctgggtcttcaggggttgcgggctaccctctactagatgctgccgtggggctggtatggagttcattcttgctggtgcccaaaattgttcgccctggctcctgtacctgctcacctgtgcttcccctcccacaaggggtagagcagcgagtgagcagggttcacccccgctggcctggaagcagccggctagttccagcaccagtgcactccagttcccacctgtgaaggggtcagggaaatatcctgtttcattaagaaactgttaaagaactagtagggtctctgtttatttcccatgttggggtggaagttccctaaaaacaagaaacatgtgtaacaagttgtctgtttacatctgacctcaaaagacacttattaaatgaatgaaaggagatttaaaatatttaaatgcttttgaactcccacacaaacgtgccccttgcatacctaaaataaatacaaaatcacatttattaattacgaattttgtgtttctttgtgatcccatgttctgtcattttacaactacatttaaaatataaaaaacaacataagggaaaaatgaaaacaaaacttttcctcatatactagatgcttctcaaatggatactatttcttttgatgatagcaagagtatctttactcacaaacatcaatatgttaagcacatcatctattcacagaaatagtacaagttatagagaggaaatgaaaacgaaatgtttcatttgataggaatggtgaagcaggaaatgagaagagtagaaaatgaacaaaggcatgcttttcttcttctatcactaaacattaagtgatgccaatttgttattttcttcttggaactgcatgggtagggttttagaagccggaaactgctggatcaaataaggttcttggcttatgtactcccaaccctgtttcccccattccctggggcttcaagatcattcacacaaaaggcatgcttttgaatattcagtaatattttctcctgctggtaatttgctctgcagactgtaacgtttcacgttcctaagaattgacagaatgttgctgtttagggataaatgcagcccactgagaagagggtcaagatgaaggatcaagatgcaattagatgtttcagaatttacatgagatattatcccatgtgcctatcaatattgcaatccagcaagaaaacaacacttggttagatgtttctgaaactgcactagtttacttatcctgatatcataagataagtgcttctttcaattgtattttaccttcagattatttgttaaaaactaaaacaaattcaaacaaaacaaaacaaactacaaaagtgagacaaggcagtgaatggggattctgtcccaatgcagatcccggggattctcttactggcatgatgaatggttaacagctatgctgcattgtggaagtaaaatggcattcctccaaaaaatggaccaacgaatacataccttgggcctttaaggtcatgtcaaccaatggttgaaaccacaagggatacatgccatctgggtgccaactgtcatcaatataacaaagacatctgagatggggatgtgtctctgagtggcatttagcttcctcccagagaagtgagccttgactgtctgcagcggaaccatcaacacacagccctgggttgtcttcactacccagttgttgggactcataaacccatacagcaaaatatggcactttgatgtgctgaactgaagaagaagcctcaacgtctctctcatcttctcccactccctcttgtctctcaaccctctgtgacccccaaagcacaggaggaagttgttttctgaagttgtttatctgcctaaagtctggacccatcaaagaagaaaacaatgacctctggtcccttccccgagattctagtaactggactcatatcgcaggaagaaagaatgaagtctgtcaacacacctggacagacttttgtgacaaaccactgtctgctctgcaagcccaacagactttgttctaagccactgtatgttcttcaagcccacttaattcccctaaaaatcatttactatccccctaagtatcatccaggagtcctcacctccctttcctctaggaagtagagtatataagcatatctactccattaagatattgggtaatcagtctcctaatccttcctgccaagctatccacattaaaggaaatttgcatgccttttcttcaattaatctgcctttttaagttgatttttcagtgaaccctcagaggggaaaggggaagtttctactaggggaagtgcctacacagccaacagttttgaccaaatcttataagataaatttttgcacagtgctcaagctgaagccaggaacaaagcacaggttctatgagttaataatgatgagaaaataactcaagtctaaggggtgaaaataggaaaacctgtcaccttaatacagtgtgtattttccacagtgggaaggaaaaagtgtgggcagatatctaatagttgcatatgcagctgaaaatataaagtaatctaaatactagatccaaacgccagattaacaattcttgcagtaaatatcatccactaatagtcccaaattttattataaaccaagtaaatgtaagtaatgttttggcatgtggtttaaagagtgaataatttgggcagatgttaagaatacacttaacattagaaaaactagaccaaagttagacatcaaacatcgttatcatcctaaaaacaattttatcttcccaaatgtgcttcatttcaaacgagctattttacccacctctcttcagcatgggacttatctgtggtcttgtaactagaaattatatggcactacaaaagattaccaactttatttttcccttctctgttaaaagtcatcatttttaagtaattataataaaaatgaaaatgaatgacattttgaaaaacgtcaaaaagcagcacatgttggcaaagatgctgagaaaagggtacagttatacactgttggtgggaaggtaaattaatacaacctctatggaaaatagtatggagatttcccaaatgacttaagatagaagtatcatttggcccagcaatcccacttgtgggtttctactcaaaggaaaagaaatggttctatcaaaaagacacctccactcatatgtttatcactacactattcacaacagcaaagtcatgaaatcaacttaagtgtccatcaacagatgactggatatataaatgtttatatataccatggtttatatatccatggaatacaactcagtagtagtcataaaaaagaatgaaattatgtcttttgcagcaacatgtatgaaactgggtggaggccattatcctaagtgaaataactcagaaagtccaacactgcatgtttttacttataagtgggagctaaacaacaggtgcacattaacatacagggtagaataatagacactggagactataaagtgtcaggaggtggaaggaggaggaaggggcatgaaggatgaaatactacctactggataaaggttccactattcgggtgatgagtacactaaaagccccgacatcaccactatgaatatacccatataacaaaactgaatttgtaacacccataaatttataaacatttttaaataaaaaataaaaagcaaataaaagcaggttttcttaaaacattgtattattttgttcttaaaataattttatttcttaaaacacgtattttgttagtaagtacatacatttgctaacaaaatagtggaagcaaatacaaaatatagcatgtagctgtcagcccagggccctgtaaatggcctgcttgcatcatgtaagttctgaccatatgacaaatggaatggatagaagctagatacatataaaattttctcctttctgcaagttcacagtttcaaagacatttcctaaagtctttccctggtcaaaagcatggaaatttaattatcaattcaagtttgctctgagatcaaatggagacactggggttgtcaatagtcaaattaaatcctaagctaaaatgcccctgaaagtaacagataaggaagaagagagccctgggacagtttttagtcttccatgtcaggatgctgtggggtacgatgacatgttttgtttgattgttgtttagtttgtttatatgctcctttcaggacctttctacacttttaaagagagcatcccagtgaaggatatgacaacttcagactttatttttcttctatttaagaggaaattcacgtaacataaagtgaaccattttaaagtgtactgttctgttcaatgtcatttagtatatttgcatttttgtgaatctatctctagaaatttttcatgttcgcaaactgaaactctgtaaccatgacacgctaattccctatagtcctcttccaagcaccagcaaccactaatctactttctgtctctatgaattgaatccaaatatccatcaaatgaaaaatagataaacataacagaatgcggtctatcatacaatggaatagtatccagccataaaccagcatgcggtactgattgatacatgctacaatgtggatgaaccttgtaaaccttgtaaacattttattaggagaaagaaatgagatatagagtgtatgatttcacttatatgaaatgtaagattatgtgaatacatagagatgggtttttaaaagttactttattttctaccactcaaaaattaccatgtccattccaatattgcaggatatgagatactgaacatgctctaacatggtgatgattacaaatagtcaattaaatcacagataccataatgttttattttactgtgatatagagaatatgaaattgatcatttaaactattttttggtgtataattgagtggccttaagaacagtcacattattgtccaactgtccccaccatctatcttcagaacattttgtacctttccaaactgaaactctatccattaggaaataattttccattctctccgcctctcagccgcacacaaacaccattcaactttttgcctctgtgaatttgacaactctacgtacctcatattggtaaaatcatacagcttttgtccttttgtgactagcatgtagcttatttctcttagaatgatgtcctcaaggtttatttatgttgtagcatgtatcagaatttcctttcttttaagggctgaataatattccatttcagcagtgtgtgtgtgtgtgtgtacacgcataaatatatacatatatatcacttgtttatccattcatccatcaatggatagttggctagttcaaaagttcagtttttagctattgtgaataacatggttaaggactgcgtatacaaatatctcctggaattcctgctttcaattcttttgagtatatacccagaggtagaattggagtatatacccggaggtagaattgttggatcacatatggtagttccatgtttacttttttgaggaacagccaaagagttttccacaatgactgtaccatcttacattcccaccagcaatgtgaaagagttccagtttctccacatctccattacaacttcttattttacgtttactttattaacagccatcctaatggatatgatttccatgatctgaaaacatgatttcttgtgtattattgagaatgtcaacaattgagattttcaatgtactgtcccaggctcctaagactcaacaatgaatgaaacaaacaacaattaatgcccttgaagagctgacatttcggtgggtgggtactgactggaagaaaagcaattgagttgcagtataattgtggccaagatggaacgagtcatagatttgactggaaattggatccacttctgccactgtcaagttttgtgaccctgaccacaagctttcatttcttcatttttcaaatgtggttggttgtccaggcccgtgggaacacgtatgaagacatacaccactttcacaacacagggggcccctgtttcagccagatccaagagaatctgctctctgttcacagaatgaacacatctaaatcataactctctatcctgcatttttcttctgttttgtctcttcttacattttcttttcaggttctatggcgatttgaatttgagactcaattccaaatgtatcccacgtccagttattccaatgtgatggagaatcacaaagtgaagcaagtgggatatactgctaaccatgaataagaggttagaatgtcttgttctgattaagagcagtcaattagggctaatttcctgtaggagtacagataaatatcttgcctataacttgcaggtgagtgactacaaaacttgcatttatctagcaaccttcagtaccattctgctgactgctgacatcaggaaatatccctttgctgcctagttagtgttgttgtcatgaatttgggggtgggagtgggggtgcttcctgcttgtagaccctcacctttagacctcctggatctcccctatgaacctgccatttaaaatgctcaatcagcctccaggactctaacaaagacccttccatctgttataattgatgaatgagtctgtagtttagtgatcctactgccttctgcattaagtatttgaattatactttttggacaatatgaatatctcaaagttctttttattttattattattattattattattattattattttagacgaagtcttgctctgtcgcccagggtggagtgcagtggtacaatctcagctcattacaacctccgcctcccaggctccagcgattcttgggtctcagcctcccaagtagctgggattacatgtttgtgagaccatgcccagctaatttttgtattcatagtagagacggggtattgccatgttggccaggctggtctcaaactcctggtcaagtgatccacctcccatagcctcccaacgtgctgggataacaggcgtgagtcactgtgcccagcctcaaatatctttttctacatcaatttagggattactcattttgaatcacaataatctctatttaccaaacaacaaaaggaagctttcaaatttgaacttcaaataaatgagctcaggataaattacaggcaaacactactaacttcctatcattggtatattcaaaagttaaatgaaaattccactgcaaattaaagaatagtaaatgggactcattaataatatcctagttgtactcttccatccatatcttaaagtgtttaataatctattaatctatacttgcaccagaactattatttcacaatataaagtatctcagagtcaagagactttcctaaatatgataataaaaaagaaagaaatgttggcactatgaaaacctgctgttagtcttacccacaagatcctttatatttaaaccaataagcttgccaacctgtggcaaatgagagcattcatgctggccaaaagtaaagcaagcgtatttccattcaaatgaatgaatctctaccaatacccaacatctcaaattcagaaatatatatatatatatatatatgtatacacacatacatatctacttctacagcaggaatttctggcatgatcctagtaaaatttttaaaagtctaaagaacttctttataatggccatttttattttcaccggccaaacactctgctggagatgcaataagatgataccatctgaaagaaaaatatctctccaccgatcagtgaattaagatctcatgaggtttaggtatcgtttttctccatctaggtcctataatccatggcctaaaattggctttcaccagaatataggtcctaccaccgccaggggtcaaggcagcatctgtgaatcagacaccattaacaccatcttctggagaacacctgacttgtttgaacgttatgtaatcgttactcacctgtctttaaaaccaggaaaggatgttacacgatctcttcatggtaccgtggggtgaggaaaaagtaaagataaaaaataacaccatctcacaaatcttgggttctggtaaatcagatatgttctaaagagaaggctatgaaacagttgagtttgaaaaaaaaaatgaggcattacaaggccattgatttcattaaaagtccatgagtcgttttaaaacttgagatatatttgaataagacccttttttaaaacctgcattaatctttgattttaatttttaggaacctccattttcacatggcacatgcccaaattgcaattccaaggcagagcattaatgagcatttgtaatcagatttaatcacagagggaaaagacagaaagaatatccaaggtaaaaggttttgctttatatttatagcctgtaatttaagaaggaagtgtgaaatatagctttgcgtattgctggagcaaaagcacaagttttgtggccaacggggaaaaacgcttttactccttgtcaaactgatggagaagttttaaaggctcaggaaataaactttcagatactgcatgactacattatttggaagcaaagaggatgcaagaaggagatgaagaatcccagattgtccttagatcttcttgccagagtgtggcctagtaaggagaaagccaggtggcatcctgaatacattggttgtacacacatgtgtagtgtaaatatctgaaacacctatattcatacatatatattgcaataatgatgtgttgggtggagtgggttgcgtaatatcctccaaaaatacatgtccacctggaaactcagaatgtgaccctatttgaaaatagggtctttgcagatataattagttaaggatctgcagataaaattatcctgaattgagggtataaccctaaatccaatgactggtatctttataagaaaaggagacgacacatacaatagagggaagacagccttgggaagatagagacaaacaccgaggccaccagagctgaaaaggcaaggaaggatctttttctggaaccacccagggaaaggcagccctgccaacacgtttattttgaacatctggtttcccaaactatgagaaagagtaaatttctctcttttaaagccatcacatttgtggtcatttgttatggccgctctagaaaactaatacatggagattacaggatcatttagaaaatgtgccagccaattgcaaaattcagcagaactcttagaaaaccatggtttatggtcttttcataatgagacatttaaaatacccatggaaagacctaaagaaaaaaaaattctaccgtagagctctactgttttgcttttataattctcaaaatctgttaaaaatataaagatatgtagatttttctaaactacaggtttcaattcaagatcaaatgcatgccacaaatataaaatatctccattccagctaacctatgtgtaatgaattatgatacaggtatacatagatatttcggggaacatggaatctccagtgtttgtgaaaaagaaacagctgctgagtgtaaacagtggaaataaacacggtttacatgaaactgggcattcactgattttgagaatcagttcactcaaactaaaaaaaaaaaaaaatgagtaaatagattcactccttttttaattagcttgcattttgcaatttggagtcaaaaaccctgcaacggctaatcattcagaaactgcttattgtccggtagacactagggagagagaggtagtatgagctatgaccacagccgtcaaggacctcagaaactggtgtcaggaagcacacctataatcccagcattttgggaggctgaggccggtggatcacttgagcctaggggttcacgaccagcctgggcaacatggtgaaaccccctctgtaaacaaatataaaacttagctgggcgtggtggtgcatgtctgtagtcccagcttctcaggagggtgagataggaggatcaattgacccaagaggctgggacttcagtgagctatgattatgacactgcactccaacctatctgagagagcaaaacctcatctctaaaataaaataagaataaatcaattttaaaaagtgaacatcctggccaggcacggtgactcacgcctgtaatcccagcactttaagaggccaaggagagcggatcacgaggtcaggagatcaacaccatcctggccaacatggtgaaaacccgtctctagtaaaatacaaaaaaattagccaggcatggtggtgcgggcctgtagtcccagctactcgggaggctgaggcaagggaatcacttgaacccgggagggggaggttgcagtgagctgagatcgcgccattgcactccagcctggcaacagagcaagactccatctcagagagagaaaaaaaaaaaaaagtgaggatcttaagatgagaacttaacccggttcatctggatgaatctaggtaatcataatgttttttgtttgtttgttttttaaaatggaaggttagaaacagagaatgagatctaagatatgtagccagtcttcaaaagaagacaaacagacaaaccaaggaaatggattctctctttgaatgtgaacacatttgggacttttagcacccagaactgtgagataataaatctgcattgcttttaattccctagagttaacattagagttataacaagttgtgataccttgttttagcagcaataggaaagaaacaaatatagataccaagtaaggaatgtttttcgtgaaggagagagtcatcgagaactctaaatgttctggaaaatcaaaatcaaaattcaaaattttccagaaaatcgaaccctgagagtgcagagtggaaggcattaatggaactgataagtagtttcatggagtagaagagctaaattctgatcgaaatgccttttatttcttgggtggattatgcaacaaccttctaacctaatgcccctttacatagacagccatttcctttctcactaagaacaatacactagtcctttaaaggcatataaaatgtggctcatgctgacatctctgaaatcaggtgctactatccccttcaccactactttccagctgcactgatattctcagggactctgtggccacagggcctttgcactggatctttccttagcccaagatgctgttcctccaggtaactgtatggatcactccctcacatcagttttgccttatctgtgaaactttccataaccaccttagtcaaaattttggcacaaaatttctaatttagcacccttctctactaaatatttctccatagcacttgtgatatcatattctactgtgtattttacgatacttgtctgtcgttgttttttcccctactggatagaaatgctgtaggattggggattttttctctgttttgtttgctactccattttcaatggaagttgttataccatgtgtcaaacagcaggttgtcaatatctgtttcttgaatgaaagaagaatgaatgaatgaaaaccactactacatcttccttggcaaagctagttttgtatatatagaaaaaacattttaacttcacttaaactagaaactctatctcactctctctctctctgtctccctctctttctcttattattactagtatttttttaaatccagggctcattacaaaaccttgtaaggaacggagggatgccttgtccattttctattgacagttataaagagttatatgcctcatagtcaatgaataaatttgcactgcactttggtcaatgatgccttcccccaatagactgatcaagtcctgccttactcagcatttacattcctgagtcagcaattgacagaatcaaatccccagtcatggtgaactgattgaaacgaacccttcttcacagacacattgatggcactctatcctaataccctttatctgtcccggcatccttatattgtctccatacaatgatgagacagccacaagggacgggatagcagtggactgtcacgataaccatgggacttgtgagatatagtaagtggacaagcctgcttaaacatatatgagtcaatattcagagtcattggtcaatgaggctgaagattatgttttcagaaacatgagtaataagaatgtgccatcaagaaagtggaggtggaagacacagaatgggagtgtttgtgaatcccacatgtggtaaggaacatgtatccacattatactacttaaaagtacccctcctaaacctcagtaatgaaaagataatccaattaaaataggcaaaggatctgaatagatatttttccaaaggatttacacacatgtccaataagcacatgaataggtgttcaacatcattagtcatcaggaaaaatgcattctcattctctgccaccttgcatccaatccatcagcaaatcctgttgcatctgtaagacacgcagaacaacctcttcttttttattttctttgcattctcactggtactgccctggtttaagctggtatcatttcttgagtagattacctcttgcctactttttggggatgtaggagagaagagatacgggacttctttttggaatgatgtaaatattcaaaaataaacccccaaacatgatatcactttacacccattaggatggctataattaaaaagacagatgagaacaagtgtgagtgaggatgtggagaagttaaaacttttgtgcattgatggtgaaaatgtaaaatggtacacctattttggaaaataatttgaaagattctcaaatatttaaacacagagttcatgatatgacctatcgattcggctcctatatccccaatcaagaaaaatgaaatatatgtccatacaaaaacttgcacatgaacgttcatggcacaattattgagaacagccagaaactggaaatgatcccaatgtctagcaacagatggatggataaacaaagtgtggtatatccataaaatgaaatattaccgaaccataaaaaataaaagagtagagatgcatgctacaacatggatgagcctcaaaaacattaagggaatgaagtcagacacacaaaaaagcatgtattatatgatttaatttacatgaaatgcccccaaaaggcaaatctatatagacaggtagatagttagtggaagcctatctcctggggacctgggagagaagaggtatgggatttctctttggaatgacgtcaatgttcaaaaattagatggtgttgctggtgtcacaatgttgtgcatatactaaaggccattgaattgcacacttcaaacgtgcacgctggatgtaagttgtttcaaataaaggaaggagacaatgaaaaataggagttggagataagctcaacgggtcacttacatggtaaggatcacaagaagattaagaaacatgaagatgtatcaaaagccattaaaagtatcagaagtgccagagaaaatgcttatgacatttctgtggccctcaagagaatagttctgatgaaatatgattgaaaagaagaaagctactcatttctttcaagatgagaaatgctaagcatgttttaaacaaagaggaatgaagaaggatgaatgctattcctaagtaatcttgtaagttcatgcttagaaggaaaaattaaacagcaatgaaggaaaaagatacctagaggttcgcaatatattgaacacaggcattttggtggggtagcctccatgtgttcaaaagcacaggatggatttataataatgtgtttattctacccacctgtttaagactatagccaaattattacacagacattcccggacttacaatggtttgatttatgatttttgatcttaagatgatacaaaaatgatattcagtcagtagaaatcatattttgaattttgatatattcccaagctagcaatatgcagtaccatagtctctttggatgccaggcagcggtctgtagctcccagtcagccacacaatcacaagggcaaacaactgctactctgcagtgtacatgaaacattcaacactttatttataaaataggatttgtgttagatgatgtcacccaactgtaggctaatgtaagtgttataagtatgttcaatgtcagccaagctaagctatgatgtttggtaggttagatgtattgatgcattttcaactaatgacatcttacatttacaacgggtttattgggatataatcccactgtgaatcaaggaacatattttatatatgtatacatacacattagcatgtatacatatatagacacatatatatacacacatatagatctgtgtgtgcatcacaagggcaaacaactgatacatgtatatgtatacacacatatgtatgtatgtacacatatatgtatgtatacacacatagattatacacacccatatgcacccacacccacatatatacacatatatgcgctatatatgtgtatatatatgtttaccaccaagtatctaagaccaactgggacatctaaacagatactggaatattttagtaaagaggcagacactactttaaaccttaccaaatatttcttaaaacaaacaggaaatagtttatcattccaaaatgttctcccaacaccagtgcaaagcttagttttcttgtgtacaaatcgtagtgtttctctgtgagatcatgttatgcctgtctacactgaaatgatgtttttttgttgttctttttaatgtttaaagatgggttctcactatgttgcccaggctgctcttgaactcctaagctccaaagatcgtcagcctcgcgagtagctgagactacaggcatgcaacactgcacccagtgctgaaatgcttatcattatgtgtttatcatacctgcctgtttatgatttacaatgatgtgttgattttacccatctgtttatgactacagccctataactggacacagccttctctctataacatctgagcctctaataaatgccactatacttaacacagtgaaaatcagtgcatacaatctcaaataattaaccgaatcaacacagactttctagtgacttatcttcataaaggccctagctcattgaagcaatgttgcgttgagcattctaaaatattcctgactttttacactgaaaattaaacacttcattcaaaaaagcgattattattatttttagtccaaggataaagtatcttaagaatatggctggacgtgccaatcaatatgttacaattttatttgaaacatatatttatatcgctaaatgcagggtgtacctgccataatttggttataatttagtccctaggaaatttactttgcacctgtatgtttcatcccctagggttcatttccataaagctaatgacttattaacgttggaatggacaaaaataagacaattatactagaacacaacacatctgtctttgtatcactgctgtcatgcatgtacatatgtgcatattcatgcttcttgtagaattgcctgtgctattacaggcgggtaggcaaatgtcaggggaaaaaaagctgcaggccagaatatgtgtagtagtcttacatttttttaaactttatgggtacatagtaagtgtatacatttgtggggtacttgagatgttttggtacaggcatgcactgcataataatcacgtagtctttaaacatcccgctcagattgccttttagagatttttccattatcctactcgaaaggactaatttccttgaatatatgtagatactgacagaattatcaccagaaccctaattccaatgtacttgaatttggctctcaatttcaatgcttctccctggaactttccatcatcccttgggatactcatcatactcttattttcatttaaagcacaacttatgtccttctgtccccaaggagaaagagggcacgtcaacctcatcaactaaaaatcatcaacctttcacatactggatgagaagcaaaatgaagaaaacaggctgaagagagaaagggatggtgtcttttagaattaataatcttaagagactgttttgaatgtaaaactttcaaagacagaacatttttaaggcatattctctgtgactactaactcatgcttaaatgacattatataatcaattaactgggaattatatattgatggaatagattcttctgtgatttctgtttgaatattttgatttctaaatatggttatgcatgtaaaaataaaatttcagcttctttaaagaaatcctgaatcgtttataaatagatcaaggagagtctccatagcatgacagatgccagatgataattttgtgtatttgggattggaaaaaagaagtctttgaagagaaatctgcactcccatgttcattgcagcactaatcacaacagctgaaatatggaatcaacctgaatgtccatcattagatgaatgaataaagaaaatggggtttatacacacaagggactattattctacctcaaaaaaaaggaaagaagttgtgtcatttgggactacatggatgaaccagaggacattatgttaagtgatacaagccagacacagaaagacaaatatcacatgttcttacttatatgtggaatctaaaaaaaagtcaagcttacagaagcagagagtagaatgttctcttacagaacttgaagctggaggtggagaggaaacgggagatgttggccaaaggttacaaagtttcagttggcaggaaaaagttcaaaagatctgttcaatatggcaaacaaagttgaatcacaaggaattgaatatttgaacatctctaagaaagtagattttaagtgtttgcaccagaaaaataagcatttgaagtaatgcacttgtgaattagctcgatttagccatttctcaatggatacatatttcaaaacatcactttgtacatgatcaatatattcaatttttatttgatgattaaatgaatacattagggaaaaaagcacaaaataaaaaaaattcttttctaccttgtctccactccctcccttgattttcttttgagtcttttttaaaaatttgagacaggatttcactctgttgctgagactggagtgcaatcacagcacactgcagcctcgaactcctaggctcaagcaatcctcctgcctcagcttttcaagtagctgagacaccaggcatacatcaccacatctggctaattttttctttttccttccttcttttctctctctctctctctctctctctctctctctctctctctctctccctccctccctccctccctccctccctccctctctctctctctccccctctccctctctctttctttctttctttctgagacagggtctcactaggttgtccaggctgatctggaactcctggcctcaaggaatcctcccaccttggcctcccacagtgctgggattacaggtgagagccactgcacctagccttcccctgattttccttgcccaataaataccgttccatctgatgtctcgcttgttgttgagtcagctgaggacgagggagcctctttgctctgctgttcccatcaactattacatcaatggcaccttcctggtgagagagtccttatcccactgcagtcgtccccatctctgctccatttgcctctcaggtcctaatgacaaagcactcatccttaatttcccctgaccttcttcacatcctgaataaatccaatgaatgcagtgggcattttgagccactaggaggcagaagaggaaagtccaagcaaacgatcattctgagagcaaaaaacatgatcctggttttgtttgccccaccaaagacctgtccacacctatcaatctgcagccacaacaaccatgggattacagtgtttccaagtgtgtattcaatgcatggaaacctcattataaagaagatgatgatgaaaaacaagacattgtgttgtgtttttttgtttgtttttttttttgttttgcaaagtgtcttggtttttctttatctgataatttctggattagaggttgccctatcttctgcaatgtgttcactctattgctgtgttatctactgcatggacccctgccaactccccaggctggctttaccgataacatctgccacccagcccacaaagaatcttattctaaaggctcccattcttccttccaccttttgctacttcctgggtttgagtgctcacacaccattcatcttgtctcaggatttcactttctcacccttctctcatgcttcttttacgtctctacttttgtttatgtatttctcactaagtacaatgcttaactttcctttctcctcatttaactttttgcagtgttttgttttagtaacgcctgggtcctgttttagacagagagaggcaattcttccagtcaaagtaggccatttacagaaatcaaatcgggggaatctgagacattttggttagaggaagagaagagagggattctaatgaaaccaggagactggcatcaaggtgtgttgattctcgaaaaaggaaatgatgctttcttttttaatatatacgcttatgaacttttgacttgatacataagatgtgttccatttatcatttcaaataaaatccttcataaagcattaaagaaaagaaatattgttagaaaaaaagaaataaaatagcaaatgtaccaaaaatagagcaactcctctaacttccaaaggggagaagaacatacaggtcatttataagatagcttgacatttttcagcaggtgtgcttcagggaaattatagtgacccattgaactcccactaatgtcagatgcatgtcacataaatgcacacccatggaattgaggctgtaactcttgggaagaacgtattggtcctctcttctaatgatttccaggcttcttttgttgagtggaatattacatggctcacacatatcacaaaagcataaaggtgagaccactctggccgatgttgcaagaatgcttcagagctcagcccaccctccctcaatttcagaggaaaaccctacaagggacaccagaacagggaaagtgaccacattattaggctgagcacgtgcatatgggttaagtcacccaaattatgactacaaatgctgtttctgctatgcatgttggttgcttttatatcaaaccatttctgtcttatattcaattatgactccaaagcgtctaataggtttattcaatgaatggtcttaaagagaaagacaacttcagaagaccatgacgcaatctaccctcagatgaaaattttcaggatagctataatatgtgaaagattgtaagaaatgcaccgaaatgatcatttgactcaatttatgcacacgacacagcaagccagcaatgacatgggaactgggggtaggacaccaaatttcctgatgaaacactagttctactgcaccgaagagctttgatgtgacaaatgccattgttgtggttaatgccaccatcaccgtgaaccaaagcaaaccagtatcgattgaatggaaatgaatcagccttcaaggacccactttgaggaacttaaaaatacactgtaagcatcttatcacaattgtgtatcttgatcagcagtaagaacttttttgcataatgataaaagctacatctgatgctaaagtgatactcaatttcttcactcattccatggtttactaattcatacttgacattaattaagaaggctgtggatgagttctgagtggtaagtcagagctctggcttcagttacacccgggtttcagtccctgctctgactgctagaaggtgtgatgccatgagtaaatcccattacctcaaagcattcatctcctcataggtaggacataaggttaactcttccaagggagtttacgaagattaaatgaagtaatatctgccagccacatagaggcacacaatgagttgatgttacatagttgggactcttttgaagcaacaattaatttcagcatacatgaagcatgaagtcataggatcaccaaaaaggtgatagtaccatgtgagctaaacggaaatacatatttaaatggaggtagatgaaatccactgcaggtacagacagacttgcacttggagacaactggaaaggggaaggaataaataagttccaggtatttccatcaaaaagcatgagcaagatgcattctcttttacatcgaaggtctttggactatcatgaacaacaacaacaaaaaaaaaacagattggggagaactcaagttatactaaagtaaggaactaagatggagaaaagagtatttattgattcagtaatggccttacagggattcagatttatcagattatcctctgcagtttctgtctggaggtgattgttctgaaagtttattacctggattaatgtctaatcttcttaggggtaaatgatacgtatggatgttgtgaggtgaatgggtgatagggcataggtactcaagtgggtaggtgagaccaggcaaatgccctggcacgtacagctcagcaaggattttgctggcttctggcttctgagcagataggaacaccacacaccctggcaatgactaatctgagaggcattggtgaacttgaggttttccaaattcttgaatatatatgtcagagacgtttgaaccagagcacctccatcttgaataagggctgggtaacgtaaggctgggacctactgggctgcattcccaagaagttaggcattcttagccacaggatgagacaggaggtcagcacaagatacaggccacaaagaccttgctgataaaaggatgcagtaaaaaaaaacagccgaaacccaccaaaaccaagatggcaactagagtgatgtctggtcatcctcactactcattatacgctaattatacactaattacaatgcattagcatgctaaaagacccttccacaagcaccatgacagcttacaaatgccatgacaatgtcaggaagttaccctatatggtctaaaaaggggaggaacccttagttccaataattgccacccctttcccggaaatctcatgaataaccaaccccttgcttagcatataatcaagaaataatcataaaaatagccaactagcagccctcgggctgctctgcttatggagcagtcattctttattcctttactttcctaataaacttactttcactttacggatttgcctccaattccttcttgcacgagaatcaagaaccctctcttagggtctggattaggatccctttctggtaacatatacaccttcctagtgacaagggtgtatagcagaacacataggaaatctgtttatagaagtgcagcttctttaaaaacaaactgaacaccaattcaatcagaagacacttcatgtagatataaataattactttatagctataatgatacatctcaatttgcctgggacaatcccagtttattcatagcacatgagcaactctcaaacatgtcctggattggatcataaattatatggccaatggctagcaagattgtgtagcacagttctgattattttttaaaaaatagcaaacatgatgatcttctgatttatttaatgtctacaagtgtcttgtaatgttattttaaattaacatggttcagtctggatgccaatatttgatagatattagttagccattacaggttgggtcagctacaattcttactgtggataaacagtagtattaatacaatgcataatggtattaataacactagaaattgtagtgtgactgggtataatggttgctgctgagagcctatgaaacttcatctacatgagtccattaaatcttttttaaaaggttattttttggccaggcacagtagctcatgctgataatcccagcactttgggaggccaaggcaggtggatctcctgaggtcaggagtttgagaccagcctggccaaaatggcaaaaccccgtctctactaaaaatacaaaaattagcggggcgtggtggcaggcgcctgtaatcccagctactgcggaggctgaggcaggagaagcgcttggacccgggaggcagaggttgcagtgagccgagatcatgccactgccctccagcctgggcaataaaagcgagactccatctcaaaaaaaaaaaaaaagaaaagaaaaaagttatttttttattgacaagcagattatatattaatgaggtaaagtgtggtattttgaaccatggaacttttatactgtacaacaaccttgcaagggagagaccactgccttctacatctaaggaaagagtctgaggaaacgctagctgactttctcaaggcagaggtagaggaaagttgttagctcctgtctgtctctggctgcgatctacattctttccaatgccagcattccgcttccattatgggcatgtttcatctttttaatcctctcttttgggtaacagagaatagcatttgttactccattaaaaaaaaaaaatcttaaaacaatatttttccattcctcaggtaggaagataacatttatgcatttatgacttttactggaagaaaaagaactcaaagaatatttcaactttttgcctaaaattgtatctacttgtatgaaatgcactcactgaaatgatcattgcagtgcctgctgtgtattttatttgatcatctttttaaatatctggatgccaaaggtttaaaaacattttttcaagaccgataataggagtttcctgcaagcaaaaagtaaatgccgcctagctgttttcaagaggacaatagtaaatgcaagatccatgataaaaaccaacgcagtcacattttaaagtctctatcgtcctgtaaaatcggcaaacttggcacatttcattccatcaaatgaaagggggtctgtagtgtgcttggctgttccacactagctcattggaggaatgtaaatagaccggcatagagatgctaaatcgcttcttttatttcttccccaccaattttacagctctctgttatcttatgacttttaaaaactctccataacaaaaagtagacttaacaatttttcaattagtttttttttcctctaaaaaaagtgtgtatactttccaggctaatttgcaagatgtgcaattgattcacgaagggacaaaactgataaaaaaaaaatcatagtgtagagttgcttgatacaactgagctttagggggaaaaggagatcaatttattttgaaactctatcttatcagacacatcaattcatcacgcatgcaacagaatattgtgtggttccagcaaagcaagaattttcttgatgcccactgcttccctcagaaaagcatgcccaagctttcttccgtgtggccgtgctacaggcagtgcacacactgctccctttgaagagggcctgtgcaatgccctcacacatactttcctccttccacctctttgtcagaatgaaccttttgtaaaacatcaagaagcacaatttcctgtttccaacactagtagccaaagcaactatccagcgcctctgaaaactattcagtgaagcgtgcaattactgctatgcaaaagttcagagacattattccgccaagatgtggctcacagaaaactacaaaaaatataggaaataaagccaacgacataataagttttttgacactaaaaggttttttggtggtgtttattttctttaatgcagaaaccaacctggaattttgagttctttatcaatgtttcaaaagatacaactttagcaacacctgtgactgatttgcatttcaaagtaagaaatgcatttctcttagggtttcttacaacacctcttagggtttctcagcaattcaccaccttttagggcttcttacaggttaatgttttcacataggaaaaaaaaaaacccactcaaaatgaaatgaagtcatctgattgaaaagaaaatattcttggccatatttgaagaaaacattttcagtcatatttcttgtttgacagacctcctttagtccatcttattttgctttttattttaattaatttattactagtattattattatttttttttttttgagaaaagtctcactcggtcacccaggctggagtgcaatggcgctatctctgctcattgcaacctcgacctactgggttccagagattctcccgcctcagcctcctgagtagctgggattacaggcgcctgccatcaggcccagttaatttttgtatttttagtagagacagggtttcaccactttggtcaggctgttttctaattcctgacctcaagtgatctgcctgcctgggcctcccaaagtgctgggattataggcgagagccaccacacctggccttcattttgttttgtatttcatattgtatcataatcacactggaaccaatatacacatctctctcatggctaacttgttaaaaactttatcttctataccattttaatgcatttttgcctggaaaacaaatgtttttacataggtcttaggaatattattcacaaactaaccaacaccaggaaaggccatctcagaaggtactgaaatctgactctgaagatgtataattttccaacctacaattagaagaagatgaatgatggccgggcgtagtggctcacacctgtaatcccagcactttggaaggccgaggcaggcggatcacgaggtcaggagttcgagaccagcctggtcaatatggtgaaaccctgtctctattaaaaacacaaaaattagctgagtgtggtggcatgcgcctgtagtcccagctacttgggaggctgaggcagaagaatcacttgaacccgggaggcagaggttgtagtgagccaagatcgcaccactgcactccagcctgggcgacagagtgagattccatctcaaagaaaaaaaaaaaaaagaaagaaagaaaagaaatgaaacatcaaaacaaggaggaactaaacttgaatttccatgtatttagcctttaatcgtagatcatcaatggacaaaagtcaactaacagctaagtttccctgcatgcaaatgcaatggaaccaaaacaacagatcttccaaaggctcaacataatcagttagagaattggataaaatcttttcctccacacaatatactgattcatacaatgacacaatcagaaaagaaagctaagatctatggccattcccaactataatatcaccaaatatgtgttcattgtacaggtctatgtagacaaacatacattcattgaactccaagggagaaacatgctataaataaaatttcatttcatctttaagatcttaaagtctgcattggtttgagaagggattcatgaccatgttgcacaaaggtagtaaaaggaataaacatatccaatcacataaagtaaataccgtgaagtggaattaaccaggaactggaataacaggattcaaatccacgagccccgtcaaaacgagaagtggacttttcatgtttcctcttgctcagtcattcacatgatgaaatcacttacctagtattcccagacggtagttaatggtgatcacgatgacgtttccgtagcttgccaaaatgctgccgtcaatcatgttgccggtgccctccatgtaagatcccccatggatatagaccatgacgggcttcttactgttctgatcatgaatatctggaaaaaaaagccaagtaaggaaacacaataaagaatcacactgactcaccaatgctaaattaagaaaaaaggagattcactgatttccctattttgacttgaattaagcacatttatttttatggatgatatgacccttgataagagtgtctaaggaaaatgatcaatgctattacgttttctatttatggaaatggtattttaagaagcatacagacatttagcgtactctgctcatctaagcttctatatatatctaaagcactaaaagaaatggttttaggtaaagtacacatttcctaaattttgctcaaaccctaaaatgtgatttaaattgaataaacacatgggacccttgatgaaatatattttatcttctaattaagtataaaatcaacttcaaaattataattaattttaatatagttgcatcttaattcgcaggtgagtgtacagattcatcttcaatttaacaataaaaacataaaagtagtagtgaagctataaactatcaataagggacagataatgacaagaaagcaaaatcaacagttaaaaattattaactgaacagaaatagggaaaaaaaagaaaagatgtccaagcaaatgtctttgttccagtgattacagtaacatactaacatacttaggtgacaaaaataaaagagatgtaataaaaaatggcaaaagaatccaaactatttaaatgctttatattttcacagggaatataaactcccattgtgacttgcaaccaatgattcctcttggtaatttactttattatttaaattaacaatgatgtaaaaacaatgatctgtgatgatagaaagttggagaccatctgtagggcctgctttgtgaaaaagacctgttttataacattaatcagccattagggctgcatttaatctttggaagactgacctcacgtataaatatttctggatacagatatgtgtgtgtgtgtgtgtgtgtgtgtgtgtacaatttaaatatctttgtaactaaaagaaaactcaagtatttatgcatatttattttcaatttcttcatcaataaagtttttttttcctcataatccacagggacacttttgaaataccacaaaggaattctgaggatatgaattaccatcgtttggatggtggctccaatttgaatgaattatgatcacaattttactgggtgcatacagaagacacgacatacccattggtcacagtaaagcacacaaaagagtgtcaagttacccaagtatttatttgcagatatttaatccacggcagaaaagtgtcttttgttttctcatataaaattcaaatatgaagtaaaaatcttctattaatcatttattcatcatacactacgggaaatgtcttctgctatatgaataagaaatggcttttctcatgatccactgcttctttctggttcctaatttgctgtttttggcctcatttcttttaccattaccagcggttgcctagtaaattgtggaaaaaagagtaagtagagattttgaagggctgctttaaagtgctcccttggaaaatatgtgagattaacatctcttacctttcataaaatatagaacaagactctcttgaacttgtggaagtaataaccagctgttatattaatgcaaagtcaaaaaatcataacttaacaatatgaaatgaaaattagatggcattttaatggtaataaagattcactgggaacactgtgaaaacagattctaattatcgagaggaaatgtattaaaaagagaaggccaaacaggatacaaattagagcagtataagatatgagacaaaagtttatttcatttttatgtatttgctcaatactgataaaatgtcaggcattcagaagcccttatcaaagaaggggctacctgaagcaggtgtagattttgatctcctatggccatcagaatggagatctctcagagagctacttgagacagtgacagctctatgagctcagtaaaagtaacaatactcaaaatgttaagggaagactgggcacagcaagggtgttggcaagatttcttttcttggagaacagttgatttatgaagataagcaaggaggggagcaactacaagaattggtcaaaagaccctgtcatggacgttgggcttgaccagcaaggataattcaggactcacttttgggctttaaattgcctttcagacagagacccaaaggtccagccaggaccttaatggagttccatgcattttgctacccagatgggaaaaatgtgcttttagctaatcctatagagccttaccaatgaagaagggcttgcttgagtactttttttgttgcttctcctctttaaaaaaaaaaaaaatcatttcttgtgcagaaagggcagaaaaacagcatgcgagttgtctgcatgagtacctcagacctaccatcttttaaaaaaaaatcctttcacttctggtagacaatgtgttgagcaatttggtagccttaagaagaaacttcacagcaacaaaacattttaaggagaaaaacgttttcaaaaaagccgtggtgtgaaaagaaagatgaacatagctagctttttgtcctttttcagttctgagatactcttatcttccccacccccccttaaatgctgtaaaaggcagtcctgaatgcatcagggctcgttaacaacagcatctcattaaaacactttttggtgtacttcactgtgagcagattatcagaaatctatgttggaatcaatatgtttgtgaagaaaaaaaaaactgatatttcagcccccccccccccaaaaaaaattcttctaaggtgctgtacagttttgtagttcataaaaataattaagaagaccaaagctccaaagtagtatattaacttacaaaataacatttggaagggagaaaatagactatacatgcatgttttaaaattccattttctcttcttgcgaccaagccaaaaaaaaaaaaaaaagggcttctctgtaaacagtagttcattactcttttcatgtttagaaacaatgtttatacttctcacagtgatttgtttcctgtacatggtaactgggattaaaaaatgacagtggtttctatacaagaagaaaataattaaggaagcacaccaaagtgtactagttttaaataaggggagaaaaaacagattgaaatgaaaaaaaaaaagagagatagatagatataaaatcatgcactggggttgagctttgaaaaaacaaaaaataccttcgtcttcaccacggtcattactcgttatatcatctgcgtttttctttgtgttggctcctggggtcatattgagaaggaaaataaagggaaaaaagagaattcaaaaacaacaggttttcaaaaaattcagaaaagagagagatgctacccagaaaaagaaaaaaagaaaagaatgtaacacaaaaagttgaaatttgttacatttggatttcaaaaaaatgagatagggaaatgcaaaatgcatataaacataaagatgtcaagaagaacaaattcaaaatgttacttgcaaaaaatattagatatcctgtgaatatgcagttgggggttaaaatgatgctactgcaaaaaaaaaaatgctaacgtgagttgttttaaaaaaagaaaaaattaaattattagaaaagacatttcccacattctttaaagaaatgcttatggcgtattcaatggtcctctgatgttaacatgttgtaatttaaataaatttttgaaatgttactgacacattatggttagaaattttcataaggcaagcaaaaacacagtaaacatggaaggactttattcaaaatattatataattgacattaatttcatgcattaaaaacttataaacatgcaatctcaaaaagtcagaattgtgactaatttaaatcactaagatttacctctactctgtgtttagagaagcactacccactattcactcttgttttcttctattaaaatctactacatgcaataaatatttaagtcaggacaaaacattatagaccatgtcctatgtgtttaaaatagttattaaatatcatttgaaagttatgccctctgtgtgtaaaatagctattaaatatcgtttgaagatcatgtcctctgtgtttaaaatagttactaaatatcatttgaaagttattggtacgtgaatttgttgaagaaaataaaaatcgaagtcatctaccttgatcacctcaataagatctgcataggaattttaatataggcaaaatgcaggaagaggcccttaaggatagcaaaaaactagcttatgctcttagtgcacagagcaccattttggtttttatagtttccacatttaaaaggtgtgaacatttaattttgcttgaattaattaattggctccattgcttccttctcatagacagatgcagcccatatgtgcatatcccactatcaataactttaactgcgtcaatcaatcaagacagtctttgccttcctatagggttctaggataagcggattaaggcaaagggaaaatactgtcatctccaacacttgtgaatggaaaacactcctctgttctacataactcagaagagcttaaacatattttgaaaccaagacttgataatgctgtttccatatatcaaacaaaagtcaagtaatgtccatttcatgggggcttaataccttttaaaaccagacctgggtggtgcgtgggtgtgatagccttgctgatccactttctgtctttataagatttgccttctctaggcatttcatataaatgaactcatataatatgcggtattttgtgtctggtttcttttacttagcatatgttttcaatgtcctttcatactgtagcatgcatcaatacttcattcctttttatggctaaattattttccattgtatgggtataccacatcttttaaatccatttatttgttgagtgacatttggtttatttctacttgttgattattattaataaagctgctatgaacatttgtgtactattttttgcatggatatatgttttcatctctattgcatagatacctaggggtgaaattgctgtttcataaggcaaatttatgcttaatgttttaataaactgacagactattttccaaatcagctgcaatacctggcattctcaccaacggtggtataaagggtctctatttctctaatacctagccaacacttgctaatatccttttttgttataaccatactaatggatgtgaaatggtgtctcatcataggttttttttttttttttttcaaagtcttgctctgttgcccaggctagagtgcagtggtacgatctcggctcacgacaacctccacctcctgggtttaagcaattctcgtgcctcagcctctcaagtggctgggactacaggcatgcaccactattcctgtttaatttttgtatttttagtagacatgggtcttgccctgttggccaggttggtcttgaactcctgcctcaagcgatccactcatcttggcctcctaaagtgctgggattacaagcatgagccactgcacctggcctcattgtagttttcatttgcatttagctaatgtttagtaactaatgatattaaatatcttctcatgtacactgtctttgcagaaatgtctattaatttatttttgcccattaaaaaataatttctttccttcttattattgaatagtaagtggtttgtttacatattttctaaataaaagtcttttattgggaatatggttggcaaatctcctctcccagtttatggcttgtcttttggttttctcaacaaatagcactttatgttctcaatagtgccttttgaagtgtaaaagtttttaattttgatgagtttcacttgatcaattcttttaaggattgtacttttgaggtcatatttatgaaatctttcccaatccatggccctgaagaccttctcctgtgttgctgaagtttcctaaaagtttaagagctttaattcttatattgccacctgtcgttcgagttaatttttgggtacaataagaggtaagagttgaaattgatctttttacatatgaatatccaattgtctcagcaccatttattgaaaagactatccttgcctcctttaattgttttggcaccattgttaaaaatctattgactacaaattgaaggatttatttctaaacccttataattgacgcttgaacaacacagttctgaactgtgcagatccacttatatgtggattttcttctgcctctgccacccctgagactgcaagaccaacctctcctctccctcgtcctcctcagcctattcaacctgaagatgaggatgaagatctttaagaagatccacttctatttaatgagtggtaaatatatgttctcttccttatgattttcttaatggtattttcttttctctaacttagtttattgtgagaatacagtgcattgtatatataacatacaaaagatgtgataattagctgtttatgttattggtaaggcttccagtcaacagtagactattggttgttaagtgttgggggggtaaaaagttttaagtgaattttcgactgtgcaggggttctaaccttcacgttgttcaagggccaactgtaattaattatatttcattggtctaaatttatacccatgtgagttgcctgctatcttgattactatatctttatagtaccttttaaaatagagaaatggaagccctccaactttcttccccttttccaaggtctttttgattgctctagatcctttgcctttccatgaaactttccaaatcagcttgttagttgcaataaaaactcctgctgagatttcgatagaaattacttgccaaatcccaattttaaattaatcttgtatatcagagcctgacccagaaacataattagatgctgtctttcctgttctacgtatatttaatttgtttatcctttcattcttttttaataaactgctgctctatttgtccatgtaaatataactaattaaatgcctttaaaacaaaccaagttctcttgagtatctagtttagacacaaccatggactatgtaaatgcaggttttagaagattcaggaaaaacaatttgtctacagtttattcaagaataaacccagcttgtggctggcgcacacacacacacacacacacacacacacacacagcccaaataaaacctaggtaggctgtgagtttcctttatcttctctatgtctacccttcctcaaaattccagaataatattccttttcatacaacaattagcatctccgtaaaacctctgtgcagaactggctttaaatattaaagagaagatttaaatactccaagcaaaagtacaacaattctattattaaaatttaaatatcattttataaataaaatctcaatgtccctaatcctgaagaatattccagcttttttttagcctgttcctctgatgtccccatttagtgctttatctatgttattttcaaaagttagtctatttaaaatagcactttatgttatgaatgtaagagaaaaactttgtaaagaatttggaaaatgatatgggcgcggtggctcatgcctgtaatcccaacactttgggacgtcgaggtgggcggaggtcaggagttctggaacagactgaccaacatggtgaaacctcttctgtatgaaaattacaaaaaattagccagacatggtggtgcatgcctgtagtcccagctattcgggagactgaggtggcaggatcacttgagcctgggaggtggaggttgcagtgagctgagatcgccctgctgcactccagcctgggtgaaacagccagaccttatcacaaaaaaaaataaaaataaaaataaaaaaattaaaaaaaattggaaaacgaagactattgtcaaagtgaaaattaacatcaaaggaaaacctcacagtcacatatactgctgttaacattacaagtcagaaaaacaatttaaatctgtatttttaatatatattaattattgccacttatgtatctaaatcatcatagaaagtcaatagatacaaatgtgatcttatctaagcaagaatataaggaaataatagaaccaaaaagaaccttcagcattattgttctgcatgagatatcatattgaactgtattagtagttcatagtttactgcatattcgttttcttttaagtgggcaaggttaattttcaacttagtcttgttaagtagagaaagagactttttaagctaagtacattatttccacacagggaaagttgcatacggcggggggtgggggaggggcacggaaagaaatgttttcctggctatcacagatgtggatgtgattgattattttgtcacttggccatagagtaatatgggcttaatcttctaatccaatgcaatatccccagctctcggcagcaaggaagtgactggtatgtcctcacagactgcccatgacacatgggttcattcactcagaagccaattccttctacaaatatgtgttgacccttttaacatgcagtcccgactaagacaggtaatgccatgcagtcctggctaaaagaggtaatgacacacccacactgaagaaggagatgaacatcagagacagacatgcacacagatcattccaacggggcaggaaaatgcatgcatgaatttaggatcctctgctgttcctggtaggagagtctggggatagaggggtggctggtgaggaagtgggttagggcttctaaatatgcacagaagatctggggccaggaatacatttatgggagcaaagaaaacaggctgctctgagcagaagcatgggttggaggctgagggcacagaaaggacatgaatagccccagaaagatgagaagaacaggtacacaacctggacaactcctctttcctccatacacctggagaacagactctagctggggaaaatattccatgcatacacttgaaatatatttgagcctccacttgaataacactaccacaatgaatttgaaagatgaccttcagatgattttcggattggatcatttaccgatgggcttcacccaatgtatatgcaccttgaaaaattggttagcaacagaaaagttcagtttctgcatttgaaagaactgccatagctgacctatggcttcttttttctttttctgaaatcagaacacctgaacaggaccaaacttcactcttaatggaaatatgtataagataggaggcttattttatggagccttcagcaaaggggctttccagaaagcagcattcaaaaagatatttcttgtattataaaccctggcagaaaaggttggtaacaaagtgtcatgcctactgaaggtcatccttttgtgatgtgggaagaagcttttggtgaccaggaaggcttagaaaggagaacatctgggggctgagtacctgaaaattagtttctttaaaatcatcagcagagtcatactttgaaaaattttgaaaagacatctgccagtttgaagaccccagttccagggcacataactactagatagacaattgttgaattacagggtgtagtccactgacaggcaaaaggttcccagttctacaatcctccccatgaatttactattcctcatacatagagagtctgtactttcaccccttgaatcttgagtggctttaagattgcattttttcaaaagaaaaaatataatgatgtgctgtttccaagactgggactcaaatcccctgtacctattcttactctcttgaaattctgccactgtcctgtgaaaaatcagactagcaggttgcacaacaaaagatctcatagagaagaacccattggccctaacctaggcaaaattacctccagcaacccccaattacctaagagaactcactccaaatcaacaatgcatacacatgaatgagcccagccaagaccaaaataaatttccagctaacaagatgcagaggctcataagcagtaataggcgcttattgtcttaaggcattgacttttagagtcctttgttatgcagcagtagctaactgatacatagggtaatactaattttatcttcagtagatactggcatatttctttccaaacaagttgtattatgctatacacccactagcaggtaagaaaatttcctggcccttaccctgttgccaacacttgacattatcagacaatacatttgccactttgatgagtataaaatattaacagtttatatttcaatttgcatgttccttaaaactagtacagatgcatttctatattcccattctaaattcccatcttgaatagcaatccaatttttgactggctgaatgtctgttattgatttgtaggaaatctttatattcatggatgctggcctctttttgagcatgtaaaagcaaacatttaacagtgcatagcagtgctgcgtatggttctaagggctttatgcatgttgaatatgcattttgtttgtttgttttttagagacaaagtcttgctctgtcacacaggctggagtgcagtcacacaactgtagcttaccgcagcctccaactcaagggctccagtgattcttcgacctcagcctcccgagtagctgggactacaggtgtgcaccaccacacctggttaattttgttctatttcttgtagagataaagtctcactatgttgtgcaggctagtcttgaactcttggcctcaagcaagtctcccacctcagcctcccaaagtgctgtattacaggtgtgagccactgtgtccagctccgaatatgcaatcttcataaataccttatgagatgtgtaactaatatcattttatagctgaggaaaattaggtatacagatattaaataatttgcccaagtttacacagttgagcattggtgatatctagtctgttgtctttaaccattttattgatttttaattatctaaactaatgctttaaaatgcataagtattataatttatcactattttctctataatttctgctttttttaaaaaaaaaggattacttaatccagaaacataaagacattttatttgcttacatattctcctaacagttttaaggttttatttcacatctgggtcataactcacctggaatttatttatctggatgctagagcatagagattattttaattatttccttagagaacagttccattttcagctacataggtattacagctctttacttacatgccaagttttatatctgctagattctgtttctgcctaccttgttctgttctatttttctatatacctagcctgtcttattttatctggtttacagataaatgatagacagatataattgcttaattgagatataattaatataccatacacatcaccgtgtcaaagtatgcaatccaatggtttttaatatattcatggatctgtgcaataattgacaatatctaatggcagaacattttcatgatcccccccaaaaaaatatggtaccatttagtggtcactctcagcccctggaaactacccattcatctgtgtctttctggatttgcttatttggacattccggatgtggggggtgacacactgtccttattcttagctttcattataagaggacttgaacacacctacatgcaaccctgacaagcttccatgaagagtctatactagcctgttagaggatgatattccacatggagcactgtcaagcaccctgttaagatagtgcttggccaatgagcacccaacagacctggaagctgactctagactgaagagcctcccagctgagcacagcccagatgtccagccaagaatcataacctaaatagaggttgtttgagatgcttagctaaataaaggtggtttgagatgctcggctttgagatggttccttatgtagcaaaagctaactgatacactaccaggaacatggcttaactcatttcatcatcaggtttcctttagaacttttgggcattctctgctgtttctcccatctgcaaagcccatatgctcctggaagattcatttttactgatcagcttaaattccatttcctcagaaaggcattccctgttcatcccaaccttccattcgtaaatgaacttgggttcctcaattattcactgtagttggcatttttcttcacaagatgaattgtaatgtgtaatatgatatcttgttaaataaggtctccctgttagattgttagcaacaagaaaaaggtgttacctgtgatttttcaacaccatattccttaatttgcaatgactaccaaaatattcagcacatataatataagttacatggtaaatatcttttggatgaatcatatatttttggctgcaagcccacctctattataagagtcacagtcataacagctatgacaaccagtgatgaatacagcctttacgtaacaagtgtaactaattctcctcttcaagcagggaaatgcaatattgtatcttcttatttaactttgagagtagaaattaaattataattcatgacgtggcaataacatgattttggttagcatattgtatataagaattctgccatttgtcatttcaaaaaacaggatgaaatgcttttgtgatgccagtaaaagcaaggtctaattctaattttctactagctcaaaaatgcttcattgtaataatggaagtaggattttctgtatttttcttgtttttctcttagtagctttggaagacagactgagagaaaaaggtgaatagtaattttcctttgctgttttgctggatttagcaataattgatttcacacttttacaggtaggaatcaaaataaatctaaagattttatgggtctctgacatattcctgtgcttactattagagtcctagagcattgtctaactttccataagcactttttgttgcaaattttactattgaaatgtttctgtcctcagaaatgaaatacaaatcctattatatttacatgagcctttcccattttttttttagaattttcagctgatagacaatattatctcgaagaatctatgagcttgagattaaaccacagtgtgtttaaaaataggtactaaataatgtattttgctaggtatttttaaatgtatgtttattaagaaaagtcatgttgagaacataattgactttcatttgtcctaagatgcttgttgaaatgttgtattaaaaacctaacatacccatagaggttttatatatatatatatatatatatatatatatatatatatatatatacacacacacgtacacatatctatacatataactcttgaaatgttgtactagaaacctaataatgcctggcgcagtggctcacgcctgtaatcctggcactttgggaggccagggcaggcagatcacctgaggccaggagttcaagacaagtctggccaacatggtgaaatcccatctttactaaaaatacaaaaaatagccagacatggtgtcacatgcctgtaatcacagctacttgggagactgaggcacaagaatcactagaatccaggaggcggaggctgcagtgagccaagatcacgccactgcactctagcctgcacgacagagtgagattccatctcaaaaaacaacaacaaaaccatcaaacaaacaaaacctaataacttctatgcacgcgcatacacacacacacacacacacacacaaacacacgtatatatattaacctctacaggtatatatatacctgtcagaagttattaggtttttaacacaatatttcaagaggtaacttagggcaaataaaagtcaattttattttcaatgtgacttttttaaataaatagtcataaaaaatacctaacaaaacaaaatatgtgtgtatatatacatacacacatacgtgtatttgtatgtatttactatatatgtaatatacattttcttatatatgtacacatattatacatacatatattttttccttgttatgagattgtggaaaagtttgcgttctgttgcatcatacttttctccgtagtcaggacacagcagctgattaataggtggaatttctgtcacaggactttttggtggtgtgggacaaggattctgaagggctggcacctttggtgaattctccttttgctgtctatgtagcaaaaggagacatctaaaagcagcccaactattgttcctagtcaaatcattcacaactcgcccttagcgtttcttgtgtgtgtacctgacatggtaaatggttctagtcattccagaaaaacaaaattagtctagatttatacaaaatcatcccgctcttcaatttctgagtatgctgtaatagaggctataaaggcaattgatttcaattaagagccctaaaatatatattttaagaagcataaggtcactcaagtatttggaagatagagtaattattactgcccacgaaggcttttgctactcttttgaacttagccaattcaccataatgaagaggttctttattctgttcagttaaacactaaaggaggctgggcgcagtggctcatgcctgtaattccagcactctgagaggccaaggcaagaggactgcttgaacgctgaagtttgagaccagtctaggaacataatgagaacctgtttctattaaaaataaataaataaataaataaataaataacaaaatcacacaggtgtgtgcctgtagtcccagctgctcaggaggctgaggtgggaggactgcttgagtccagggattgcaggctgcagtgagctataattgtggcactgcactccagtttaggtgagtgagaccttgtcaacataagcataacttaagcatatgtcactcatctctctttcagtgtgactgtgttcactcattttgtgtagtgagctgtattattggttcaaaatagttcctatcctttcctggagaggtattattcttttcccaccttctaatatcagtctacctaagtaacaagcaagtccacccacaaccgacatgaacttcagaaaaaggaaataagcctttgttgttacaaactgctaaaattgtggaggtttttttatggaagatttttagggttgcagaactatactgtgtgatactgtaatggtggatttatgttattacggatttgtctgaacccacagaatgtacaccaccaccaagactgtagcctactgtaaaggacggactttgggtgatgaagatgtcagtgtaagttcatggattgtaacaaacacacccctctggtgggtgatgtggaaaatagggaagaccgtccatgtatgggggcaggggatatatgagaactctctgtacgttcccctctattttgttgtgaacctaaaactgcgctaataaagtcttaaaaaagacacacaatgtagaataaaagacaaccacagtcctctcaggaacactctaaaggaacacttagggaatcatttgtgatttttcatggagtaaaataagatgcagtttctttattacagagacataagaacagtctgagataaaaaggatgcgttggcaaagcatactccaataaaatataaagtgtattgaaagaattaaaatccagaccactcataaggaaaaatacagaaacagatgtaccttagatctgagtaaagggacgcaaccagtgatatacaaaagacactgcaaaaagtgattgtttcaggagatactatgtgaacactgcatctactgaaaatcaatatatttgcaaatcttggtcttgaggtaaagataatttacaagagaataaccataagaaggtgagactgtcaatagaaaaatctatatgatcaaattctgggcattcactcaggtgtaaacacctttagcacccccaagcacagaaaatcctaaaagttcttcatccaaaacgcagttcaaaggccaagaacactaaaatgtaaaagttacttgtaaagaatcttaacacgttctgattattcctccaatgatcattataataaatagcgtaaaatattaaattaaaaaaaaactatgcagtgacctaataaggaattaggttgactctacaaatacagtaagatggttcaatgggaagaagtagggtgttttgctttgtctcattcacagttgaaggaaagaagtcaggtgatagctgagggaaagatcaaaggagaaaaaagctatttgaaagatggcaaatagtatctggtactattaatgtatttaatttaaaaagtagagtacatggaatatttattttggcaggaaatcctttttaatcttatcaacaaataggaaaagaaatgttgcactaagtgaattttcactaaaagtataaacagggcaatgatgttcatcatcaccatcatatttcaagatacttctacagactcgaagcctatatgtttttattaaaaagtattgagaactgaaaatatcagaaagaaggagacaaaataaagtcactcctgcatatgactatccaacaagagaaagagaatctagagaatcagctaaataatttagaatgagtcacttattatttagaattgtataaaattaacacaaaatgatttgtcatatatatgcacataaatatatttgaaaaaattctttgcacattcatgataaatgttctagcaataactctaagaagtgtacagcacatgttacataaaatatataaaataacaagaaacataaaagaacgcttacatatttaaaaacattcattgatccaggtataaatcaagagtgtaatagtatcgatacctcttcaaaataatttattactttagaattcccaataagatctttggtaacagaacaaaatcattatatattgatgatttgaataaaacatgaatgttaagttgaataaaacaaataaacaactacagataattatagctggaacaaaggaagctttttcccatcattacattatttatcccactagtgataatttgaatacaataaagtcattctttttaaaaagtaccattagctaaaaatttgaaaaaagagggagttataacaatctcaacttaaaacaaaataaatatgaattaataatgtatgcttaaaacaatgagcatgtttgttgaaatgtatataatgctgaggttgatattgtgaaccaatgtatatttattaataaagaaggcatttattaatgaagatgatggcatttttgctgcatatatatatgcgcatagacgattatatggtcagcttttacaatggtattctttaaatgtggtcatgagtatgtacaaaaacacaaatacacatatatgcacatacacttttatcacattaatgttatatatatactatatatacacataaacacatatatacacacactgttacaatcatttgtatatattataaacacatatatatatacacatgtctgtatacatacatatatagtatacacagaacctaattgtgtataaaatgtatatataatgtatccataatatacattatatactaatgcttacattatatataaatatataattatacatacattatttatttcaataaataatagaatcatttaggatatatacacatatatgtatacttttgtgtacacatatatacatatacatttttaataaagaatgacattactcaggaaatatatacataaatcagaaaagaaagatcactgaaggtagtcaaaaaagtaagtgacatcgtgacagtgaaccagtagtggtcttagcaagtgtgggaaagagagggaaccaactggtaaagaaaacatgaaggctgaggcaggcggatcacttgagccccggagttcgagaccagcctgggcaacatggtaaaacccagtatctactaacaacacaaaaattagctggtcgtggggtgtgcacctgcagtcccagctacttgggggcgctgaggtgggaggatcacctaagcccgggaccaaggctgcagcgagctacgatcatgctactgcactccaatctgggtgacagagcaaggccttgtctcaaaaacaaaacaaaatttttaaaaagagatggatgatggagtaggaagatggaaatatctgaaaggaatcagacgcgattgaaaaatacctttgtcactttagcagccttgcagaggctgttatttccagaataattcacaaaaagagctagacatggagacatatcctggcagtttattgtaaaattagtgaaataaagaaaaacaaacaaaatgtccaggattgagggagaaaaacaaaaggtgtctctacaatagaggacacctttggaggtatgtgtgcagattatctgcccactccatctaaaatgaggtaggtggtccctgtgtctaaggtggtgaggacgtgcaccactccaccccacatgggccctccatactcctggctgggatctgagtgcaggtgacttggatgtaggcctcttgggtggctcattttctcaaagaagccaaacatgctcaaagcagcatgcaagtgaaggctgagctgagaaagcctgggcccctggaaggaaaaacagcctggtcatgggttctgttcttggttcgtggtcccatgaaattcccgctgtgccctgtcctgtgcttccaccagctgccattgctctcaagccctctgtgctctgttggtttgtttgcgatccactctgtgaaatgtctttatgaccacgctacaaacacgcacaatttcactcaccttagaactctctgacacgagacgcagttgataatggaacaagatctaccatgttttggtacaaaacctttcccaatctctcctttgaaaaggtatttttagagattagcatgctaagaaagtccatctaacttaggcatagagtaaaaatcacaggataattcactctaagaaatcaagctcagggcaactccaacaagctcaagaatgaagtcaggattcaagttaagaatggggaaggtatggcctggaagcactgatgattcaagactgaagaatcatcatttcaaagatgttattaaagaatatgagttttctaataatcgccattctgacttgcgtgagatggtttctcaatgtggacatgcaagtgtatgttcattgcagcgctattcacaatcgcaaagacatggaatcaacccaaatgcccatcaatgattgactggataaagcaaatgtggtacatatacaccatggaatactatgcagccataaaacagaacaagatcatgtcctttgcagagacatggatggaggtggaagccattatcctcagcaaactaatgcaggaacagagaaccaaacaccacatgttctcacgtataagtgggagctgaacaattggaacacatggacacagggagggaaacaacacacactagggtctgtcagggagggcggggggaagggagagcattagcataaatagctaatggatgcggggcttaatacctaggtgatggattggtaggggcagcaaacccccatggcacacgtttacctatgcaacacacctgcatgtcctgcacatggatcccagaacttaaaataaaataaaataaaataaaattttaaaaaagaataagggtatgccaaatgaacattatttttgcatatagatatttgtaaaatattaagaaaccatgtacaaaagttgtgagtgataattcaaaaattcagatgataacaggaggatgtaaagtgaaaggctggcagaatctgccaccccagaaatgctatgttggtgtatggtcatttaagctccaggccaggaaaggggaggggaggggaggggaggggaggggaggggaggggaggggaggaaaaaaacagcaggtacaagaaagctgctctgatcctgttttcctttctgaaagcaagagatgaaactcctgtatggactgtgccctccctataccagaaggaaaaagcattcttgtcattgagaaggggaggctgaaataagagaattgtgtactaaaagaccatgttaaaataaaccacatatttctttagcctccacataggttagctacttttccatcatcgtctgtctttgttcaaccttctctaaaagcactgaagtgtcgccacttctttgagtcttcgtttccatctgagggttttctcatgtcacagaaaccttaaattacatgggtttgtatgtttttctcctgctgatctgtcctttgtccatttaattctcaggaccatcagaaaaaactcttaagagggtgaaagtaaaattatgccttctctacaaaaggaaaaataaaatggggggggggggcggtcacaaaataccttaaagagctactcaaatgaagaaaataatgccaagtaaattttttaaatcttaaaaatggctctggatagaatgcagggtatgttatcatcattgtgattacttccagtgctgtaatgaggagtgactgtgctctccacaccgttcaccatagaaactgttgccttcctcagagatgctcagaaaatactcatgtgcatgaatacaattaatgcaatggaatgaatcctttcagcgccaggtaaatcctgatgttggaaccaggatccctggtttgggaaaggtggcagagaatctatctttctcccacttcagagccacagaatgcttttggtaggaaggtaagcttcctcccactgtaaaatgatagcactgaggatagtgaacaagaagacccagtgttgccctcagggagccttatgcaacaattaattcaataatcactaaatcactgaattcctgctgtgaaaatgttattaatgagcatgtagacatatacatgtgtgattacagatagctatagagatggattgatacatagggattaagaggtctatctatccatctctaccatctatcatctacctgtctatctatccatctctgtcctctacctacctacctgtctgtctatttacctatctacctgtctattcatctctatctaaatttatatctacttatttacctacctatctatccatctctatcatctatccatctctaacatctttatatctaccatatatctacctgtctacccatctctatctatcatctatccatgtatccatatctgtctatgcatctatgtatctatctgcctttctatcatttatctatccatctctatctacctatatctatcatctctatccatgtatctatccatcgatctatcatctatccacctattcatatctatctatttatctatctattcttacacatatatcatctatctacctttctatctatccatctccatcatctattcacccatgtctgtctgtctgtccatctatctatctatctatctatctatctatctaactatctatatctatcaacctacctatctgcttacctatttatctcctggtgaccccatcttctctaatgattgagtactgaatattactcctagcccaagatgatctgaattaggagttaaggagttagaaaggaagttgtaaggaaatattccagaaaaggtgaaggagagtccccacaagatgagaccagaggattgggcagtgtcaggtcatgggcaaagcttgacggggtgtactgtgttgaataatgtcccaaaaattcacatccaccagaatctcagaatgtgttcctatgtggaaatatataacaccccacatccttatctatgaggatatgtttcaaggcctgaaactgcagctagtatcaaattgtatagatactatgttgtctcctatgtattaatgtctatgataaagtttaatttataaattatacacagcaagagattaactcttaatatctcaagagttaactgactaagcctagagattaaatgatcacagggaactgaaaccctggaaagcaaaaccatggataaaaaggtactactgcagggtctttgcagatgtgatcacgtaatttctttggagataaaatcatcacagatttgcagtggtccctagacccaatgactagtatccttttaagaagaggagaggatccagaaacatatggagagaagaaggccttgtaaagatgaagacagacattgaagtgacgcttccaagaaaagccaaaagttaaccggcagccccccagaaagtaggagagagacaaggaacaaattctccctcggaggctccagaagaaaccaaccatgccaacaccttgattttggtcttctggcctccagaaccgggagagaatatatttctgttgttgtaagtcacccagtttacaccatttaccacccagtgttaatatattatagaaaccctaggaagtttatacattagagcatttatgactcagaaggacctaataagccatgccctcccgtaatcccaggaagttgaatttgagccggacctatgaggttgatagaagtcatcccttgagtgtattacattacctaggaaataggatgggatgccattgccttgattaggttatgttatctaagattattttattagccgactggaagtaagagattctcctgctggacttgaagatacgtgtcgccgtattgggagacagtccctgagatggcttcatggcaagaagctgcctgggggacctctaggagctgacatcgacccctgctgacatccaccaagaaagaggggacctcaatcctacaaccaaaataaaccagattctgccaatacctgagtgaccttggaaaaggaccatgagcctcccgagagtcatgctgcccagccgacaccttgatagcatctctgtgtggcactgaggaggaaatccagctcagacatgcccagacgcctgaccacagaaattgtgacataataaatgtgtgtgattttaagccactgagtttgcagtaattcaatatgcagcaaaagaaaactaatacacacaggcagccaatgcaatcttactcatctattctctttctgaccgcacatcaccagttatgtaaggaatctgtttagccagccccacaaattccctgaaatttcaggtaatgtgaattctgttagggacccaagaaaggcaggacttgaaggcgtgccagccagcaccagcaagccatctggagttcagcagtctgcacgggcatttgggctgcctgtcagctgtcctgtggtgtgggggcagtacgcagagagcatccccgtctgttcaaaacacaccaaattggccacctccatctctacaggccaacctgtgtatgtgtgcctttcccaactgtttttgttatatttagaattgaagcccctattgggattaaagaatattatgtatcccatgataccgcaactgcttctaaatgtataacacagaatgggcacagcagcacattatttctgcacatatcagtagattccatagaagcttctgacatcacaaattataacagagttcagaaataaaagcagtacctggattggttctgaggcttccctggtgttttgaaaacgtttctctggtgtgaaaaagaatgtttcctcgcttcttttaatttgcctccttccacttttaattcactctcctttctctacatcagctccaagtgcctcctccaaccctactgaggcaccacacttgctcagatggacacccaccatattacatgtgaaattataatggctggaaagcccatgactgaggctgatgagacaaagaaatccccccatgagactgaagctgcgctgtctgccaagtctgactttgcccttttggtctgtgaaaacggaaatctggactaagatgggatgcttcagtgaagatgcaacaattatctgcatcctcaaatggcgtgtacacagagtaataacccgggaaggagcaagcatttccatttacagcatgaattcaaagggaacacaaatcactcatttagcagcttgtgagcagtttaggaagatcatgtttctccacttgttcatgcagcagactggaactccacgagcatgctggctcagggcatcacagagctgcagcaagcacctccagccacacacaagtggaagatggccaatgggtttctcagcgctcagatggtatacaatcatcacataaatgagggggaagagagagcttttttataggaggtcaaatccctgcatttacgggcatatgactatgcatttccatccagagagatggcaacctttctgatttacagcataaatcattactaggaagatcatttagaaaacaccacccaattttccagcagcattttataaacatcatccaaattgactctggctcctccaaaaggaatctttcagtgcctggcaccatgctttactgagaaagctttcaaaatttttgagctaactaagccattcaaagcagaaatactctatttcagtaggatgctttcatggctattaaacagcaacatcgggaaataatcattgcagtcaccatgcattatcacatatgttatacatttcacttgaaattctggtaggtcctttcttttatcattactctgcaacagagccagctttgtcatcaaatagagtttccaaagagagaaatgatctacaatcacgaaagcacagcagccactaaaaatcaatagctttaatgcactgttagcatgagttaagaagcaatggctatccccaagtgaaatcattacagctgccacttagtcaagaaggtgtttaatacgtgcaactttttttttatttatttttgtccccagattagaaattgacatattcattgcaggaataacattagctacattttaagtttcatcatctttacctagagaacaaaaatgtgtgttccagttgaccctattctgccaacaatactatcagaattcctatttaggatgaagataatggtataaatgtaaaaacagcagccaaatggctcggcactatcacacctataaacccagcacttcggaagaactaggtgggaggatcgtatgaggccaggagttcaagaccagactgggcagcagagcgagaccctgtttctacaaaaataaaaatagaaaaattagctaggtgtagtggtgcatgcctgtcaaccaagctacttgggaagctgaggtgggaggatcacttgacctcaggatttcaaggttgcagtgagctatgatcataccactccaatctgaaagacagagcaagaccctgtctctaaaaaaataataataaataaataaaatcaacagtcaaaggggaattaatttttttttgagatggagttttttgcttgttttgcccaaggtggagtgcaatggtgtaaacttggctcactgcaacctccatctcccgggttcaagcaattctcctgcctcagcctcccgagtagctgggattacaggtgcacgccaccacacccagctaatttttgtatttttagtagagacagcgtttcaccatgttggtcaggctagtctcgaactcctgacctcatgatccgccctcctcggcctcccaaagtgctgggattacaggcgtaagccactgtgctcagcaggaattaaatttttaatgtggctctctagagtgattccatgccagaaaaaaaccctgggattctgttcctctacagactactgtacttctcccaatggatcaacagagcaatcttctgttttccaattgccagcaaccgtagttcaggttgtcacctacttagctgtctcaggtaaacacatctcaaaaagatggaaggctgtggcaggcagacaaaacccttcaactgcctgaagctcttaaagatcaagcattggggctgggcgaggtggctcacacttctaatcctggcacattggaaggcctagccgggaggatcatttgaggccaggagtggatgatcatcctagtcaacatagcaatactccatctctacaaagtaaaaattaaaaaattagttggccatggtggcatctgtagtcctatttactcaggaagctgaggcaggaggatcacttgagtccaggagttggaggctgtggtgagctttgattgcacctgggcaaaagagcaagacactgagaactactatagggtgctggttgtgggggggcttacaaaactacctattggatgttatgctcactacctgggtgacaggatccttcctgcaaaccccagcatcaggcaatatttccatttaataaatctgtacatgtatcaaataaaagttgaaattttaaaaataataataaaataatgaaataaataacattctgcaaattatgcaagagaagtgtcatatttttatatttaacacattaaatataaaaataattatctgaaaaatggattattctgatatcagttaaattattcaagttgtagaggatttgataaatgatttaattaaattgtgtagaattacacggtggttgtatctaaatacctttgaaactgatgctgccaaagatttgttgaattctttaattcattgtctgccatgatttgatagtccaagatgttggcaatttcttacctttcatattggtttcctgaacttcatttaaaaacagaaaaggaaaagaaagatgtcaacactactatatcatgcatgaatgatacattaatactgttggtgctcacagcctattactattttatccattcaaaatgaagagtcttaaggccattaataaagagctgtaattttaactggacaatttcatgctgtaaaaagatgggtaagtgggaccatatgagtctcagcctaagagatttaagataaaacaaaaacaggccaggggtggtggctcacacctgtaatcccagcattttgggaggccaaggtgtgtggatcacttgaggtcaggagtttgagaccagcctggccaacatggcaaaaccccatctctattaaaaatacaaaacttagccgggtgtggtggtgcatgcctgtagtcccagctactcggaaggctgaggcaggagaactgtttgaacctgggaggcggaggttgtagggagcggggatcgcgccactgcactccagccagggtgatagagggagattccatctcaaaaaaaaaaaaagataaaacatagatcaacatcgtgtaagtgcccttttgttttgttttgctttgtttgggctgaaggaagaaaagagaccctttctatcagaattgtctagaaacatgcgttaattggacagttaaatggatatgtgtaacatgcaccattgctttgagaccaaacaattagaaagagatgacaggggactggccaacactgcattagcgtcttttagtcagatagtgtgagttgacaggctgaataaaaatacagcaaattgggaccagtccactgtgaaggtgaatcctagttatgaatctaacatgtgttgacttgaatgcacagtttcagaacatttcctaagtcaccaggaaagaaggaagaaaagcatcaattgacaaaaatcaatggaaagcgatggatggcctctgcatccaagcaaacgtcagcaggaactggatcagtgtacagatcgacacattccctagctcctgggaagtgactttggcgatgctacgaaaatttttaattattcagatttaatgaagtgaagcagcataggaaaatgagaggcaacaaattattacacttagcatgaaagaggtacgttgtcaatggtgccaatttgaaacctcaatgtggcttaaatgaatatatcatattgtcacaagatcacattttgtgatcatcaatcattccaaaaaggagtttcataatgttgattgagtgacgtgcatttgtagttgttgatttgcatagactaagcagtagtgttttggcagctttgagaatagggttcctacaaaccttaacgtgagaaaagagattcagtgatttgtctagaggaagcttgattctgccaattcaagttcaaagactgcaaagtgcattggtgtcatagaatcagaaataattctcaagcacaccaaggcagagatgaccacacggacagctggatgaaaaactgggtagagataaaaatctgtaagaggcttgaatcatttagattactaagaattagataaattagatgaattaagaataagatgagtaaaaattagtgaatatcatattaatcgttcatcaagcagattaaatcacaaaatgcctttcatagtggaagaacattaaaatgcacatgtatatatgtaagggtcacaggttttattaatatgctgtggtcattgttacagacaattaggctaatttagcttgataaatctccatttaggttcaaagttcttgtttgaataagatctacttaatatcttctgccagttcattacatgatgtaatctaagggaagatgatctagaaatagaccataaaaaagaagcccttgctcccaaattagtgaaataatgaaagtcaacaacaatgaaaatacaatcaggtgagcccaaagcaatttacctacacactcaccatcagagactatataaagtttatacctaaaaatattctcaatgtaataggtctgatcaactcatcatcacaagataagacttcatacatggggtaatgaacatatccggtactgaaatatcataaaaatacgtcataaacacattgcaatttttcagaagggtatataatcttagcaattttgggcagaatttcagatatcttagtcatatgaagagaaaaaaaggcctttcagtaagccattactttaaaatttgtgtatacatgcacacacacacacacatgttcatacacacatatatatataaacacatgtaataattgaagcattgatagcttagaaatagtataaattgcagttctcacccctatggcaaatttttaacagtaaccatttgctgcagacaagtttgacgttgtcaatgtgtttaagatactaaatctgtgattaaataatggacatatttcccaaaatttactacaaattgatcatttaaaattccatgaaaattaattatctcatcaaaaaacaaaagcaacagaatatggagcaaaataattattttgtttaaatcttctattgagatccttacttgcatagtttgctggcttataaaaatggcacattcattgttagaaatttttattttagcatatgataagaaaagggaacattatgtctttttagggataagagttaacaacttacttaacaacttacaatgttatatttaaaaataaaggattgatactgggcacatttcagttggtaacttggtacattagagttttccctggaattaaaatcattaaacataatttaaactgacaagataaaatatgatcgttgtacttttattcagatattttgtctatgtagatagcctgaagctctatgcaattatacaacctgtttaaaaataataaaaacacttaagtgacaatatacaacagaacatgatatggatttaatatgatggatgtgtttactttcagtaaaataatgaatcattcatgatttagtagaaatataatctcaaagtacctcacctttcgtctactgaaagatgaatcacaaaaatattttatagtgaagaaaacacaaggaattcataggagatgactattgatcaaagtgaattagattttggaattagctaaaaaaaaatatgcatttggtatacttattgaaccctagcagagttaagatgtgagctagaatgactactgagtacttgggaaaattccagaaaggtactgaacatgatttgattttctttgcagctgtacttcttgtagagtagaatggaaattcatgatccaagtgtgtctacatgtcagtctctacatttataaggcagagcaattctctggtaagagaagcgaagccaaacagccattcctgggaatactatccaactcaacactgattagagggtaacagcacatgagaaaacacaccacccctgacagcgtcagcccacgctgatgatgttgtcttccatttttcattattgttaaaacccataatcagcaccttacaacatctgtgttgccttgttctctaattgtctaccccacacacggtggcagttaattatacattatcttatcctctaattgctgtctgccttgggtttctcagcaagacgttggctcctcctgaactgcttcgaaacctgtgcccctgtggtagcgactgccttacctgcctagtgcaaagtacttccaaaaaatactttctgcttgataataattaatcagtgtcacaatacctaatggattgtgaagaggtcatcttcagctgagacaccaaaataagatcttgaccccaaaatgaggacaacttatgccagccacttatttactgagaaaaatacattttagctatttcctgtttcaacactgtatgatttcactgtcatgtcttgtttactttttcatcaaactaagtaatttttcagcatggcatgaaacctgttttctgagccaaaaaatttcaacaaaaagtctaatattttaacagtcacctacataattatatagctgccttcattttactactcttggataaaaattaaatacctaataaatttcttccatttttgtggattacatagctgtggtaatatttttgctacagataatacaaaactgtatctttaccttttttcctattcactgctttcatttcacaaattcatggttcacattctagggcaaacatacaaaattgtactaacacacacacagagttatgtgggaaaaaggtaactgatttactctttttgaggcctgagatcatagacatacaagccctctgaatcttgtagaaagtgacaaatggttttgtttcattcgtttgttatttccataatgaggatggtggtaccgaatcttcttttcttagagttgtggagtcatagcagatccacgatcctttagacaccctcaattctaatccagccttaattcttgattcttccttggcaaaactccaaccctggtgaaatccacctccccacccagcatgcatccgcctcacctttactgatcagcacagatgaaagaagatatttaatcatgctgacttatctcacattaaattcatgaacacaaacctccagtaggttaatcgagatgcctgtatatcatactaaatttctctgatgaattcccttaaaggctctgctaaatagcaccttcttcttcctcttctaatccccaatccctcgtgctccatcttcactgttagaatatgacctggcttcttactacactgaagaaattctatctcaagaaaacatgcacaaaccaccactaacccatttacccatgtgacaataatggccccatcttttgtgcctcctcttttcataagagaataatgataggaacccaatataaggctgactctcacccatcaaactccatcaactcttgacaacccaacaatagaacaccttgctcttgctatatcctcagaattgtcttcctcttgtatgttgtattattgtgtaaaaaactgtccacacctctcaaggggacaaatacacacttgcaagactttccctgtccctaactcgaaagaatttcactgactcacttccatgacttcagttatagctaattgacttgctttggcagatgaaacatgaacagaaattagtggggctacttccaagcgaaaaccttaagagctataatgtggttctgcccattttccccctttgctaaaataacaaaaataattagtaataataagaataaatgagtcttctccatcagcccgggtcccagaattaagaatacacagaaaacagccacagtcaacccttagcgaactttgaacatgagcgagaaatcaactttagtggctgtggatgtcgctgccattttagggatatttgttaatgtagcacactatacactgtactgattgataacaccacgcctctagatcaaccctacagcacacagaaatgtggttagattttccatcttaaaagcaataaaacaattttctcatcttaaaaaaaaaagtgtgtctatattgttccttttctgaaaatatccttgaaaatatttattgatattgattccaattttattgctcttattctctctgaaacctgccccaattggggcttttacccccaacactccaccaaaattattacttttctactaaaggtcaaaaatgacatttgcattgctatgttctcaattttcctcattcttttttcccctctgtctacctctattcaatctcaactgccacaatcagacagacaaaaggacgaggacactttttccttgcatctgtagtggaaaccatagcagcagatgtgcattttatgacctatttgaattacacccagttgactacctctctgtcattgaaatgcctttttccccccttcacttccacattaccagactttcttttacaccctggacaattatgttcatttcctttccaggttcctcgtattattaccaatctcaaattgttggcaagctccagccttggtcctttctcttctctgtccacagaactctcttgataattttattccgcctcatagctttagataccatcgacactatctaggctgacattttttctcttcagcacagatttctgccttgaacttcagactctgacatccatctccttatgggatatcttccgtttgatgtctcatagacatttcaaactcaaacatttaaactttgatgataacttaagaatgtctctactagcccatcctccaatgtcacctgtgaccacctctaccttttccagtgtttaggccaaaaactctggacttccttcgatctcccacactccacatccatataactagcaaatcttacttcaaatgtataaaaaactccaaccacttctcacctcccagctgtaggttcttatcttgactcttacatcagccttctaactggtctcccacattccacctttgcccctacagacaagcctcagctaagcaaagtgctcctttaaaacacaccttgacacatgaattatctgttgaaatccttccatttgttctccctggttctcagaattacaaagttctcgatagcaccaccctactctgatacctgccattctgatggcatactctgatactctagaaatgtggatcttactgcttgatatggtttggctgtgtccccacccaaatctcatcttaaattgtagctctcataatcgtgggagggacctgatgggaggtaactgaatcatgggggtgtgtctttcccatgctgttctggtgatagtgagtaagtatcacaaaacctgatggttttgtaaagggactgcacacgctctctcttgcctgctgccatccatgtaagacatgactttgctcctccttgccctctgctatgattgtaaggcctccccaaccatgtggaactgtgagtccactaaaactctttcctttataaattcccaagtcttgagcatatctttattggcagcttgagaacagactaatacactgctctgccctaaacagaacagggatgttcctaccccagagccttggcactggctgttccctctgcctggaacatccttctcatatatcatcatggctttttcccttagctatttcaattctctactcccacatccccttttcattgaggttgtcattgaccaccctacttaaaatactgcaacttccctagcaattctaattccacttatcctcttctagttttcttcacagcactcatcaccttataaaataatacaaaactttggccacgtatggtggctcatgtctgtgatcctagtaatttagggggccaaggagggagggttgcttgaacctaggagttccagaccagcttgggcaacatagcaagacccaatctctacaaaaagaaaaacatacagaaaataaatagctgggcatggtggcaacacctgtagtcctaggtacttgggaggctgatgtgagagtactgcttgagcccgggagttggagagtacggtgagctatgattaaacactgcacccagcctgaatgacagggcaagaccctgtctttaaataaaacctaatttatttaactcttaagtttgttttccatccacctatagaatatcagtggcacaagggaggaaattttatttattttgtacatggatgcatccctgaagcttagaacaatacctggcatgtgacaggcactcaaataataactgaaagaattaatagtgaaagtcaaatattacaagataccatgctatgaatgttgttttagaattatataagactatgctgatacataagccattacagttgaatgcttaaaaatcttagagaataaatgatttgaagagtcaaattttggggttggttgagagataatcacttaaggacaaattaagaaaatgcagagaaagtgcttcacaaaatacaaaaatactaggaagtccttgtccttccaaggttagtgatacctaactcacatggtttcttccagtcctacaggtggctttgtctagtttttctgattgggctctttgtttttgccagaggtaaactgctatttcatttccttttatttcctccttatttctgtcctatttttagataccataattgaatcaacattcctggtgcacagacatctaacaatttgataaacggcatgtattctctggtctgctaaaggctgtctcttaatgtctttcccttctgccccattctgtgcctatatccccttaactccaccttcctagagggttagaagtcccagagtcctaaaaggttcttgcaaagttgggttcaaggctacctaggttttctcattatcgactctacatgacagcaaatcaataatgaagccacacagcggggaaggctgtgtggatgtggataaagccaatgcctgtctttcacagatggacacatgactttatcgcctcaaaaacatgtcaaactctgccggtcctcatagttctcagaaaatatttcaagatgtcttttttcctccccgcccgctgggagaatttccattgtgaaaaacacatttacaatcatctcactttaaaaccatgtagagaagggcaggtgagctaaagagagaaaccctgatggagagggagaatctttagctgaggaatctttagctgaagcacgtgtgcacatgcatttgtggacacatctatggaagcaggggacaagcatgtcatcaatagcaaatgaggcaagtgcagcgggaatggccaggaaaaaaagggagagaatcaggagatcgaggcaaagtaaaaactattaagagacaagtcgctaccattcgacccagcattctcattactggatatctatccaaaggaatataaatcattctaccaaacagacacatgcacctgcatgttcagcacagcactattcacaacagcaaagacatggaatccacctagatggccatcaacggtgaactggataaagaaaatgtggtgtaatatacatcatggaatactatatagccataaaaagaacaaaatcatgttctttgaagcaacaagagtgcagctggaggccattatcttaagagaactaatgcagaaacagaaaagcaagtactgcatattctcacttacaagtgggatctaaacattgaggacgcacgggcccaaaaaggggaacaataaacacaagggtctacttcaaagtggtgggtgggaaaaggctgagggtcaaaaaactacctatcaggtactatgctcactacctgcgtgacaaaatcatctgtacaccaaaccccagcgacacccaatttacccatgtaacaaacctgcacatgtaccctctgaacctaaaataaaaattgaaaaagaaaaaatagatataaaattcccacaaacaaacagaaagagagtactggttaagtattggctaagtgtcactctctggcccttaaaaaaaaaaagaaaagaaaagagagaagagtggataggaaaagataaagatgcaaagatgttaacattgcttgacatttaaaactggtatctctccataatagaactttaggaaatatagcaaaaaggaagagaaaggaaactatgaaaccgaactgcatatcatgactgcttttatcataatttatccgccaaatgtttaaggggagaaggtggaaaattttgcggttaaataattacatagttaaaattcctcctgggctatcagtgtgatagaagtgcaatgtctactgaactctttcaagcagaatccaatatataatctctggaaattttgttttatggaaacaaaaacagaatcagcactttccaaagatcatctcccaaccaaaacacataataggaaacatgtactctattatttggtgcctaaattttccttctgcctatcttgatatactatgttattttttaagactgttttttaaaatagctaaattgcatattttaaaatgttaaatcaaaagccccgagaaatgcatgtcaaatatgtttaacatttaattcaattatatttcatctagggaataaagtggatggtttaaacatagttataacattattagaaataataatcaaatataatactcattttaaaaggcattatctgcatcaggtttaatagtttgtgtcctgtcacactgtaagaggtattggtaagtatttatggtttaacatgaggttacatggtatatgaggctcccccttgacatgcaggattgttctgctcagagggcaaaacctttcccatgttttcctcttccttggtgatgacagctgcttatgaacatcctctgcttttatcctattaggcggtcagtgttttatccgtgatttctcatttgcaattcttctcaatcttccatgttagcatgttacctcatcttgtcctatgctagcccatcttctagccatacagtttaatttcagtctcagagtctacttgttattgcctctgccttcttctttggatgctctcttctgactcttggattttctttttcacctggctccaccgttttaacattccctttcacagtttcgatactgattaagaaaataaacactaaatgtgcaaatgggctggtcacagtggctcacacctgtaatcccagccctttgggaggatgaggcaggcggatcatgaggtcaggagttcgagaccagtctgcccaacatagtgaaatcctgtctctactaaaaatacaaaaaattagccgggtttggtggtgggcacctgtaatcccagctacttgggaggctgaggcaggagaatcgcgtgaacgcagcaggcagaggttgcagtgagccaagatcgcgtcattgcactccagcctgggtgacagagtgagactctgtctcaaaaaacaaacaaacaaacaaaaacaataaatatgcaaaagggctggtcacagtggctcacgcctgtaatcccagcactttgggaggccaaggcaggaggatcacttgagcccaggagttccagaccagcctgggcaatacattgagaccctgtctctacaaaaaaataacaaaattagttggacatagtagcacatgcctgtagtcccagctacttgggaggctgaggtgagagggtcacttaagcccaggagttcaaggttgcagtaaactaggattgtaccactgcacatcagcctgggcaacagagtgagatacagtcccccccccaaaacaaaattaaataaaacatataaaaatatgcaaatgcatacaatttaaagcataatctctaactaatgcctatcattgccattcccagttttaatacataaactggtatgactttctggtgaatgatgccttcttatgtgttcactgcctgtaagggatcttgtactccttacattcttcagagatgccctttctccttcccatcttcttttcttccagtggttttcctcttgctttggtttttctcttttcctctacctttccttttctccactaccattttcatagaatgctgtaatcctggcactttaatcccaacagatcacacacacacacacacagacttataataaaggttttgtcttcatgcattcctcactccaatatcgtagttgggctgagctcattggagttcaattccactgcaatgttccatgttctgcacctatgcaatccagtaacatacccggtcatggcatgtttccaaggagaagtccaggttccaggtaccccctgctctctcctttcccatcagcattagatagtgcatctggggcaatctatattccatataattatttttaacacttaccccagtttcttattaccattctgcttgcaaacacttaaaacagatggatgtaaatggcatgccagctcatgctagaattactcatgttaaataaacgctgcaatgatgaccttcctcagtggttttactggattctgttcttgcccaaatgctaaggagaaaagaagctgtctctcaactccatttaggaggacagaaacataaaacagaaattgtcctttttcaaatccccaaataatggatggctcaccctcaaggcattatagcattctgccttctctataatccacgtgttgggatctgagacccagactcctttgtgtctaccgtatagttttaggtgagcacataaaatgctatctctaattaaatctcacaatattagtgaggaagcatttgccagtatggattctaaagcccaaactgaggtctttaaaaaggatgaaagagaattgattttaccagacaagaagaccaaagaaaattgtttacagcttagtgattcaacagtgtctataagggctcaagtcttctctcctgtcagaacaccaccctggtcagcagttgggtttccatcttgttcataggtttgccagctcctgacctgagataagcagtggggtcctgacaaaagcacctgcacccacatgcaggcagggggcaagagagggagagggtgcaagatgtgttggtcccttctacagagaaaagctttctcagaatgtctatgagtgtctcctgggctctgcttatgcctgacgttccctccactccaggaaggcatgggaggaggagatagggaaagcgtttggggctggcatgagagtttcttctatatgtcaaatctcagagattaatgcaacagaaaataaaactaaaaattaaacgatgaatcaacaattgtaaaaattcacctgaaaatatacaatgatctaatagctcattcagaaatgaaatctataaagggttttgggtcagcagatctaggtgtgtccagtcctaggaactcatttgctctgaatggaaaattccattctgctgattaaatttcattgagctaagatccactcatttttctaattaatcacatccctcacctaaaagcaacgacgtatttgaacactccattgcaaaagaagaaaatcaaattacatagttctctatcaccaagtaacaaagaataccttatgaggtgctagagaagatgtctgaagaattaaacttgtagttctggtgctaagaaatgaagtaacaaggcatataaaatgtaaaattgaataaaaattaaataaaagtggggccgggtacggtggctcacgcctgtaatcccagcactttgggagactgaggcgggtggatcaagaggtcaggagattgagaccatcctggctaacacagtgaaaccccgtctttactaaaaatacaaaagttagcctggcgtggtggcaggtgcctgtagtcccagctactcagctggctgaggcaggagaattgcttgaacctcgggggtggagcttgcagtgagccgagatcgcgccactgcactctagccagggtgacagagcaagactccgtctcaaaaaaaaaaaaaaattaaataaaagtagacatccataccagaaactaatttaagaaaaggactaactacagccaaaagcaagtgcacaatcaattgctgttacaaaggaaggtataaaagcattaatgtgtatccatcttttttcttttctcattttcaaatctcagagattaatgcaacagaaacaaaattgaaaatttaaacaatgaaccaacaatttcaaaaattcactttaaaatatgtaatgatctaatagcttatccagacacataaggtaagatctaatagctcatccagaaacataaagtgcttgaatcattttagaaatgactacatcggtcctactggtgttattataacaaggcctaccttttggtaagtctaaacactttactgtggaaatttcaaaaatttgtattcatgctgaaatacaaaatggagcaaagctttcttgaggcatcatgtaaaaaatgcctcagaagtgtgcctgtgtgagataattgagcagaattctagtttggctgttcaaaacagcagccccctaaccctagttccacccaaaccatgcatcttaagcgtctcaaataaatattgaatatgattagccattttcatagaatgttgtaatcctggcactttaataccaacagatcacacacatacacccaagtctttatgtattccctcacttcaacatcgtagctgggtcaagctcattggagtttaattccattgcaatgtttcatgttctcctcccttggaatccaggaaccagtaacatactagttactgaattttccactgaaggaaaatgatgatacacaattcataaatctactacaacaaaaagtcatagcaaccctcaattcaagctacattctttaaggcttttttttttaatgtagctgacaccatagtatgtactaaaataagacatttttccacttcttgaaatgtttccacgttagcaggtgagatcaacggcaaaaacatcaccaccatcaacaaacaaaaatgcatataacacttcaaaaaagcaggtacaaattttagaagcacatagtagccattaaaactgctaaaaagctagagtttttcaagttccacaatttcctgaacattaataaaatatattttcacagcattgttctttccattcaatagaaacttttcagccaggtgcagtggatcatgcctgtaatcccaacactttgggaggtctaggtggaaagactgctcaaggccaaaagtttgagactagcctgagcaacatagtgagaccccatctctacaaaaattaaaaaataaacataaactagctggccgtgatggcatgtgcctgtagtcctagtgtcctagtttgttttcacacttctataaataaatacccgagactgggtaatttaagaaggaaagaggtttaattgacctccgcatggcatggggggcctcaggaaacttacaagcatggcagaaggtggcgggatggaagcaaggacctttttcacatggtgggaagagagagaagaatgtgcgaaggaggaacctgccagacacttttaaaaccatcagatctcgtgagaactcactcactatcattagaacagaataagggagaccacccccatgatccaatcatctcccgccagattcctccctcaacatctggggattacaattcaagatgatattcaagtggggataaaaagccaaaccaaaacacctagctactaaggaagctgaggtgagcggactgcttgagcccaggaggttgaggctgcagtgagctatgatggtaccactgcactgcagcctgggcaagacagtgacttaaaaaaaaatgtacttttcataaacttgggcagagaagctctctttgtcagataatattgagacttacccatatgaaacagtgtgtattgcggctcatatgaaatctttgcataagacagtaaaaaaccatccaataataaatcatgtttccatgacaattaagaaagtagtaattgtagctgaagacagcacccatggtcttgtggattattttcatgttctaaatcattagcggtggggcggggggagagtaatacgcccattttaggttaactttattttaaaataaagcttccataacaaaaagaaaaggtgcatctaaaataatatctaaatcagtgaagaaaagattgtccaatatgagaagtgctcttaccaagagaaaataatgaactgagagtcagccaagttacatctctctgtagtttccttcggcttcagaagccctaatcagatggatcccctcatggtcccggagaaatccagctggctctacaccttcttatgtatcaagggctcatcacttaaatgcattttgtttctaacatggctggagaaacctccaaatgtcaactgaaaacctgccctcactttgtatgagcaagatttaaattttaacggggtcaccagggccttgtgcccaacaacattaaatgaagatgcttggagagtgctttgtgaacgacagcctggctgctggggagcataaaagcagcacatgggagtctttcctgtagcccaaggatttgacttgccaatgtgatccttccaccgtaaattcagtgccatggagtgctacgactacaggtgtcagccaccatgcccagcctgtcagagtgtgcactctgacagtgccaaaaacactccataggaaccatccacagcaagctcgggttcttttttattttccttttttttcccatgagctaggctgtggtccaagcagggcatgtattttctgtcattttcatggactgcaacagaaagctggaaatagatttctctggtgtgtgggagagatcttactgtctgattatctagaggccagggatatgtatcttcagcatgccttttttcttttatttacctccgtgaaacaaactgaactacttaagactgcagatcctggccttctgcatatgagatttggaattttgactaatagccctgcaactaaccaatgcagagaacgcccctgttttcttagctgccatcgtgaggtttacgttttacctggaattatctgaaaatgccccctcaaagtgtacgtgatagaacagtgggccaaaatatacaagactgagatgcttaggggacagttattagatcatatataagatactgcactgtaaatgaggaaagagtaaaatgaggacagagtgaaaaaagcatgtttgcacaacagtgtgaatattgttaatatccctaaactgtacatgcaaaaattatagatcttacatacattttgccactattttaaaaaatatgttgctagcacctactcagcatctgtcataacccttcacactcccttgccgctgtgccatacggagtccacctctgggatgacacctgtgtctgtctgctctcccattcagtgccgccatagcccttgtgaatgctgccttgatgaacattaatgcctcatccctcactgaacatatgcccaaagcacctaactagaatctccaattccttctctccacctttgcaaatgttactcatctctccaaacacaagggctgaccagaccagcagcccgaattaagtccaagctctttactgccatattcattgtacactgaatcactcccaaatctagtcacagattcactttccagcctatcataaaacatattctgcattagtaaacaaggacttcatgttcttctgaaattatgcctcaatcctgttctgacaccttgcttaaaatattacttcagctataacatccaatggctctgcttccaaaattccatttggaactagttaaagtggcatgtctttcatgatcccttcttaaatgctgcaacctacttattcctcctgggaatccctatggtacaagcctgaaatcagtcaccccctgccttctccaggacttaatgatatccatattttatttcccttacactagaaactgactttttacattttttctacagcagcacatacggccatgttttgaacaaatttggaactcaataagtgtttgttgatgggatgaattaatgaatcctatagaatgacaacactagcactatattcaaatatttaaaattagaattaaacttaagatttatgcagactttagcattgttcccattggtgacattttgcatagagggccaaagccatccttggcaaataagtgtcatgatatacataaaaaataacagggaggggagtgaagaaaatgtactatgcaagcacaatatttcatgtgatgaaggaggaagattagtagggcacaatgtctatccttaaggtgtacctgatataacagaggaccaaaatatacaagactgagatgcccaggacacatttattagatcatatataagatactgcattggaaaccaggaaagagcaaaatgagggcacagagtgaaaaaaagcatgtttgcacaacaatgtgaatgtacttaatactcttgaactgcacatgtgaaaatggtacattttatgtcatgttcatttggccacaatttaaagaattttttttaatgtgggatgagaaaagataatgaaggaataatgcaaagctgaaggctgtgccagatgtaagaagtgattatgaaggataaaagaaaagggctttccaagcagggaagaggcatcagagagaaaaccaattgttgagccagtattctgtcacagggacatttgtctttgttctttaatgcccagtaagggtcttctcaggttccattaaacatgcagaatcacaagacccccccaaagttaccatggtgccaaccgactcaaaacaatacagacaagaagctcagctcatcaggaaggctgcagcaggcatatgggaaccatctgctccacaaaggacagctgagatgcaaagatccctacaaggtccatatccacgggaattgggtattccttggcattgaagtcccagccttcacagcagccaatattccctgtaaatactccatgagcagagtttccatggttcctagagtgaacagagcagctgcaaagtgactccaaaacttgccctccgggaagcctgaggtggggtggtattaccactaggttctttcaggtctttatggtttctcctggtcatgatgctatttacaaataggggatcgtttgtattgtaagcaatgtggccaagaatattgttgccatgttcttcatccaactgccaggaaaacagagctagacagtcaagcagaggtcagattatcttgcagcaggttgaaggttttgttcacatttaacccagaggtactttgcatatctgagtttgtgccattgtcgtagcaatggcaggcagtagaaacaactatcaaaattatacagatgaggaacttgagagtcatagagaggaaggtaatggcctttaagtatgcagaagaaagcaatgaaatcatgagacaagagtgaaagtctgatactttgcatatctgagttcgtgccatcatcagcaatagcagacaattgaaagaaccatcaaaattatacagatgagtaaattgagagtcagagagagaaaggtacttgcctttcagtatgccgaagaaagaaatgaaatcatgagacaagagtgaaggtctgctatgcacaaagcttgtattatttatattgattcatggagaaagaaccaacggcaaaggtacagaggaaagatgactagggaaaaaaggatgataaagggatggatgtggtaacagcaaagagaactctagaagccaaacaagcatttctggaaagcctgctgcatgccaggcattgtacttgcccacagtagcccacattcctataggcaagatggtcacagaaacgactaatgacaagaaggtaagagccttaggaagatcatcaggaaggtgcactggagttaacacagctacactggacaaggtgcaaagagcactttgcagagaaggtaacatgcattctgaatcttgaagatacttcaagatacttcaagaagttacaagatacttcaggatgctgatcttctcttcatcaactggttccccagttgatgaagatgcaacctgatgctataaagaacagggaaccagtaaggcataaaagcaaaaaagaaacataactacatttgcattttccaaagagaactctagattagtcactgaagaagaaaggtgcacctaaggagacagagtgctatagtttggatgtttgtcctctccaagtatcaagctgacatttgattcccaatgttggagatgaagcctagtgggaggtgtttgagtcatggaggtggatccctcatgagcagcttggtgccagccttgcagtaatgactgaattcttgctctgttcattcccccaagagctgactgtttaaaagagcctagcacctccttccccccattctcttgcttcttctcttgccacgtgatctttgcatacaccagctcttcttcaccttccaccatgagtggaagcttcctgacaccctcaccagaagcagatcctgatgccgtgattcatgtacagcctgcagaatcatagccaaataaatctctttcctctatatgtcacccagtctcagagattccttaattgcaaaactaaatggactaagacagagggtgatcatacaaaatgaagacagtgtgaatttgcactgaggcaaggaagagaatatggggaggagaggtaagagctggtcactcaagccagaaacacaaaattttcccacactttatttgtccactctaaatcacgcccccctcttcccacatcataaaaattggcctccaagacttgccagtcctatatgctaaatctctgtatagctctaattacaatatgatatttagtatctgcactagagaaagaaacaaacgctccatatttgaatgtcttcagacaggtgagacaggcactagttacactttattaaatactgcagtaggaattaacgtatgttatccgagaacacccaaaatgtaaatactcagcaacaaaagcatcttaataaacagctccatacactggtcctatgttagtcctatcaaaatcagccacaacagcaacaactatacatccatctaggggctcccagtagatgacaagagcttgaggaatgatcatttagaaatagacagcttttgtatgactctggcaatttttctggttgttctcattgtttgtttcagagttccatgaaaggacatattttacatattttacatgctggaatggtccaattagcttcattccttagcagctaagtaagagcaacagcttagctgatcaacaatgggataaatgctctgagaccagagttgtggacttcccttcactaacttataaatgaatgcagggtgaagcattatcacctaatgcagcctaccatgtgactggaagaatgtatcagatgaatacatctggcatgctcaaccgcactcattatttcatcactaaaataaaataccaattaattagaccaattccttgggtctttactattacataaacacaggcaaatgatgagatatgaagttcacttggataactctctttgcttttcatgcagttgcttctcatggtgtttagtgtgttcatttcaaatggctgccagctaaagttgaaggaccatgtttagcatcatctgtgctcagaccataaatgaacaaagtcctccataatgttttcatagttccaatatgttctttcattagaattctacacttaacatatttttacctttttcctttcattcctacatgcattttaaatataaaaagtgatataccacctgctatccctgacatttgcacaagtgtgtatttgaaaatgtttatgttcaaattttggtaactaatgcacagagagaaatttatactatgtgattaaaatatattttatatgatatttttccacaattcacttcagcatcaatgttattacattccaaaattttattttgtgtgtgtgtgtgtgtgtgtgtgtctgtgtgtgtgtgtggtgtgtgtgtgtgtgtgacagggtctcactctacaagccaggacagagtgcaccgaggccttgaactctcaggttcaagcaattctccttgcctcagcctccctcatagctgggaccataggcacacaccaggatgcctagctaatttctgtaatttttgtagagacggggtttcactatgttgcccaggctggtctcgaactcctggggtcaagcaatcctcctgcctcagcttcccaaagtgctatgactacaggtgtcagccaccatgcccagcctaaaatttcatagttttatacaccaaaattatctcacttttccttaaaattttgtcggattaacctcattttttcaaatcattaaataagagttactttctgtatttttaatctgccttcctcctatttcagcaacatttagctaatcatccaattgttcactaactcaaccaaaaagggaaaactaatatagaagtttggcttatgaccaaaaccaggattcatagaaaggtatgtctcttttgccagatacagggattgttctttgattggcaaatgacaagagattgttccttctacttcatccccagccttagaacctgcaaatgggattttcagcaacaaaccccttctaacctcaccattcacaaagaaagcttggtttcttgtagtgttacctgaactcctaccactaagtttattaaattttgcgagaccctttcacataattaaaaggctgatgtttgagtcagaacttgtgtctgggatgcttaaattcctcaccctcataaagacatgccctggccactccatctcaaagatcctcataacccacattagatgttatcgttgcttcatttccctcaaagctatgatcaccatcagcaattctgtccttcatgcatttgatcactgctttatcttctgtccccataactaaagtaacagcaggacaatttgtgcatcctgtttgctatcgtatcttcagagtcaacaacaatgggtcatgaatagttaattcatggatgaaagatgaatgaatggatcaatgagtgaagactcatttaacctattcctatgcatatgtgttgctactgctatgggtagtgggggggtcttctagacacctggccttcttccacttacttctgacttctcctgatgtctagcaactcgctaccgagtaggtcaatcactgccaggttggttgcactgggggaagaaggtacagggtggtttccatgactattaacagcaactctaataatgtgcttgcggcaattattgaccccaagatgcagcatatcatgtgctgatcctagccactgatgtgaggttcaccatttttaaaattacaattaaactacaatactgataacttttaaattctattaaaaccattcctgagtgtggccctattactcactaaggaatggttgcagggtagttgatcaaggtaattagatggcaagtgatatggtctggctctgtgtctccacccaaatctcatcttgaattgtaatccaaattgtaatccccacgtgttgggggagggacctcatggggggtgattagatcatgaggacagttcccccacgatgttctcatgatagcgagtgagttctcatgagatctgatggttttatatggggttcttcctccttgctcagcacttctctccttcctgctgccctgtgaagaaggtgctttccttccctttcaccttttgccatgattgtaaatttcctgaggccttcccagctatgcggaactgtgagtcaattaaacctcttcctttataaattacccagtctcaggtattttttatagcagtgtaagaatagactaatatagcagggaaggcaggcaacgggaattgggttggttcctctcttataccacggaaggtggcaagttgttaagactgtgtgcagcatagcccatgagacttgcattaaagactaccagccctattactaatctggctgttattcaatcatcctaatctcagtttccacatctctgtaacagagttaataaacagtgtaatctcatgaccctactgtgaaaattaaagtagataagtcttgcctatgtttcttgctcaaatgccatcttgcagagatgcatgtcctaaactcctcatttaatctagcccttcaatcactactgatcccaatccagcttgaattatcctaagaccaccttccctattttatatgcttgagcctgtctttactttttcccacatgggtacatgagcaccatgatattgggatggtgttagtgctcatgacagctgcatctccagtgttgggcacagagtaggcactaaataaacacttgtttcatgtgtgaacccatatcccaaagcacataattgtatcttacacatagtaagcactcaataaatgtgaactattgtttatgtgcttataataccaaggaaataattggcatcatcctgtgggtcagcttcattacccaagagaataagtatttatatttactgaggagatcctaacttctaggactccttactgcaatcctctgaggtctctgttctaaattttccagacagctgtattaattcaccccagatcacacaggtaagatttcaaacaagatcccctgactcaaatggactccatcttctctgtgaaaatgctctctgtttcctgccatcatctctactcaaagttgggtgaagacataaagcagctatattccctctctttggagagcttacaacttaggaggcaacataatgtgaatgcatgaatgcttatggtctagaaaccagaaaaaaaaaaaaaaccagaacaacaagcccaagaggagaaaaatgccagatgctgaaagaggaaaaaaggaatacatgatgatcttattgtctaagtagaagtcatatgaaaatgactgtatttgaaagctttgggtctaagaaaatggcaaccccataaggttcagtctcgtatatactaggaagaaactctccttaagttccaagtgaacagtcctgacattccgaatccaaagcagagatttttcatcttttcttctaggtcacagacttctttgaggagacactcctctccaagaaaaatccattctcgcctactcataaaggtgacatagagtttgggggtcccctgggagtccatgactgtcagttgaatgacatctagtgccaaagatgcaaaatcaccctcagttgaagaatccaagtaacagctcaagagaactgggttttaactcttactatcactacctaataagagcacctgtccctttcacaccataattagcttcttcctaaaaagggttgtggttctgctgaaagacaccccataaactgtttccccataacccacaaaatcttcaagggcaaagtggaaacattatcaatacgggagagactgagaaacactgtttcccaagagaaggtattagtgtattaaagacctaaatgtgacaaatgaagtatccacatcttcagaggtttacgactatgtgaaaatttataatttgtttatttatttttttaatagagacagcgtctcactatgtcacccagggtggaatgtgatcatggctcattgtatcctcaaactcctgggctcaggcaatccttctgcttcagccttctaagtagctgagactactagcacactaattaaaaaaaaaaaattatagaggctgagcgcagtgattcgcacctgtaatcccagcactttgggaggccaaggcaggcagatcacctgaggtcaggagttcaagaccaacctgaccaacatggcaaaaccctgtctctaccaaaaaacaaaaattatccaggcatggtggtgcacacctgtggtccaagctactccagaggctgaggtgggaggattgcttgagcctaggaggttgaggctgcagggagctgtggacatgccactgcaatccagcctgggtgacagactgagaccctttctcaaaaaaaattgtagagacggggtctcattatgttgcctgggctggtcatgatctcctggtctcaagcgattttcctgccctagcctcccaaagtgctgggattacaggcatgagccactatgcccagtggaaatgcggaatttaaatgaaaacagcacatctctcttttttgatataaatgcatgctgaaggttctggcctcactcctggtaaaggcaaagcatcaggatgagaaagcatgtctgagaagggccttttcccagtaaactggcctgcttgacaaaggggctccatctataaaggggaggggaatatgaggctggtgatatttgtttggaaagggctgcaggcaagaaaaagaactgcctgtgtcaagggagttgcagtcagactctaagatacctagcctgcagggcatgacaccctctcactatagtaacttccttccatcttgatttccacttcttagaactcatgctctagaaactagaaaccaaactcataacagtaagcccaagaggaataaaattgcaaggttataaaagaaacacaaaggagaaatcgatcttattttccagtctggaggcggtgctgccaatgtacagttgcgatcaataaagaagtgttattatcaaagtttgaaaagaaacaccatgggaaccctacatttcttcaactttattatgatgcataaacacttagaccattcatgtctcgttctctgttaaattctcaacacttaaaacacatgcaataaacaaacattttaataatacattgaataatcttctaatataaaataatcccctattttttacctaaattgtctcaaggttaccctatggttttaatattctgtattttggcaaactatcatttcattcatgcatttatcaatccagaaatcatttgttgattattatttgaaaaagacaaatgaggtaggcattaaaataacaaggataacgtcagacacaggggcacaggcatgcaatcccagcactatagaaggctgacgcaggtggattgcttgagcccaggaattcaaaaacagcctgggcaatatagtgggactgtgtctccacaaaaaaaaaaatacaaaaattagctgggcatggtggtatgcacctgtagtcccagatactcgggaggctgaggtgggaggattgcttgagcccaggaggtcgaggttgcagtgagctgtgatcatgccactgcaatccagcctgggtgacagactgagactctgtctcaaaacataaaaaataaaaataagccaaaacaagatgtatctaatagatagatagcatacatatgcatatatatgtatacataaaaatattatatgaaggaaaataaataaaatctttttcactgggccttaacaaatgaatgactgggatcttcccagatggagagtggggaggaagtcatcgagatacaacttatcggaaggcagctcccgggcaggtagaagggtgggtgtgctgagggaactgtgagctgtttgttccaaggggcaagggcacgaggtgtacaagaaaaagtaaaagaagctaacactggaaagggacacatgggcagattaaggagtcttctgtgctgtcccaagggtcttaggttttcccaggtggtaaaaaaagagattttgccatgatgcgtttttttctttttttttttttttttttttgagacggagtctcgctgtcgcccaggctggagtgcggtggcgcaatctcggctcactgcaggctccgccccctggggttcacgccattctcctgcctcagcctcccgagtagctgggactacaggtgcccgccacctcgcccggctaattttttgtatttttagtagagacggggtttcaccgtgttagccaggatggtcttgatctcctgacctcatgatccgcctgcctcagcctcccaaagtgctgggattacaggcgtgagccaccgcgcccggcccatgatgcgtttttaacggcttgcaggagtgggttcactctcttgagctctttgcccctgtgccatttgatgatgtgcaaaatggtcttgccagatgatggtgccttgatcctggacttcccagcctctagaactatgagaaatacatttctattttttataacccagtttcaggtgttttgttgtagcagcataaaatgaactaagaaagattggaatgcatcacttagccactgaaagccatcagatgtgagaatcaggaagatgactccaatagtagcttgaaggtaggaggcagaagagtaatggactgcataacaatctaaactgagataaggaagctgtcacagtgggccacaggaagacagcacatagctaggaatgttctgcagggcagaaatgagaagtagacatccatttacataagtgctgagaaaagagaagtaaaatccaacagagtttgtatcttggacacactggtatatggggcacctttaactaacaggagggtgcagagaggaataggttttagaggaagagcatctcttaatatttgaatgtgttgtgtttggagtgtctatgtgacactcaactagagatttctaataggggctaaaattacaaacactgtaactgaagctagtggcctgagctggaaataaagacttgagaatcatccacatagaggcagatagttgaagataagaagatgcaatgaattacctagacatacaatatacagaatgaagtcaagaacaaatcctaggaaaagtcaacatttaagaataataagagaagaaaatacagaagagcttctcacaattgtagaataaaaccagaacatagtgataaaatgaaaaggaataagaattctgcaagtgataaagtgcccatcaaattgatataggatcatcactaaaaagacaccactgggttttggcaatgtagaaatcactggtcatactttaatgagatttgttagcataaaattgaaaggatagagaaccagttttggagaactggaggacaaagaactataaattcctattacagtaatggtcactattaatggaaggagaaaaatatgtcataactcaagagaagacaggattgaggctgactggccattggacacaggaggagtacttgggttgatggtgggggttaactcctagatcccacttgggaggtggaaaactgtcccagattctggaagacaggagagttatacgaacaaatgaatctgttagtataaaaatgagatataatgaaaacaaaaaaggtcaaaaaaccttaaattgatgccctttgaccccgatgaggagagagtgtaaatgggttgtcctatggtgtgaatgtgttccccgaattcatgcgttgacatgaatattattaaaccctagtaagacagtgttgcaggagaggggacaatggcaggtgtttaggtaacaaaggctctgccctcatgaacagatgagtgtaattataaaaagggcttgcaggagtgggttcactctcttaagctctttgcccttctgccatttgatgatgttcaagaaggtcttgccagatcatggtgccttgatcttggacttgccagcctctggaactaggagaaataaatttatatgttttacaacccagtttcaggtattctgttatagcagcacaaaatggactaagacagattacaagccaacagtaagatctcaagtgtttctggaaaccacacactaatgagaccaaaccatgcagtaattcacttaatgctagcagtgctatgggacacaagaaattgatatctggatgcacccttagctgagaaacaacagggtgagcccaccacaagcagaggaggaaattgagggtcttagtgagagaattaaagtcagatccagcgatctatgtcagacgtttggtggctggaaggatactcagtactaggaggtttgccaggattcatggaagagtgatcaaagtgggaaggaagaagtgatagccagaagaagaggaggtttaggttagggtcattacttcagagttttcagtattcagagtagaatacggactttagtaatcattttctgggtgataaatcgtagctccacaccattgtccttcagtaagtcagaaacaggcaaaaggcaaccgaatgaggactgtgaggtggtcgtgtaatggagctgaagtcttcaataaagaaggtcaaggaatttatattcttcagatttttttgagtccttccagtcaacactggcttcatggatataacattaattcttcaacatccgcattaagagatggattcaacctaatattttacttacataccaaaaatgcctttgccttgaattctcatgttataggtaagctttctgatgtattagtttttgggattatcctaggaagaactcccactgtattccatgtctggacagagcttatgtttatacaggcttaagtaatgctttcctatgtgttttcaatactgcttctgagaattcccctggtgtggtggactccatgcccacacggcacctggcatggagcacagcctgaatatgccattgttggtgacagaaatcaagtcaatgtcttcagaaagccatctatactgattctgttccctttctgccagggaatgactgactgatagctcagcgccatttttcttcaaggggttaacgataggcaaagctcagggctgaggagaagcccatgtattttgtctattttgttgagatgtcatgaaaattaagggagaaaatccatgtgaacactaaaaaatactattattactgttattataagtgttgctatttggatgtaggttatgattgcatgaagcccagacagaatttcttaaacttactggataccaaatgaattatgccaagtgagcagatgagtgtcagctgcatagctttggaaaagaaaaattaatgtaaaaattaaagtttggtttgggtgaggctaggtaaagatggtttgaggaagaaagaaaatgttttcatgtgtcatggctgcttttaagtatataaaatttaattttcaaaagccaagaagatgtgaatgatgtagggtatttcttattcctctgtggggcttctctcaagcccaatgaagcaatgaataataggaaatgtaacaaaaaagcaaaatgattgcaagccatatattattcccttgagtagatttccctgtaacactgaaccacagcagaactttttggaacttctgagattccttgcctacatctcaaaattggcctaacgggtataatcctttcaacaatccatcaatctttctccccagtattacgggtttggttatatttgtttaaatatacagctttcttccacacaatgaagtgtttaaaacaaatttttttaaggacggggtcttgttctgtcccccaggctggagtgtagtggtgtgatcatagctcactgcagcctcaaactcatgggctcatgcaaccctcccacctcagtcttctgagtagctgagaccacaggcctgagtcaccacgcctggctagattttttaaactttttgtagagaagggatctcattatgttgcccagcctggtcttgaactcctggcctcaagtgatcctcactcctcggtctcccaaagcgctgcagtcacaggtgtgactcaccacacccggctcatgcaacaaagctttgattaaattggtttgggcagatactgtctcatcagctgagtccaaattctaacctgtgctagttttctctatcacatgaaatcatctttttctcatggctttttatacacacctagaagatctgcataaatgaaatgtcaatgtacttttaaaagttactcaaactcactacaaagaattttttaaaatcttaaatataggtgcagttatggtttttcattttctctgccaatcaaagcctctctctaagggcaccgtaccatagtcaccttctaagaggcaaacattgttaataatttgtttattttttgactttttttaatacagcaacatacacacatttgtatacaaatctacacataagcattcacccacatgcacacatatgtacacatatgtgtatggatactattgtgcattcatatctatgtatatatacaagtatctatacgtgcatacataggtttaaggagtttatgtgaatattactctgtgtcctcacattttgctctgcctcttcaatttcaagggaaagatagttttaatattctaagtgcttaaaataattcactcatcttcctgatgagaaaaatttcagttgcaatgatcacctatgtacatatatctttgtgtatatatctgtaagatagattcctggaagcaaaaatgcttccagaggagtaaagtgggtctctttctaaattttgttgtataatacccaatgtcttctaaaactctacttcaattcttcctccaactagcaaactgtgagagtgctcatttttccatgcccaaagataactgaactgagttttgccattcagctaggtaaaaggataataaaataaaataaagtaaaattaactaaaataaagttgatttcactttctttacatatgaatgagactggacattgttattgatgagttctaagcctttctttctttttgagcttctgatagttctgatggactcatttacaagtttttctctatttttctctatttttttgatgtcatttaatttctcacttttattctgaatgtgccattctcatctacacacgattttctacctaacatgtggcacttcccaacctagagtgcaccgtggggcacgcattttgcacaagccaaattttgcaaatccacaaaagggaaaaggcggaaaatggtaccctttggaaattggccaaaaatgtcaacgaaagcagtttcattttctacgtggcatttgtcatgctccatgcatggaacattttaaattgcatatgtgaccttttaaacaatagcaggaaatgccaagagaaaatgcgaagctcttcattgtctttcttaagcccctgcagaagccatttttcatggtccacggctagagcccatgatcaggctgtcaaagcacctgaaacaaaccatcaacatctgcgcagttttctatcctgggaaacatcagacacaggcatggcactgctctggagagcttgttcttctccgcatttattcagtaacagcagtttgtaacactacctgagttgttccatgatataaagagattcaagtcttaatatggtattatggtgttatgtagtagaaaccaagcaaatctctatcaccattttaagaacaggattattatacattattaggttactaaaggggggtttgtgtaagtcttttatcaatgacccttagggattaaaactagaaagagaaaataataaacttcagctttcttcatccaagtaccatatctactactgtctgtgtagctttttaaccaaagtaacaatagatgtgttgttgacatttggatgttattaatgataacataaagaagaatatatgatgccgagttcatatgaatatacattcctttctctgtttatttgataagtatgtgtccctgtacataaactgtaagttccctgaggttaaagacttggcatccttgtcttgaccatttttttccttgcataaagcagatgaatgataaatgcctgttaaataaatgaatgaaataaaaaacctctatgctataaagacaaaatttcaatatattaaattaatacctgggaaaatcattggcaaattactaaaaacaattcaaaaattttgcaagaatttaattatagtcattaaatgtattatccatagtagtaagaaaattataaacatatcgttaaactaaatttctaaatttctataaacagcaaatacagtgtaatttattatgcaattaaattacaatgagtggtataggcactgctcaataaatgtaggtagctgaaaatgagtaaatgttaacgcctattaaactaaccaaaactacaggtatggaagctctgtattttgatatttatctccccaacatttgatatcgccctttagtagtttgtacatggctatactttctgaagaagaagaagaacagcacattaatgtctctgcaagtcttagctatcatcataaactaattccatccagcacctggaattttcccaagaacacagcaggtgttcaataaataacagttaaattaagagacagaggaattgtgggatattcctactgaaacttgaggtgcatgtaattaacttaatctttttcttgcttacattatctgctgcagagagacaatgaagagagaagtcggtaaagttagtgtggagaagggatacccccttatgaccccaccccaaaggggtatgtgttggggcggataaggagataggtttaaaagagaggtcattctatcattctcatagtcagagggctacaaaggaggtgatgccatgtcaaataacaccttctagaaatagaccagcatagaaaagttggatatgcttgctgtatgcatgaaaggaaggaaagcaaggggccagacaaatgtcttagatatggcctgggacaagctgagcaccagcttcccttagccaccagcaactatgtgaaatgaaaaagatattaccatctagtgcctcaattccctcctctgcaaaatgagaaaaattcatgagactgtggttatcagtattaggaatcatgtgctcccaagtgtgtggaccaaggtcaggagagctctgagaacaatcccaacaagagtcaatcacgtaaacacatgtcctattctccaagccctgagctaaggtaacacctcctgcagagatgaagctgggaagtacgctactaatgtctttttagtttttatttttgtaagtacttcataataatctcagggttgagctaaattttgagtgtttaaccttactctattgttccagtattaatatatgaataaatatatattgtatattctctattaatatatttagataaaaactaaactattttcatcttaagaatgtcaagaagctactagtggcacagtgtcagtattgcatacctgagatggacaagcagcagataatcagaatgctatacctttaccttaatattcacttttgctctcgttttaattttctttgatctgaatctcattttgagacacataaaagtagaccatagaatcagaacaagatgcatactcattcccataaaataccaagttttatgctgctatatgaaggaatataaaaataacaacataatttcaatttttcatcaacagtaagattttaagactcaatcaaagaacatccctagaaatcttgtaaaaacactagtgtcttacaatcttaataaccctgaactgagcaaaaaacatatatatataaagcaggatttttattgatatgaagtgtatttttgagtggtggttcacaaccaggggtggtttcgcctcagaggcaatatttgacaatgtctggagatatttttggttttcataacttgtggtagtggtgccactgtcatctactgggcagagcccaggcatgctgctaaactaaacctcctacaatgcataggacacctcctacaacaaagacggggtgatcagctccacatgtcatgagtgccaaagttgacaaatactgttttgtaggaaaaagagagaggaagaaaaagaaaaggaagcaaaggaaaagaaagagaggggaaggagggatgtagaaaggaaggaaggaaaaaatggaaggaaggaagggagggagggagggagggagcaacagtggtagagagggaggaatagttggagagaagatggagaaaatgaacagagggagagagtaagagagaaaggaaaacaggctggcatgactgatggtctgatatgtgctataacaagttatttattcctaagagtatccttaaaaactagcaattttattctccattttactgtgaggacgtgaataccttgcgaggtcaatgacttgctccagactttgtgggttccaaggtcctgcttccctggaagcatctttttaaaataagatcaaataagaaagtgcagtgacttgattcatctgcactgctacaagatcccttcttatgtctcctgtcttacatcctgtgttccagaaaatggaaccctcatgaaaggaatgcagttttcacataaggaggcaatgcctactttctaaaagcgtcctttccttagagtattaaaggagattctgctacagtctgctcctagaacttagatatctttcaaaaccaatactggatgagtttcattcacataaaaaaaaagccattaccattttaattatatttttcttctcagcctcctattctagattagtattcattattacaacagacaactatattcctgccaagtgtgtaatactacaaaatctctttttataaaagctattttctcacagatctgtattacagagtaagagacagccaattctcttaagaaaaacaaaagagaaaaaattagctcataggataagaacatgtacgaactgggtctcaccattgagtaagatgttcctcagtacttcttcctcctctccttctttacttccttccttcctttcttcctttgttcttttttcactccttccctctctcccttcctccctttctttttttactccttccttctctctcttccttcctttcttcctttctttcttccccccttcctccctccctccctccctcattccttcctgtttttccattggtgaaaccttctcaaaggaaaagcttccactcctatcatcagcaggtaacacatcactctgggagaccttccctgaacaaaacaattacctcctgataagatgcacttgctagtgaacttctgggcacaaggaagtaagagaaatatccaaaattaagctttcccacataaagctcctccaacagtgtaagcaaaagaatatttgggtgtcctgagcaaagggaaaactggacctaagggaagtctgcccttatgtaacacacccatagtagcactgacctcagacaaagggagcaggtagctggaagggcagccagatgtgtaagacaaggggctggggccagaaacccaagcttggcttccagtaaggtggagaatttggacccttgaaagggctcaagtcttacactctagcttctatcagaaggaaagcgaacctacctgcctggggaaagaatgccagcataggccagaaaattcccacagattaagatcaaacaaacatgagttcacagtcaaagatcactaagcccatgaacactgaggtattataggtgctgcacacaaaacttgtggtattaaaatagctatttaaaaaataaagtttgaaacaggaaacaataaacaaaaaacaggaaattactggaaaggacaaggaagatttgaaaaatgaccacatagaaatgaaataaataaaaactgtatttgttgaaataaatagaaattaatggattagctaaagagattagacacagaagaaaagacaataaaaaaagatatgtctgggaaaatcttacaaaaaacagaagacagaaactaataatataaaagtcaatttaggagacatgggtgcaaaaatgagaatctcatatatcaaatcaaaatttgagaaaacaggaagaatggagaagtgtcagtatttgaaaggtgatccctaagatcttcaaataatgattaaatatatgaatccaaaggcacagaaaccatagaaagaatggataaagcaaaaaaaaaatcaatattgacatgaaactgatgaatgccaaaaataaacaggagatcttaaattttagcccttgccaaagacaacctgtgcataaagtttaactcaaaaccaactgacatctgtatagccagaagacagtgaaatgtgaaataatggtccacctggatttgcataataagcaaaattatctttcaggaatgagcagggaacaaaggtattcaatcaaacaaaaactgaaagagtttataacaaatattcatgatacataataatagcctgtaactagggagacaggtgattggtattttctagaatggagctaaggtcttgcttaattttagactttaatgacttaaatgtgagttttacaactgcaagcttttcttgaaaagtagaaatcaagtaaatggcaaattaagaagaaaatacagaaaaagaacaaactcatttattaaaaggaatgcataaaaaaggaaatccgaaagattaaaatacgttgaattatatcaaatatcttcaaactcataaatagcataagttatgcaattactagactgaaactgtcacattgaaaaaaagaaattatagatatctgtcatatgaaatgatacaaccataatatctgaaattactaaaggtgaaaatataaaaaatatattctcagcaatagccaacccaaaagtaaaaaagaaacaagcatatttctactaatattggatatctattgtaaaacagaaagcattttaagagatagcaagaatattacatagtaaaatatttcattcttcaaggagataacttgttatatattttatgccacatacgttctttaaaaaaccccaaatcagtagtattataggaagaatttataaattcattcattaatggaagatacaaagaaacctattttcaattttaatagatcaaaaaataggaaaaacagatgccataaacagttaaccgatgatttgatagacaattacataattttgtatctcatcattagaaaatacacacaaaacacttaaaaattaactgtttattagaacgtcacacaaatctcacttaacacttaatagacaaatactgaaatactgtgttttagaatttacaggaggcaggaaaattagcagtagagaaaatttaaagccataaatactgacatcagtaacaaacacaagggcaaaaagtaatgagtgaatcatcccacttaagaaattagtggagaaaaacagaagaaactaaacagaaagtagaaggaagaaggtataaaaaggaaagaagaaaagctaaagatgcaatagcaagatttggcaaggttaaaaagctggtcccagctgggaccagcttctctattcatatgcacttctggcttctggactctctattctgtcccactgttaatgtttttccctgtgccagtgttataggaacccaccgatgcttcaaccacacctagaattagagtatccaagtcccagttggcctgggactgagatattccccaggtgaggagattctggtgctagagctggcaatgacctgcacaaagatgacagatcaccctacttcacatttctgttatggggtggggggatactagacagggtatgcattgcatctcaaatatttctacaaatgaatgtagttaggatcttggaggaaatttctaaagaagatctcagaggatctgctgcaggttatcgaatagcctaagccatttatcaggttggccagaggacttgagccacagaaatacagaaaagtcatcggttgtctgtttctgtattgaagcatgaagggaagtagagacatgaagtatgaaattgccaagtcagggtaaatacatctagggtgcaatttggggtgaatcatgtgtaaatgtttatggtgttaatgaaaaacgttgcagcaattttttttttaaaaagagtaattttatcaaatttgcacattggaaatcctgctatgaaaagagttccatgtgtacgagccttagttgttgaattctatttttaaatggctaaggctttaagtacgtgcgtgcgtgtgtgtgtgtgtgtgtgtgtgtgtgtgtgtgtgtgtgtgtgtgtgtaattatggcaatgttgctaagtgcataaatatgcgctctgaattccagctttgggtagactctactcagattgcatgctatttaatgattgcattgactctgaagcatatatgcaattctatactattgctgatacatgcttttataaaatagcagtgctgctggaaaacaatagttgcaaaacaacaatgcctcaagctgtgcataaatcagggcttgtaaaactcataagctgcacttcaactcttaagcaactgttaccttaaagaagaactagcctttccacaatatctattgattaatatgaaatactaaaagaggttttgtttcataaactgttgcttcttggcttctaaaaagatacagttttaccttttatgattttattacataattgtaaagaaataattgttgaaagaaattcacgttcctgtaattctgattctaccccatatatgttaaggaacaataaggtaacacaatagattaggctaggattaccatactggtgctcaatgaagacaatgctgccccctcaggagccacttggcaatgcctgcaggtagttttggttgtcacaattaaggatgggcgttaggtgttaaagacttggagtgggtagacgccaggagtgctgctaaacatcttacaacgcacaggaagcgccccaaaagttttaatagtgctaatgtggacaaaccctgaatttgggaaagaaaaaggtggaaaaatcaaaatggtccctggccaggatgcatgcatcacctgtttatagccgctacatctgaatatggaggctgcaatgaccaatggtttggagtatcagggcatctggaaatattctacagcatgaagctaactaattgtttgttgtgccaacagaaaacagttaccataacacagagctgtctgtaggtacaaaatccagaactgcgttacaatatctgccttatgaagaagttatgtttcagagccaaattccacaggacactgcatcctgaaagttcatcctagtggtgacttggagagctagggggatgcctaaccactcatctgtcaaaaaacagctctgtcattcttcctcccactctttcttgagattgaatggtgtattaacactggcttttcatgttctattgagcctcatttcctgcatttaggaaccagccttccctacagattagaggccaagctagagctgaaaaatagaaacaacaagcttgttatctgaaatcacagccatcaaaaatgcactctataatgcccccgataaaatgttaacccttaatgtgatagcctcaagattaacctttagaatatgcacctttaaaaaaaaataatggtacaacatctcccagcacaataattgaattcgcaatgcagctgagttgtggaagtgaattcacaagtgtccctagactcctcaaaggccacttgaagaagagcggactgttgtatgtcattatgtgagaaatttaaggccaaagaggttaactcgctgagagactttggctgtttgatgttaaagccccattgtcagagactctcatctggaggccaacattaaggatgctatagaggaaaaagcacacacatacgaacatgagtatcttcttagcatgaaaatctaaaagacaacatcatttgcgccagaggccttgagccacagggaacctaaccacgaaatgcagaaaaatcatgggttgtttgtttctgtattagattgtgaagggaggttggactcgaagtacgaagttgccaaggacattgatggtgctgttgaaaattttcatatcgtgtgtgtgtgtgtgtgtgtgtgtgtgtgttttctatcttcatctttcatctattgtggtaacatcttaacatctccaactgtcattattgatgagtctttctttgcatttattgctaattgtataattaacagctctcttattaggtgtacacaaattaacattattagttctcttaggtgaattcttccttgtatcattatgaaatgtctctcttttattttggaaataatccttatcttgaaggtatctttgcctgatattaatagagccatctcagctttcttggcttttttttttttttccttatttgttttcatgatacatactttgaaatattcacacagtgtacatattttaaagatatgaatctgactacagacttactaaagacagtcattgacaacattgttttcattggatacttttttgaaaatgtttatagcagaggccaaagaacataagtaggagaacaaatacaatctaatgagagagacttgggggtgttgctgtggttgcaggagggcaggactctgaatacccccttaccctaaactccacctagttagtccctctatgtgaacccagacacaaatgtgctgaacccgaaatctgggacacctggtttagtaagatggagagtagagaaacactaaaattcaaaagaaatagatcgaatgtattcataacacttgctaagaatatacaccatgacccttatgtatcctaaaacaatgcctttatcacaaatggactctcacctataagaaaaggtccatgtcactcattagttcagggacactccctcattcgatggcttagcaactgcattcaactcagaccaatccaaactcaggcttaaaaaaataacacgtcctcaaatcatggccctttacagctacaacattaagaattaacatctagcatttcaaattggtaacaaaggtgagctgtctacaatctacctttgggaagaaaaaaaaaagtaaaacctcaacagcaataaatgaataatgctcaactgaaatatgagaagaaaataaaccaattaaaaactagagggtggggcgcgatggctcgcacctggaatcccagcactttggtaggcccaggccggaggatcgcttgagcccaggcatttgagaccagcctgggcaacggaatttgtagagacagccttgcctctacaaaaaataaaataagctgggtgtggttgtggatgtttgtagttctagctacttgggaggctgagggaagaggattgcttgagcccaggagttggaggctgcagtgagctatctatgatcacaccactgcactccagtgtgggtggcagagcgaggctctctcaaataaaatacataaataaaaataataataaaaaaataaaaactagaaaagcacaaggtcttaggaagaaattgacatgtatgtgagactcactaatcacaccctgcaaatgtcttctgagtgagaatatgatctccctagtgcagaaaccattgtcttagttgcctttgtgtctccaaggtaaacctttgggctacatgacagaagacaacaaagggtgctgatccaatgcttgaatgttattatagaaaagtatcaagaatgaaagaagaaagaagtctacaggattgtataatataaacggcctgcgtacttttattgtctacccctgcctgcatttccagcttcccctcctgcctaactccccattgccgctgttctcaagccacacctgtcacttcagatcctgactgcactgggctccttcgagccctggagtcttcgcatgaaagtccctctgctcaccaagaccttcttaccctaataacttactactgccccttcaaccgcccgttctcaatatcaatatgtatcctcacaactggatcagaaactttggaaaccagctctaccagcatctaacatgtatttcagtttgtaattatacttgtgggtgatctgatgattatttttcttcaactgctggaagagtttctcaaccttggcactgctgaccttttttggtcagataattctttattgtgaagggggtctggcctcttcccactagacatcagcaacaaatctcagtcatgacaacctacactgtccttagacatcgccaaatgtcccctgaggcaaaattacccctggtgaagaaatgctacatcagagtataagccacattaaataagaaactatgtcttttttgctccgtattcaatgtctaaagtctagtaccatgaagagtacataggagatgctcataacatttagatggatagatgaataaaccacaagtaactacaggttaatgtcaggtctggttgtagctcgtagaatattctgggatagccaattcagagcagcaagtcctgtgtatcaatttctatcaaactttgagcactaaaatggctctgaagtatatgtaacaacaaagaatgcttattttcttctatgagttttgttgatcaaaattactttgttctttcttggactctagttggtgtctgatctctctctttgacagcagaaaacttgtcctcattcacttaagtgtttcctggtatctatgactaggcatcaaccttttaaagttgaatggataaaaaagtatctactatccattcttacaccataaagaactacttatataataatacctggtacacagcaagtgctcattaaatatttgtgaagctgaactgaactgtataaatcagcattaatttataatttaacacagaggaggcaaaggatgctggaaaaattatcagatgacaatgtgatgatgtccatttgaagtcaatagacttgtctttgcttgttgcaaattaaattctgcataatcagtctccctaagctttgtttttcttctctgttaagccagtagaaaatgtctttatagcctgccaagaccagctcggtccgggagaccctaacccagcagcgctagaggaattaaagacacacagaaatatagaggtgtggagtgggaaatcaggggtctcacagccttcagaggtgagagcctcaaacagttcacccacatatttgttaacagcaagccagtgataagcattgtttttatagattatagataactaaaagtattctttatgggaaacaaagggatgggctgaaataaagggatgggctctggctagttatctgcagcaggagcatgtccttaaggcacagatcgctcatgctattgtttgtggtttaagaacacctttaagcggttttccgccctgggtgggccaggtgttccttgccctcattctggtaaacccacagccttccagcatgggggtcatggccatcatgaacatgtcacagtgctgcagagattttgttttggccagtttgggggcaagtttatggccagattttagggggcctgttcccaacactagcctagttcatcagttgctgtataaaatgtgaaaatgtctgtgaatggctatgtgtggaaagcatttactttggttttatgcaaagctaagtcagggtcttcactcaatcaagtcttatgtggtacagctgagtgttggaaaatacaagataacatatagctgcaggtagagtccagtgggagctccgtggagggaaatttatctctacccagaagtagttggcaaaggaatcttctgcaatctgtctcaatgagtgggaattaaacaaataatgaaaagtagagaggacaatacagatagagaaacagataccataccaacggcagtgataacattagaattcatttattcattcatgcacttcacaaatattaagctttgaataaataggcctagactctgcaaggtagtactgaagaaaacaaagacccacagtcttggagtttatattctgaagacgataagcagataaatatatatacgataaacatatataccatgaatatagatctctgatcaactcctttctcctcatccttctcaatgtcatcaacatgaatatcatctttatacttgaggcagactagagatcgattgcattccaagaggcaggggaattgtggcagtcccaggaggtaggaaaatcatgtctcccaaaggagtcacttgaaagaaatataattaaatatgaaaaaaataaagaaaaaaaccaaaacatttaaactataaagagaatgtacttttcaggatgcccccacgtgaggcctctcagaaatgtaatcttactttaaaactcaatatgacattggaaataattaacaaaatatgccatgcaatattcaggaatgggagacagataaacagatggatggacagatagatagatggtacagtatgctatagtctgaaagttctgtcctctcaaaattcatatgtttatatccaaacccccaaagaaaggaaatcagtatatcaaagagatatccacacccccatgtttgttgcagctttgttcacaatagccaagatttggaagcaaactaactgtccatcaacaggtgaatggataaaggaaaatgtggtacatatacacaatggagtattgttcagctataaaaaagaatcagatcctgtcatttacaacatagataaaactggagatcattatgttaagtgaaataagccagggacagaaagactgttatcatatgttctcacttatttgtgggagctaaaaatcaaaaagattgaactcatgtgcatagagagtcaaaaaagggttatcaggcactggaaagggtagtgggggtgggatgtggggaagtggggtggttaatgggtacaaaaattatagtcagaaagaataaataagacctagtatttgctagcacaacagggtgactatagtcaatactatagtcaatagtaatttaattgtactttttttttttttgagactgagtctcgctctgtcgcccaggctggagtgcagtggcatgatctcggctcactgcaacctctgcttcccaggttcacgccattctcctgcctcagcctcctgagtagctgggactacaggtgcccgccaccacacctagctaatttttttgtatttttagtagagatgggatttcactgtgttagccaggctggtctcaatctcccgacctcgtgatccgcctgcctcagcctcccaaagtgatgggattacaggcgtgagccaccgtgcctggcctaattgtacattttaaaataactaaaataatataatttgattgtttgtaacacaaaagataaatgcttgaggagatggacaccccattttctatgatatgattattatgcattgcatgtctacaccaaaatatctcatgtactccataaatatatatacctaccatgtacccacaaaaattagaaattaaaaagaaaaaatatataaatcttaatccccaacgggacagtattaggaggtgggcgccttttggaggtaatgaggtcatgacagtggagtttcatgaatgggatcagtgcccttataaaagggatcccacagagctcccttgccctttccactatgtgaggacacagtgagaaggcgctgtctatgaatcaggaagtgggtccccaccagacactgaatctgtaagcactttgatcttgaacttccagccttcttatgtgtgtgtatataattttgctcagttacataacaaaaacctgtaagtaatttgctgaactaagagagagagagaggattgatagatatatacatacatacatacatacatacatacatagacagatagatacatagatgcatagagatgatagatacatatagataagatagatcgatatatatatagatacatacatatatgcatacatacatacatagatacatagagatgatagatataaattagatagataagaaatcaacagattagatagagagagaggggtagatagattaaatagatacttcacatgtagagacactacttatcaggaaggcatagtgagacatttagtcaattgtatgagtacatgatcatcagaaaaatgactcaattaacaagattcagggttctgaggaaggtgattagggaagctgtgaattctctgttttgggaaattactaagtttgaaaacacaacagcactccttgaaagtatgcaatgctcagcccgtgggtgtgcaggtggtatcctgtggttgctttctactgctcattttctgacataagcatatatttggaaaagagtagatactaattgagatgaggtttaatatttacttacactggtggcactcataaagtgcttatcagtggaaacagaaggagaacaaaattagttcacaaatctcatgtgatcgcccactctcccagcctagacaaactcactcatgtgccttttgtctttttctccctggagttcctctccattccaattgttcctcccctccattttctggaaggaaagctgggatggattccaacttctcttgttcctttttagagggtaaaaaatacaacttagggtaactagtagacataactaaatgtttcaaaatagggtgaaagggatgagatggaaatcacagttgcatgtctttctgcaatgtctaggagtgcagaatatgaatgagccaaatattactacataacaacatctgcgaaattttactgaatcctcctaaataagtcagtgaatctcaaatcgtacctgtgcagatgtggacaccatcatttggatattctaccatcattacatagagctttcctgctgggtagagttacagtaggacacctgataactgttttcctcgctacagttcaacacctatgaaacctgatgtcaacgcattggtacttaatacatcagtattttatttcagaatgttatcaaatttgattttaaaacattaatagtcactagttcgatgttgaaaggaaatacacagtatctctaaagcacacgcaccttatggtattatgaattagaccataactttgtggtacatgatgagcattcaaagcattgcaaagaatagtaatagaatacgtatgtgcaattgggtgcacctgagtgttgcacttgtgcgtgaggcatgtgtgtgtgatttgcataagtgtgcatgcattgtgtgtgtatgtgtgtgcacatataggtacacataaactaacttctgaatctgttaaatgttttctggtaccgcacagatctacaccttacttttcaaagttgctaatatttatcctaaatttcacctccaccgcaaattcttccatcatcaaacatttaccttctacttagtaataaccagcttaaagcactgttggaattgcatgtgactaaaaatttctagcaatacagaaatagaaacttatgcttgtcaagagaacagaaggacatactgcataagatttggcttgcttcataatcttcccaagtaagggctttagacgatattatttatgatgaaatatgttatcaactacattctcaggtggataatatctaactgcacatgagtttctgtgttcatttggcagagttatagctcaaggcatttatcagttgttcatttatatttatttctccatcttctctctctctcacttttatcctgaagatcttttttgctctctctctctctctctctgctcagactgaaatagaaaccaagatgcaacggaaacttggacctaggaacctgagaaatattctcacaagagtgccttcagtacctcatcttcccctcagactatttagatgatcagactggagttacagaaagtgaacaaaaaaggaagagtcaaagggacaggagaggatgggcagtctggaaagatcaggagtccctgagatggcagaaagaaacagatgacagacagattaaggagatacctgcaagcctcctgcatggaaggtcaggagcacggacaatgtatatggagttagaggtaggaaaacagaacctcacaccctaatccaagttgaaccaaacagatccagtggcctgaatttaatagcagagatggaaccaaaactgttagaaaactatgctgcgtaaactgttatcataattcagatactgggacggtaactggattagcaagataaaatcacattagaccatttaatcaacattattttacaaacgtgaaagtgtattatctccttttttttttttgagatggagtcccactccgtctcccaggctggaatgcagtggcatgattttgactcactgcaacttccacctttcagggtcaagccattctcctgcctcagcctcctgagtagctgggattataggtgtgcaccaccatgccccactaacttttgtatttttagtagagatggggtttcaccatgttggccaggctggtcttgaactcccgacctcaagtgatccacctgccttggcctatctcctctttagacaaacttgattcatgacattgtgtgtgacacatttatgtaatttagaatatggaataaaatgttttacgtgacataatttaacaaagttaaagcacaagcaaaaaaaaaagtacattagattagcaaatttaaaatatactaagaaattttatgtgaacaaacgtaggtgggttcatttacttttcagtacttagagactatcgtctagcacgttttcttaagtaacttatttcatttctcattaatgttaatggggaaattaccacctaactaactgccactgagtctcagaaccagcccttggaaacccatcccaatcattaagccaggagtttagctggcaaactgcacacataacacaactcagtcccaggctcttttctccaaaaagaaatgacattattttgatggaagccacttttcttgatttgcataatcatccatgaacacaacacagatgtcagtctttaaaggtaagggaggtggttagattgtctgttgttctttggaaatcataaaattatttctgcagtcattgcatgaggtccagactaacacatctctctccacacaactattttccactgaccaccaacattatcaatgagacctttgatatcacagatccaccaatggggatctgaaacccttgggaatgagtatgcttttgtggacaagaggaaggggactcagaactttttaatttttttacatctgttttatgcagcaccctcagaggaatatggaacatcactcccaaatcaaactcattaatattcctgcaggaaaatatctaaatgtccaccctgaggtggaaaagaaagaacacaaatagtcatctgtcagatcaggttttgcccccaaatgagttttgatatcactgtaaagttttgaactgtttttgactttcaaattgtagataagggactctggatctgtatgtcctctgatttctattaaccagtcctagaacagtaaacaaaacaaacactaaagagcaccccatttacagagtggtttaagtccactgaagttggttaacacttggaccctgaaaatccatgcatactgtatggaatcaattatgatgaatgtgaacagttaattagacaaaaagaacctccttgcatccaccattacagtataacacagaatatcttccctgccataaaaatcctctatgatccacctatttatcttttctttccccatccccaaccgaaactctgacaatgatggattttttattgtcccccagttctgctttttccagaatgtcctatagttggaatcatactgtatgtagccttttcccatcagcttctttcacttagtaatatgcatttaattttcctccatgtcttttcatggcttaatagctcatttctttatagcatggaataatattccattgtctgaatacaccatagtttatttacccattcatctattgaaagacatcttgttcacccagagggtctcttaatcttgatacttcccacaaaacagaactaggaatcagcggttatgtcaactttccagggaatccctacaagtggaaggctagaatgataggacaaagaactgcctgtgcctctccaggcaaaaacctgcaaacatctagcaaaaaccttaagcactcttgaaattcatttattcagataacctaaaaattgaaatatgaatttatgctttattctttctttaccaatatagacatggtctcattgatttgtggacaatgatgagcttgaattcaatgcgaagaatctttgaacactttcacatactttggccctagttctaccacagctggaggagctctgtttcacttgatcgttgtgctggatgccattcggccacatggcttattccagccgctcttgtggtgatctgctctgcctagacttcagccagcttcacgcaggtgcagcctcacttcatacctgcaaacttgcctttttcttgatttcctgaagtttctctgatgcctcacagtggatgcacactaaaacctacttagcactccccaagcagcctggagaggttacccccagtaaactaataagaggtgaaagatggtgtgaatatgggtcctccattttcaccgggtaaaggtggtctggagacacataacataagggttttcagacaacctcactgggtcaagcagcagtcactcctctgtggccaatacacttttttgtgtttttgtttgtttttaaattttaatttggattcaggggtgcatgtgcaggtttcttacatgggtatattgcacactggtgacatatggacttctagggttccaatcacacaaagagtgaacattgtacccataggttaatttttcaaccctcaccccctcccagcctttcccttgtttgagtccccagtgttgattgtttccatctttatatccatgtgtacccattgtttagctcccagttataagtgacaacatgctatatttgattttatgtttttgagttatttcacctaggataatggcctccagccacattcatgttgctgcaaaggacatgattccattctattttatggctgcctagtattctgtgttgtagatgtactacattttctttatccaatgcactgttgatggacacttaggttgattccacaactcggctattgtaaatagtgattatttctcgttccttcccacaacacagtgctggttcctcatccctatttttggcataatatttgcaataaacaagggttttctctaaacctctgctttgagtggaatctgggctaggaaaatacacagtggatcgaaatgtgcagcccttactgccaacaaaataaagactcaaagtgaattggcttttgaatgtgacaggtgtgtagccaaatgcccaacactaatgttgatgtcagcttcaagtcaaagcaccaaagccttctcacagaaattcattttccaacagaacttaagcttactttattttggaatctgcaggatactgtgaattattattaaatattattttttgtagaataactatgaatgcacacataccaaataaaaatggtggctcatgcctgtaatcccagcactttaggaggccgaggtgggctgatcacttgagctcaggagttcaagagcagcctggccaacatggcaaaaccctgtttctacaaaaataaataaataaataaataaaaaattggctgggcatggtggtgtgcatatgtagtaccagctactctactagggaagctcaggtgggaggatcacttgagcccaggaggtcgaggctgcagtgagccaaaatcgctctactgcactccagcctgggtgacaaagcgagaatctgtttcaaaaaaaaaggaagaaaaatactgcgtagttgtagaaatcaattttccatgccatgcaaggaactgatggcagaatttggtgtgtaggtctgctctttagttagtcaatccctgctcatctctcaggttttggactacattgtgcttcccctgggaagccctccaggctgcctccaagattggatcagatgttcctgcagctgctcctaagcatatcactgttttaagcagcatgagactaacctcattttaatctcattcttatttcattatctctaacaaaaactctaggtaatggccaagcacagtggctggcacctgtaatcccagcactttggaaggccaatgcaggaagattgcttgaggctaggattttgagaccaatctgggcaatacactgagatgctatcgctacaaaaatcaaaataaaaaattagccggatatggtggcatgcacctataatacaagctactccagaggctgagggtggagggtcgtttgagcccaggagttcaaggttacagtgagctatgattgcaccactgcactccagcctgggttgatagagcaagacccagtctctaaaaaaataaaacaacaaaatctctaataccctatgtactgcatttacaattttataaaccttcagaaaccaagtaatacctggatgtaatattataaatatggtgcaaaacattcaatcacgtgaaatacagggttatattagaatgaggtcaaaactatgagcagattgtatggagattggggttagccatgccataatccaacttttattattacagacaataacaaaaggttttactgtagcagtatattaactaatcctaatgaacaaaagaattaatgaattgattcactgacttgttcttttaagaaaactttcgcaatctctcactttctgatccagcaatccaaaaaggtcaaacaagggtctacagcagtgatcttacaaacccagaccttccatagctgcagaagtcagacatgcattgatcacatgcatttgggtgtgctcactgcatctgtgagcagtctgagcgaaaaaataaaaacaaacaaacataaatgtagaatgtgcaaaccccatagctaactctactatacatttctctttcaaaatcactactttattttgagattgcaaacctttttccaaacctgttaggatccagtctcctaattatagcagttagggctcaaagggagggtttcagaaataagccagattagggggtacaaatgtcagcatcacctgactggttaatgtgcctgggaggtggctagtcaagcagcagaaaaacgctttcctgacacagaaaaggaaaatcacaggtttcactccctccaaagcaaggctgccatgtataatctttctctcctttctcttctgccaagccacacagaagggcacagccccaaggagagactaaaaacatatgtggaattatagtaatatctccattagcaactaaatgtattccagagatgtatggcacagtcagaaactttgctcacaggtacaaagccaatctagggggtgggggcaggctgctgtctagacgctcagagtcaagtggaaagaacttcccagggctctgctgttccctctctgccctcactccttatccacaagaggctcccactcacagacagtaagtaccccttgcaagaaagaaatttggcgaccctcccaattgcaagggggctgggctgtcagaatcctgagtttctgtgcatccctccttgactgggctcaaaccctataagcagatacgcagcagattggttcttctaatatgcttctctactcctaggcagccttcatgctggaaatgcatttaattataaattattaatggaacgaaggggctgtagagagtttcttctctgaagcccctgttccatggaggcaggaaaaatcagaagtgtccctctcactaggaggagcatatctggacaataagcaaaaatcctggaaagagaaagaaatgcagttgcctgtagaggcacttgtaatatccacccaagagaaacagcttctatgtactttgagactctggctaacaaatttttgagtgtctcctctcggtcatcattgtgaaggactttggaggaactagaaattgaaatggaaggcaataataagaaaattcttagacctcaaacctgttcctgaatctgcacacagacagaggactcaaggttttgcattagaagtgacaggtgcgttactgaaagctgaagcccttagaggtggttcgaggcggaaatacctactctgcccagcaaagcgaagctaatcctaaccctaacccgaaccctaaccctaaaagaccatgatgcaaggcaatgagctgttacaaaccattctcattttaagatataggatagcattggtttccttatttagttttatttcagtgaaagtaaaaatatgtgaaagggcttacatagattcactcaagtgcagaacaccccaaacctaatgtatcttgttatatagtctgaatggtagtgtcctcccaaaattcatatgctgaaatccaatacacaacatgataactctaccctcatgaatgggatgagtgtccttataaaagaggctgcaggcccttccaccttgtcccttccaacatgtgaggataaatcaagaagatgccatttgggggaatgggccctcactagacactgaatctgctagcaccttgatcctggacttcccaggaccatgagaaataaatgtgtgttgttagctgggcaaagtggctcatacctgtaatcccaacactttaggaggtcaaggcaggagaaatgtttaaggccaggagttcaaaaccaccctggtcaacgtagtgagtcctcatcgctactaaaaattaaaaaaataaaaattagccagggatggtggcacacacgtatggtcccagctactcaggaggctgaggtgggaggatcagttgagcccaggaagtcaaggctacagtgaaccatgatcaagccactgcactccagcctgagcaacagaaagagaccctgtcttaatgataataataacaataaatgtctattgtttataaattacccagtctaaggtattttgttatagcagcctcgacagactaaaaaatatccctatatcttaccctgggatattaaaacatacatttatagctcttaaagatgaaatattgtaaaaattttttaaatattcagggtagcaaaaaagcatttggttggcaggagaataattttaaccaaacaagctagagtcatgaacaaatacattcataacctggcttcttgtatgtcaaagttaactagaaaatacttatatgctaaaatgtcaaatataattttgttttgctggtctaccttctagataaaataactgcatgttcagtgcttgaaaattaaaaatgatcagtctcagattatttcctacaatctgttgcagaggggggacaaggactaaaaaacttcctgtgctcattatctgggcacagaataacctagtgacgggatcaacggaagcctgaacctcagcaacacacaagatacccttgtaacacacctgcagacgtaatccttggatctaaagtaaaaacagggattttctaaaaagctatccctcaggaatttgaaaaaaagttacgtaaacacaaaatctatgcagataaacaacatcacattagattacaacccaaagtataaaataaatatccatgagtccatactgatatatgtaaatgagggaataaataaatgagtaggcgagaataggcacatctctcatgcaaaataacttcaaataatttctgtagatactctgccctcaaggaggggattatagtccccgctttcttttttttttttttttaatttatttttgtttttttgagatggagtctcgctctatcacccaggctggagtgcaatggcgcgatctcggctcactgcaatttccttctcccgggttcaagtgattctcctgcctcagcctctggagtagctgggattacaggtgtgagccaccacacccggcctcctgctttcttaagtgtaggctgcacgtagtgacctctttccacagggtacagtatagaaagtgtgtgtgcaggaggacgaacgtgatactggagatatctggccaacatcacctcatccatgggatcaaggttagtatcaactgcaatgtcatggtgctagtatgtgcccttgatacaatgtaatgaaagtggcacttcacctctggtcttcctctgcacaatccatagccccccagtataaccatgagaaaaacatcagacaaaccaaacaaggtaccaatcccgtgaccagccctcctcaaaactgttaaggtcatgaaagacaaaagaagaaaaactgtcacagtcaagaggagctcaaggagacatgacggctaaatgtaatgtgggatcctggataggatttgaggaaagaaaaaagacagaaggaaaataccaacgaaatcagaagaatgggtgggctttagtaaaaaattgcacacatattggctcattaatagtgtcaaatgtacaataatgatgtaaggtgtttctagtagtggaatttgagggtggggtataaggaaaactctacacaatcttcgccaatttagcacaaatctaaaattaaagtttcttttaaaaaactattataggtaatatttttcaaaacaataattcatatatatttaacttttaactcagatcatgtagtaaaaaagaaaaatctaaaaataaaaagtagtgacacaggtatttatcaagaaaacctgtagttctttaagttttggaacttactagatgttagagaaagacaagaaactaaaaacttacaacattgcaataaatctgaaatcctgaactgtaaaaatggcccagaattataacatcctaagggctcgttgcaatgccctggctttcagtgaatattaacattcaatccaggtgggaacgtgcttgtttcaaaaaaaaaaaaaaatgcacgatacacaaatagcagatggacttaaggactgacttatccatccataactgagtgattgcagtctgcagaattagatctacctctgggttttttgttttgttttgtttgttgctgttgtttttgagatggagtcttgccctgtcacccaggctggaagtgcagtggcgcaatctcagctcactgcagcctctgtctcctgggttcaagtgattctcttgcctcagcttcccaagtagctgtaactacaggtgtgcaccactacgcccggctaatttttgtatttttagtagagagggggtttcaccatgttggccaagctggtattgaactcctacctcaagtgatccacccagctcagcatcccaaagtgctgggattagaggcatgagccaccgcacccggcctacttctgttaaaccaataagtcttaaagtttttctaaatttctatattctctgggtttcttctactccatgaaagaatcatagatttaaatcctcagagactttaaatggctttaggcaaaaaagcatgtgtgaaggaaaagacttagtaggatattagtcactttacttatttagtttattttatacttatggaatttattgggacaaattccaaggttgtgctgttgtttataatataagataaaagtcatacttcttgtgagattgccttttaagccacatcctaccattttccctggcctatgcaatcagtgttataacttaaagctctaatttaatggaaagttcttaacaaaaaatagtctctgcaaagtcagcctctttccatcaaagtggcaaacacacacacacacacacacacacacacacacacacacaaacatgcacacatacacctgcttggaataagaaagtttacttttatatgaattatttacttttctcctttattattttagtaacgaaaatcagataaactaaacactacatatgaggatttttttcttaatacatacaatcattaaaaagaaaacactgaggcacagctattggtagtgactgagggtggaggagttgtgggattggtgaattattccatccttaggggaagctcagtaaacaatcttgccagccttccacatttctgccttgtcacaaagcctcaccatcgtcctacaaaccatcggtgtcctgcagataagctgtcacacagcaggttctgtcttttgtgaaatctacaaaaaatatatccctaacagaaataaacagtagtcaccatatcttcaattgttatagtctaaactaaatgggttcatgttctaaagtggatcttcatctctaaatggtttctaggaagaaaaaacaataataatttagaaacaatgcctgtgtgttggaataagtgtgctctttttttgagcaaatggccaagagaaccacttaataattcagaatcaggtaattccaggaggatggatgaatttcggaggaaatatggttgtaggtgggccagtaataactcataaaaatgtagagtgaatgactacaatactttaagagacatttattcttagggactggaaacaaaacaaattctacaggatcacggtggcacatatcagaacaaagtcatgttgtgccttgggaatataggataactcatgcatcctttttagaaggaacaggataggaaattcatgttcagtggacacatttctctaacgaatattacaggactcctgtatcattgtaggtaatggctgggcaaaaatatgcccctgttctcaggggcttcatgtcgccttgaaggagagagatgaattaacccaagccctagcatcccactgagggacgagaaggtaaagttggcatggtagaaccaaggaagccagaactgattcttgctgaagcaactgcaaaagatccagaaatagtagctcttggaaaagtacagacttggaaggagcatttcaggaataggaccacgtggaggcaaaaaacacatagatggatgctttctgtagtgggagaaatgtttttagaactggagaggtaaggaggtcaaggcagaatctttgtgattgtcttctgtctctatgcaacaattagaagcatcgttttaacgtgcacacctgactctgtggctctcaagatgcaacatctgttccaaatgcccagtgctttcctgtaagcttaataggaagacaccacccaattctccagctttatcatgcacagcttctctgtttgctcaagaattaagaggtgagcgagaaagtgctctcacggagttagagttacctttacaaatgtaataaagaactgaatgaggctgggcgcggtggctcatgtctgtaatcccagcactttgggaggccaaggtgggtgcatcaggaggtcaggagatggagaccatcctggctaacacggtgaaaccccgtctctactcaaaatacaaaaaattagccaggcgtggtggtgggcgcctgcagtcccagctactcgggaggctaaggcaggagaatggcgtgaacccgggaggcagagtttgcagtgagccaagattgtgccactgcactccagcctgggcgacagaccgagactctgtcaaaaaaaaaaaaaaaaaaaaaaaaaaacactgtgaaagagcggaaactttgaattcacacgtccactttcattcaacaagtaggtattgaacctttctttcttttttttttttttttttttttttttttttttttttttttttgagacagcgtctcactctgtcgcccaggctggagtgcaatggcacgatttcagttcactgcagcccccgcctcccaggttcaagtgattcttctgcctcagcccccgcctcccaggttcaagtgattcttcggcctcagcccccgcctcccaggttcaagtgattcttctacctcagcccccgcctcccaggttcaagtgattcttctgcctcagcctcccgagtagctggaactataggcatgcgccaccatgcccggctaatttttatattttcactagagacagggtttcaccatgttggccaggctggtctggaactcctgacctcaagtgatccgcccgtctcagcctcccaaagtgctgggattacaggcaagtaatcccaagtgccaagaagtgcttttaagtgccaagaagctttccagtttttggagatacaagtttcacaattaacatacttcatttttctctttatgtgtgtgtttagtgtgttctaatggactgccaggtagtagatacgattttggttgattgcttttggtcctgctttttccacataagaaaatcaaatttttcttcattatttggtgaggacattttcatgtcaacaatgcactaatgggattagccgttcaccttatgggaattggccagttttgtgggattagccattcatcttaaggagctcactttcattccctgtatcccaaccctactctttctctctcccttgactgcctcctctcctcatatttgtccgcatctttgttaaattccatgaaccatcttttcagttaatgccttggactcctcaattcctgactctcaacccttctttactcatggagcatcacctgtggctggttcaatctacctcctacctcctctgaacctgagcagacaggacatggctggaaaaaaaccctccaaccatacagcctaggttcaatgcatgctctactgcctctcacatcaaacactctcaatccatctcctagttaactcttctacactttctcctccgtctccagctcctccacaacgtcccatctgttaacctgagtaagtcccagcagtgagagaaaaacttgcccccacctccaactagcccaaactgcagcatctcaaccaggattcctggtcctgccttgttcctgggcatgaaacaaatggcctatacctctctacaagctactcaagttactcatccttgtgttactgcactcatcagcagcatttagcacagctgatcctttttcctgaaagtctattcacagccccctcaatccccagccactgttgtgccccttgaagtatctcccagagaatagaaaaatgctttggacaatcgcatatgagtggatgtgcaatgccacatctgagcagaagctgaaagaactgttgtacatgaacaccatttcctcagttcaggcatggcctccagcctggattctggaataaagacttggaagagaagtggggctgatgatagtccatcagtgaggtgcaacataagagaaaaaaaaaatgaagctttcatattgtaagtcattaaaatttgggttttgggtggatgtaattcttcccccagtctctctctctctccttctatctatatcttccactttctccctctctctctctctttctcatacaagtgcacacatgcacgctgcttctttcctcttcctcactgtcttctctctctcctcctcttcatccttctttttcttctagtacacttacttctcctctctatctacattcattgtgttggaaatgcgattcagtctcacaactgtaaatatcatctacatgctcatgtctcctgaccttgtatctccagcgtagacctctctcttcatgtccacactactgtacccagctgtctctaagacatctatctctccttggttgttcttaacttaaacaaaagcagtctcctaattccctcaccctaaagtgctcctctcacaatctccctgttgtcagcacatggcaacgcaattcttccagttacggcggccaaaggaattggggttggccataagttgtctctttctcattcattctgcattctaggaataatcgatttgttggatcttcctttaaaatattcccagaatctggccatggcttatctatcagctctctggtgaagccagcatcctcccttgagcgtattattgcaaaggccacctaagtatctccctaaatatacccacagatccttagagctcattctccaaccagaactcagggtgatctgataaaaatgtaaatcaaggctctcattttcatgctcaaaattacattgtgggttccaatattcatcacggaaaagctaaagccctctcaacggcctactgtccagcacctctctattcttatacccccacttcaccctcattttgtcaactctagcccaactggtcttctccatattccttggacgcatcaaggattctacaactccagggtctttgcacatgctattccatcctcataggaaactcttctcttacttgcttcagatatcagtatgaccacagcaataaaaataataactgtgtgggtccattcctattattccttatctactttattctgaattatttttcttcgtagcaggaatcacgatctgaaatactccaaaataacttccttattcacttaaattccataaagaaacactgtccactgtggtctactatttcactacaattatcagcacctagaaaagtgcccagatcatagtaggtcctcaatgggtatttgttgaatgaatgattgaatgcctatgttgggcaatcaaggagttcacagatatgagcttggagaaaataggaatcactatcctatctagtctttagttggataattaaacagatattttatgagttgataacagcaacagaaataaatttctgaagtgctcaataatacaaactggtaaatactaaacttttgagtatgtgatcccaaattcttaatgcaaaaagctcaaaataaccacatgaaaaaaatcacaaatactagaaagattctgaggaaaagaaagtaacaatgatcataaggttgaccatctatgagtgggtaataacgttggaaaagaaacagacaacagcctgggggttggagacacaatagggagcggtggggagtgtgactatggcaaagtgagtgctgtgtctaaagggaacagccacacctcatccacagtcacatataggccccatgttcccaaatcttttcaatattcaaaagatggtgtgaatgtaagttttcatgtaaaaatttacaacttttaaagatgtccagaattcttacttttgtatactttacagagcgagcaaatgtacctatgggtttgaaatggcccatcagtcatgaagacgtgatctttgtattatggaattaaggtaccattatatttatattactattgacagtgccaccatatttattatgatgactaacactccaaaaaatagctccaaatgtagattagataaattaattaacctactgaaaaaaatatgcattgcatcttgtcactgattcagaaaattgctacgtaatcacagctacacaaaacagaggcaggtgtggtggagtgtgcctgtaatcccagctactaagaaggctgaggtgggaggatcactgaagcccgaagctgcaatgagccatgattgcaccactgcgctcagcctgggcaattctgatttttatagcaagcccctgccgcaacacatatgtatacaaaacagaggcaagaatcaagacctataatgaagagggacatcataaaaaatggcccatcgacaaaatgatgactacccccatacgaacactgttttgatcatcatcatacacccagcacctagcctgatgcctggcacttatttggaactaaagaaaaatttctttgttgaattaaagaactgtagaacagtactgggagtggcagagctccttggtagctcaggcagctcattatgataaatgaaattagtaactgctaccatgaattaaagatctcgcatgagtcaggcattgtgctagggatttacataaattatctcagtaatcctcacaacagccccgttgaggtaggtgttattcttagtccctgtctgcccatcatataactgcagtgttcagaaagtaaggaacctgctgaatgtcaatgcttacaagagcaagaacctgtattcaaactggcttcctcactgccttgtccctagagagaaaactatactggtttctttattctatgtccagtagaactctgttgagcttgttaatcagattgtgtagcatagatcacattctgaagggaaaacagaggtaggcactagtgtgaaagcaggttgcccagggagaagaaaggagaggtataaaaagcgtgaacaagaataaaaaatccacaggtgtttgatttcatttaacacagcctcaagaaactttagagagtagaactgaccctgcaggcatcttctatgctaaataacatctaccatgacagcacttagtcaacaagtcaaggtgctgtatcctttgttacctctgtttgaagaagcatgaatgtgtttttaaatgattcacaatgagcttcgtccaaaatcattaaattaggagggaattctgcttaagggctaaggcctctaaaaaatatctaatttaaatttaaaatacacacatatatatacatacacacacacacacacacacacacacacacatatatatcgcctcaatggcagaagaaatcttatggtacatcaaaacctacgtttgaaaacataatattctagaatatacaaaattatctctgtttgaattaccctatgactaacatccactgcattgttgtgtctgacaaaaaaaaagcgttctaggttcaactcaggtctttgtaattgtcattatgacatggaaggagggatatgttgaaaccaataggaagccaaaaataaaaacacaccctatcatgcaacagacatgtcaggctctcatgcaatgaaaactgttggcaattaaaaaatcccaggctgttgtgggtctgtttgcccatggagatgcaggaagatgctgagagagaatattcttgcagccagaagtaattcctttgtgtgtgtgtctgtgtgttttcagacatctggcaaatgcctcctttattcttacgggaagagtgatgcttcacaactactccagtcacagaattttccatgccatcttttgaacaagctacccaaattctgttctctattcctttaatcaaagtatttacctactttgaagtcgccatacaaaatgggaaattcctggacagacagatggcagtggagtcctctgagactcaggtgcatttcacaggacagtcaggggagatagagctttccacctaggtattgctcttcgctcctcactgtctgggcggatcaatgcttttctcatcttcgttattccgaatgaagaaggtcacagtgcaaagctaggaaagccacattccaaggatttctggtaaagcagtggaattttatggcaatgaaaagaatcaggctggcgaaatctctcagaattccttctccttccctaagtgttgagtatttataactgcacacgacagttttcagataagagccagccagtggatggaagtgatagggagggaggaaagaatataaagttcttggtttagaaattagaactcgagttccaagggctcttcacagagggaccctcttttccctccaatttacccagaggcatgaaatcgagaggtgggcctttattttttgttttttatttttttcttgagatgcagtcacactctgtcacctaggctggagtgcagtggcacaatctctgctcactgcaacctctgcctcccgggttcaagtgattctcctgcctcagcttcccaagtagctgggactacaggcacatgcctccatgcccaggtaatttttgtatttttagtagagatggggtttcaccatattggtcaggctggtcttgaactcttcagatgatccacctgcctcggcctcccaaagtgctgggattacaggtgtgagccaccgcgccaggcagagaggtgggcttttgattgcccattggacacttggtaccttccaagacctctaccggcctcaagaaaataaaagaactcccaagaaatttttaagagccagtcaaaaagcaaagcacttaaaagaaaaggaacatcctatttaaaaaataataataataaaatgacccaagtaaacaaactgggattcaaaagaagcagatccctccaatggacagagagacaatgatagcgatataaagttggaacaaagggtttcaaaggaagtcacacgagataccggggagaagaaatgaaattgttgaactggagagcacaaagaacagactgaaatggaaggatacccacaaacaatgcacataggagccaaaagacagagatacattttcccaaaatggatctgggatgaaaaatggtggaaaaacatcctccaaatgctaaagtatggaagatggaaatagaagtgttaccagtcctataaaaaaaaatgacccagaaagagaacaaagagaaaaagactaggaagaactacattagacagaaaggctgagaatttcccagaatgaaagaaaaaaaaaggcttaaaagtgaaagtactcacaaagtaaataatacgttgatttaaaacagaacaaagcaaaaacaaattccaatttttgagtacctcaaatgtaaacaaaatatgtctaatttttccaaggagaaaaagcaggcgatgtgcaaaggaatgaaaaccaggctaattgcaaagcaacgtaggatacaaaatgcagtggcttctcacccccagcaagtacaagggaaagaaaatcagcctggattttatgtccagtgaaactgtcatttaaatgatagcttaaatccaaatccacttacatcacagaaatcttgacacaatatatttctgcaaggagaggaacccagaacacagcaacataatacaggtaacgacaaaaaattattccgaagaaacaatgatctaaaatcaaatttttaacatgatctagagcccagattctcttagaatctaacacagtgtggggtgattgagagagagagatgccgaagagtagagaaaatgctaaatcaatatcttgttttgaggaaaattatggatactgaaatgtttgatagctaataagactagatacatcttcattaaaatataagtgcagcataaaatgggaagagggaaatttgatgaatcccaactataaggaaaaaaaaacagaagaaagaaaaatataataataaggtcagtaaaagaaacttttaaaattatataatggaagtcaggtaaagcaaaaaaaaaaaaaggtaaaatttaaaaagcatgattgataaatataaaatataaaataaaatgtcagaagtgaaatctataataatgataactgcagaaataaaattagaataaagataaaatattgattaaaatacttttagcaacatattgttgaaaagatatatttaaaataaatggatacataaacttgaaaatgaagacactaaaaattttaaatataaaacaaaatataaatgaaaaaatatcacaggaagcaaatttagtatcaaacaaaaattgtaaatgtcaaaaatggataataaatactagaaaaggaatggaagattaaaaaggtgtaactgacactttcatgtaacatcctaataatacagcttcaaaacatgtaaaaggtatataagtacattttatatatacatactacatatatataacatagtatatccatatacattaaatatataagataaaggacagataagaaaagataaaatgttacagtagaataaaacacaacattcttggagtgataaacttaggaaataaaatgtaattgaggatataggccagttgcagtggcccacgcctgtaatcccagcactttgggaggccgaggctggtggatcacttgaggccaggagttggagaccagcctggccaacaaagtgaaaccgcgtctctactaaaaatacaaaagttagctgggcgtggtggtgtgcacctgtgatcccagctacttggaaggctgaggcaggagaaccacttgaagccagaatgccgaggttgcagtgagccgagatcaggccactgcactccagcctgagcaacagagcgagactctgtccctagccccacccaccaaaacaaataagatatagaagactgaagtaacccatacatgtgatctggtgggtatctatggaaacctatgctcctcaaaacacacattctcacatatacacgtatatctgtatttgtatttgtgaatatgtctatgtatgtgtaaatgtgtccatagctttcaagcacacaccgaacgtttacaaaatctgcctttcataaagagtactttaaagaaacagcagcattcagcactatattctatcggtcaacagaattagaaatcaatagtaaaaagcattcaaaataatgatagaacactaaacatatacacacacacatctatgtgtgtatgtatatgtgtgcatgtgcctttatgctaccgtataaacacaaaacagtcagagtccagtgatagttcaaatgtcacatgtgaaaatttgtcagatgggactgaagaagtgcttaaaagggataattaaaacttcaaatatctttacaaggtaacaagaagaattggaaataaacgagccatggaggcaagtcaagaaacaggaagaagagaaaacagaataaatccaaataaatctgaaaataggaaatgatcaaggtaagagcagaaattagcgaaacagagaaaaaacagttgagctaattaccaaaatgaaagctagtttatcgaaaagcttaataatataaacaaacttctggcaagactgaccaaggaagagtaacatatacaacaaataatgaaacaaataatatacaacaatatacaacaaataatatacaacaaataatgagaacaaatagtctttaaagaggaaaatcatttttaaaataacaaataaacaaagttataaaaaatacaaaatactattttaatagtataagccctggtattaaaaaaagaaattgaaatatttgaggaaaaaaacaaacaaagcaactttacgcaaagaaatgaataaactaaaagctataagtagtaatgaaagaatcactaaaaatctcccacataaaaactcaccacccaagataattttcacaaaaattttagtaattctacttatttaagttttcttcagaaaatatacaattaaagaaagctacccaaatccttttgtatggacagtttaacattcatatcaaaagtatagagtgtataacatcagaaaattataaatcaaattcatttatgaaggtagatgtagacaacctaagtggaatatttacaaaccaaacttagtagaatagtagctatttttcatatacaatatattccactataatagaataatggccattttaaaaatgtttcttttaagattaaaaatgtgttattcccgaaattgaatatatatttaaaaatatattaattttcagagcacattaattataagagaagaatcatataaccagctgtagaaatgccagttgattatttggtcataatcaacatttatgaacaaaagaaaacattttttaaaaacttagaaaaaactgggaattgcaagtaattcatattatctgataatgactgcatgctttaaaatctctcctcaacgctgcatttacaaaaaagatgttagactcatttcctgtaaaatcatgaatgggaacaaaagtttgtaccaacagtattcatcctcgcactggacgtcagtgggccatacaatggtacaagttataaaggaaatgaaaattacaagtattgaaaggaaagagagaaaatggtcattatttgtacataatgtcaccatttttatggaaaccatgtaatttaacagaaaagctactagaaataatagggaatcaaaaaagatggctgaacatataatcaatgtataaaaaagatcgacattcttttataccaggagtagaaaatgtaattgaagatatcatttgcaaaataataataataatcaattaacacataatgctcaaagtctttaataaagctatgattagatctcaacaagtaatgaactatgccagtttacaaatgagataacatgagcttggaagatgtttatttttcctcaaaccaacatttcaataaatacaattcccagcaaagacagaagaatgttgcagattttgatacattgattccatattgtatatgaaagaataaattctacaaaaagcaacgagaatgttgaagatgaaaaatatatgggcatttgtactatttgagtcatactttaatcttgcaggaatggatcaggaaatcaacaagaccaaatataaagcccttggattggctgatgtatatatgatgaattttaaaagcttgtactattttgtggggggaggagtctgtccccttcaagacttttcctcatctccactcctctctggtgtggaaggtaaataaacaggttcactcttgccttctggctgctcctgggtttcagccaaggaagacactagcaggtaatccggagggcagaaggcgagtaaggcctgtatatatgacctccagttccctccctggtaggtaggtccagttcaacctcagcgggcatcagcaacttcacataaggactccactatcctgtccccatcttaattacatttctcaagttgcatgccatttatccctatcaaggtcctggctgacaccacaaatcattgggaaagaatacattgtagctgggcacagtggttcatgcctgtaatcccagtactttgggaggccgagggtggatcacaaggtcagcagttcgaggccagcctggccaacatggtgaaaccccatctctactaaaattacaaaaattagctgggcgtggtggcgtgtgcctgtaatcccagctacttgggaggctgagggaggagaatcgcttgaacctgagagggagaggttgcagtgagctgaggctgcaccattgcactccagcctgggctacagagcaagactctgtctcaaaagaaaaaaaagaatacattgcttccttcatgtgtcaaagcaatgttcccctattggggaaaaaaataacatgagattcccacctcatttcatatataaaaataaactctgcatggattaaaaactgtctgtatgaacaatgaaattctgatacttataggaaaatgtttttgtgatgttggggtagaacaggatttctttaacaggcactacgtaggagaaaccgttagaaagaaaaatatgttgatggcattttgctacattaaaactaatggttttgtttcaatcaaaaccaggaatgatgggtgggtgccagtgggagaagatatttacaacatgtaaaactcaaaatggttgagtttgctttaattttttagaatgggagttttgctatgttgcccaggctggtcttgaactcctgacctcaagagatcctctgtctcagcctcttgggtagcaagaggctaccacaaggtgcaacacaggttgcaccactgtgtctggcttatggttgactgtttaaaccagagcattctcccctgtgtgcccgtgtgtcttcaatgggtcattagggagttgaaacatggggccctacgaaggctgggacagactgaggcacacacccctggcaacatctttttacaccactgtaaatagtctcagcagagaatgcgccaagctatcattatcttctattttacataatatgcaacaaaactgagatgcaatagagtaaataatacaagggagcccacaagaaaatgacagtccactctagtaaaaaacgatatgatgaaaatgtttgtatataatacactctgaatattcctccatatcactaaatattatcctgtaatgccattttaacagctggtattcaatgcttgtattgtatctctaattatgtaatggattctacattgttaaaaattttggttacttaatggaggaatagaaaacaaaacaaaatatcacatgttctcgcttataagtgggggctaaacactgagtacacatggacataaatatgggaacactccacactagggactactagaaggggaggaagacagggggatgtgggttgaaaaactacctgttgggtaccatgttcgctacctgggtaatgggatctataccccaaacttcagcatcacacagtattcccatgtagcaaacctgcaaatccgtgtctaaaatgaaagttgaatattttttaatttttttttgctatcataaaacatgtaacaatgaacaactatatatatatgcattcttctgcactttcccagttacatcctatggataaaattccttgaagtgcaatgcattcccagctcatatttcaggcatttatttaatactacactacccactgctgtgtggtctcctgaaaagatgtgtgacaatctgtgtatcctcctgtgctgcatgagtgggcatttcaccccatccacagctaatggggtggtaaataacagtgacttttaagagatggaagaggaaataatttataaagtaccatggctgcagagaaaactgaaatcttcctttcaaagagaaaaaagaaacaacaggtcgaccatccacactgtgattcacatacatttgacagataattattgtcagctatactttctgtgttgctttcttcagcagcttggaagacccaagtggaagacacaacccttgccagtcaatagagtactactagccatgcacagagaaggtcagcaagtcaccccatgaaacagaaaaggggaaatcagtgtgtggaccagagagtacacattgcaggcaggaggcacccttgaggtgtgagctggcagagaaaccatatgagaaacaagcttagttagacccttctattgatgcttgattttgccttgtacatatttcactagctaaaaagactaataggtatccaacataacagtttttgctccaaaacattaaattcaccaatgtatgattgcttttcaataagggcttcatgtatccttatttttgaaacgtttctcctttccattatgtgacaataaacaatatgtttaggagtttcatttccgtggcaaaaagaatgctttgcttacttcatgggtctcacaacagggcaggtgggaattgaagaagccaaagcaaaatcatgtacccatgtgaaagccagactccttttttatagtgaaatgtttaaaaaaaaaaactattttggcttaaatgcacagttttcaatgtatatgcaaactgtgggggaaagaaagataccaaatcttttttttttttttttctttgagacacagcgtcttgctctgttgcccaggctggagtgcagtgatgtgattacagctcactgaagcctggccctcctgggctcaagctatcctcccacctcagccttcctagtaactgagactacaggtacgtgccatcacactcagctaactttttagtcttttttatagaggtggaggtctcgctatgttgcccaggctggtctcaaactcctggatcaagtgattctccttcctcagcctctcaaaacactgggattacaggcatcagccacgaggcttggccccaaatctttaaaatattccccatgctccttttcttttttaaaaaatgccaatcttgattggattttccctcactccttcatataacaatgttatatattttaccattttggcactccacatgaaagcctctgaaacagagaaaaggccccaatgtaaatacagttactgttgttgttactataaaaaaagccatccatggaggtataaagcttacctaaagcaaacataattttgacaccaacctttcctttttaagactgtgtgctttaactttttcctactaaaactctgttgctagtagcattacttctgtttcatgcactcacaataaatcatagaaggcccactttcctgcctcttctataaaactggcaacaatgatgttaattgtgcatgaaaaatatattaaaactgtaaatcatctctattttcgagcaggatgcaagaaacaaatgtaaagtaacaaatcaagtgctgtttcttttgcccatatttggccagaggccattattttaaaagcacaaaattagagcccactttcatcaattaggccttattctttggctcttgaatctaatcaagaacatgtaaaaatgtatccccaatcccatggtaatgagcacggattaatcctgttaatagtggtggaaggttctttttatggtgcattctttagagtattcatatatgtggacatttttgtgccaactgtatataaaaaaaaccaaaacatttctttttgatgctttcttctcactataattatggcgtagtgtttgtcacttcctaatggctacagcaaaattctgctttctattccaagcaatagtaaatacatgtttttctgcaaagatgaaaagacgatcttttatttttaaatacacctatggatactcttttacagtcttgccatgccaatcaatttcaaagaataccaccgataaataatattttgcagcctaacttagaaagcagaaacaaacataaactatatttaccaaaagactattcatgcattaaaaaaaaagaaataattgggacaaagatctcctatcttccctgtatatgttactctccccttctttaaatgttccatgtcttgataaattagcatggcatgctaatcatctgataaactaatccaatggtcagcttgttccctatctaatccattctcacttctttggtgactcttggaaatgagatggccatacactaaataaataagtctttggtgttcagaaattcaggcagtgtgccaagataatgtaggggccaatcacccctctgcagaataaatcaaattacaccctctagatgtctgcttaggctgaatcaagcaagttaacaaataactggcagtctctgagtcattaatctcaaaaggcaaatcagagcttgtcactttgctgcttaaaaatgttccttcatgggactccagctgtcaacatgataattcccaaataggatcaatgagataatacatgcacaccaacttctgtagctttggagcactttggggatggtcaagaactgtgcattgtaggacttgtcccttttcactgtcccattggtgctccattgcaatttggtgccaatctgtctgcacaagcatttgttcaattgctccacattcttcagtgttccccaagcacaacaattttctcagattctcttcttctataggcttctacagtctacctcatgttttctctacctcagtactgttcacattaggggccagatcattctgaggtgtggaggctgtcctatgcactgttaagatgtctagtggcatcccttgcctccattcccagtaacacactccatactcacaacaaacaaaaatgtcttcccacattgccaaatgtacactggaagcaaacctgtcccctccccaaagttgagaaccactgatatacactaggaattaaaaattgagtaagacaatgctttgacttagagcagggtttcacaacatcagcactgtgggcatttgggggctggatgattatgtttgttgtgagggctgtactgtgcattgtaggatgtttagcagcatcctctgccttctagatgtcaggagcacacactgcccagatgggataatccaaaatatctccagacattgctgacacccccttgccagctgaatctagaatcagtaagtaaaaaacgattacacatgcacaatacagagccaagtttctcaatatcagaactactgatattttggactagataattctctgctgtgtgagtcgttcttctgcattttaccatgttcagcagcatctctggtcaccacctactccatgtcagtagcacctccccagctgtgacaaccaacaatatctctagacattgtcaaatgtcccttacagtggggccaaaattgctcttagttaagaatctctgctatgcctaataacattcttccacgtcttcaaaatgccattggaaatatctccacaaccgctaaacccatctgagagctccagatagagttggctgccctgtcttcccccaacaacttggacttatccctcctttattcatccttgccccagtccagcatcattgctccctgtaggtccccaaggtaatgtcaattcctcaaggcggccattcagacatgtggatcagcagctagcacacttggctcactgagtgatgaggggatggtgtgagttctcctaagatggtaaaaatggagacaggagggcattcattgtgtcaaaagcagcagctgagtttcgaacatggtaagtttgaaacatctctaaggtggttctgtttgtatggagtctgggggagcaactgagattgacgcatagaaacagaccatcaccacaatcattattatcgccataaattatcatcacaataattgttatcttcattgctatcatcatcataaccatcaccatcaccatcatcaccatcgtcatcacgataaccaccatcatcattatcaccatcatcactatcaccatcaccatcctcatcatcaccatcataaccatcatcatcaccatcatcatcatcatctagtagtagtagtgtataattgtgtatatttattcatattttgattgattgtgttctttggccactgggctgacagtgttttgtttacattgatttgattttaaagatctacggctaataattccttgttgcacacacacctcctaatttaactgaacacagatatactttgcaactatttcatcttgaaggtcacttcagaaaattatcttgcataagccatatggaccatggttttaaaatcaggcttttatcattttttcctaattggtttttaatgacagaaaggagtatctgtttatatgtggattaaaaatatttcacgtccaattttctgtttcatgaatatgtacatatataaaatttttgccatcaatatcacctctaaggtcactaaaaggcaaattgttggaatctatacccagattttgagtcactggaagcctggatggagcccaggaatctgcatttggaaaaaattcatagcaagtttgaaaacaattgctgtctgacatggaacttctgtactcttccattcatgtctatatggtaactagaaaatccacatgcgacttcatgaagttggtcctttacatcaggggtcagaaaactttttaaaataaagggtaagatagtacatattgtagactttgcaggccatatggtctcttttgcaactactcaacttcgtctttgtagtgtgaaagcagacatagacaatacataaataaaagggcttatttgtgttccattaaacccttcacaaaaacagcagtgtgatagatttagtctacaggttatgctgtccacccttgcttcccatctctaaaaggaggtcagacccccttttagctaaatacttgtcctggttgagcttctcagctttcataagagcacatctgtcaatattctctctagctcgactgatgactgaaggatgctgccctgtaattaactgaccatacagtgactacacttcatacggttggctgagtgcaggacttcaaattcactgtcatttggtttctttaacaaaacttagctaagagaatcgatattaatgtcaggctgtggacttcagccttgaacgtgctcctctgtctgtctgaaatgactctcctcccagcaatttggtcagttactgattcttcaaatttctccttagtgcattttcaccctctcagtctgggacacatgcttctcccagatgttctcacatctccccaacttgttgcatcattgcatggattacactaaatgatgattccagttagttgtgcattttcccctgtatgttctgcaaggaaagtgatggaacaacatttagcaaagtggcctgacaattagaataagttcaataaatattcactgagtgaataaataaatgaataaactacatgtttgctaatgcctggggcccatatggaagcaaatgttagcaaacaatccaatgacacttaatgtcgtaaggatatttagtggtgcctacgtggacttacagagctgcacaagaattgaagaccaggttatatcaccagcctgagaactcactcacagcatagtctcacaaagaagtctactgagcagaaagagcaggctgactgagaaggacctcctttgctttttgaagaattccttgtgagagaactggaagctcttttgtcagccatttgcctaatgttctacaacgaaactcttcccaaactttcaccctgctaaacgcttaggctgaagtttggccaaattcatgttcaccagatcagctccccaaattggcttatccttcagtaaacctaacctttcagttagaactcttaaaagagatggcaagcacagcatgttgcgcccactcctaaacagcctcattcatttgaggtcacgtttcccatctggcattaaatctcagactatctctgatttgccaccagctgacagcttccagacccaggagtgtcccaggagggtgactcccaacatagaactgcctggataacatcctaatagaaatatcctcatctgttcctgtcactttatctctctatgtcactaagagctacagctgtttacaaaccaacaacaacagcaactgatatacaagttttctcatttctgaatgtccaagttcctctttttagctgaaaaaaggaaatatcctaggtaaggttttgccccaagttcatctcctcttccatgaagcagccatgccattctttcttgtttggtactatttgtaatataagcaacaatggacatcaatgagttttgcttacctagcattcaattttcctctggggagcaatcttacttccatctaccctaagcctactggacttacccaatctcttctcatttctgaagagtatacataacccaagcagtccatatcaattcaagtatctctttccactggatatagacattggttggcatgcaactaaaattaggccagtacgcatagttgctaggccaatgtgcttctctgagaaaaggatgacatactaggaaatgctgttgactgcctaccaccacacacggacaagcctctctaagaaagccaaagaagaaacatggcgccaaagtgccagattcctaacagcaatgattagacctgaggacaccattttcgaaactaaatgcaccgctagtaaatggaacccgaaaatctcttcttttcccttaagtgaattcaacctgaatttctttcacttgctaactaattgttcctaagtaattaaggattgcaaagtctcaaaatatatatccctccaatggagacataatatctatgtagaagttgggttacaatctggccaaatttgaaatccatgtctttttttagaaacaaggtcttgctctgtctcccaggctcatagctgccatgagctatgattgcaatggtgctatcatagctcactgcagcctcgacctcctgacctcaagcaatcctcccacctcagcctctcaaggagctgggattactgtgctcagctgaaatccatgttttgcatattatgccacattagttattgactgctatgtaacaaataaccaaaacttaacagtttcaagtaatgtatttattttatgagtttctgcatatcaggaatccaggcacaaccttagcagggtccactgctttgaagtctctcactgatgaaggtgttggcctgagctggggtctcattttaaagctgaataactgaggaaggttcgcttccaaacttatgtggttgttggcaggattcaatgccctgtggactgctggactgaaagcctctgttccttgctggctgttgtttcagaggcagctctgagcttcttgccatatgcacctgtttaatatggctgctctttcatcaaagcatggaaaccaagaatgcaacaaaaagggtatactagtaagacacaatttatatgcttatgtaacataatcatggaagtggtgttccattatctctaccatattccatgagacacaaacaaatccaatgtcctgcctacactcaagggggaaggatttacacaaaggcagtgtctttcacttggaaaatgccagccctgagagactggaatccaagacctacttctctggtgagcaggggagataggacatagcctaaaggctaaaaatgtgtcaggggagctttgccctggacagagcagtgggtactgagagaggattttaggaaccaaaaatgcagacatcacctcttctggcttctggcattcttaggcagcatatgtacgcagaatatacctaatccagactgcattcatttctggggctttgtaactaattaccacaaacttggtgacttgaaacaagaacgcattgtctcactgttctggggcagagtccaaaattaagatgattccttctagaggctcttaaagaaaatccatttcatgcttctgtcttggattgagttgttcttggttcctggtggtttccaacagtgctccctggcttagggatgaatcacttcaacgtttgcttccatcctcacatggtgttctccctgtttctgtctttgttgttgtgtctcttcttacaagaacaccaattatattgggtttaggatcttccctaacacagtatgaactcatcttaccttgattacatttgcagaaatcctattttcaaataaggtgaaattcctaggcaccaggagttaagacataaacaatttttttgagagacacaattcaaccataacacaagtcaactcaaaactcatgccaagagaaaactttactacctatgacgtggcctgtcaaagtttttaaaacacagattctaacctatgctctgcagtcttaaaataacaatatcaaatctcaaagaaattgattcctctaaagctaggacctcacaataccttctcatagctactcaaatttagataatgatgatggcgatgactctgatgatatttttgatgatgacaagtaactacaaaaccttaagttgaatgaaatgcaagaggaagctcattttatcctaagtcttagaataagctttccctaatgatgagctccattattttccaacctatgaactttaattaatttcttggaaatgattccttctgcattctatcaaattatagaccactgcatttaaaaacaggcaaccagctgctttctcaaaactataaaccaattagtttattggccattctatcacacatgtatgctgccttccctccttgtaacacctcaggggcttggcatttcagggaaacgtgcagtaaacagactcctggcttggctggtgattgttgtgcattcagcatccggtgggaaaaactgagcttcagcaacaaatggctttgccttgctgtatatgctgacattttgtcataggaagtggaggtattctattttctttttaatttctaaggcatattataaaatatattacttttaaaatattacaaaaacttgtggcttccagctcaatatatataagccaagggtttaatgcatttgacaaaaaaagatctcacataaactctgggtatattcataacctgtaatgtgatgcatgagaatagatgcttgacactgaagaggatgcttgcaaaagactacctagaaggaacataccaacatgttttctaagacttccaaagctatgtattaggagagaaaggaaacattccaaatttcttcatctctgtttgtagagagtgctcaggtaaatattgccaaccctttctctgataatgaaattaaaaagctgtaaacgtctttatcggtcaggttcaaaaaaaaagctgggtggccaggcactacaggtttattcatttgttccatgtactgaagtatatgattcattcttttatctcaaaaatgctctgggtcttcaaagggtttaccatctactggggagggcagactcgtaaaatggtgattaaattcaacttctaggaactcaggggaggatacttcatctctgcttagagtgccaaaaggttaatgaacgggaaaatactgtatggtgaaagagttttggtgaaatgacctcaaaagctccttctccttggaagatgttatcattctgtgattaaagtctaagttgactctatcgtttccgtccaggtaaatttccagtatgatattcaatataccaaaatcccctcttataaagcaaaacaaaaaaaaaagtataaaatgcaaagatccctgtagaatgtgcgatggtgaaatttgttctcattattatctgattttagctcaaaatgaaataatttgttaacattttaatattcttgggaaagctgaagttttctccctaaggcttacttctctatttttaaatgtaaacattttagaaacatgcaaaatagtattataacttgatttcatactagttatctggattagtacatttccaatataaaattatgaaagtactttactagaatagaaatttggaggagactgaaagcttttgtattaatgatttaaacaccaggtgataaaaagtatatttgaatttggtaagaatgggacctcatgttctttgatttaactttattctatagtctgctaaaaagaaaagataggcattagaattagtttggatggaattccatttatgaaccctccaatgtcacaatgtaacaatttaaaaaatacccaagtgagtattttgcatgttaaattacaacatcattgcaccctcctccagttttgtcttagttttatctctcccttctccccagttttgcatcttttatgtctccgtgcagctaaagaagcaataaacaagaacttccattttaggaaacatagacagcatttcctcactgcacaaacatgtgtttacgctctgcatattcactcaaggctgggtgaaaacttttctatcaaggatcctccatagaaaacatccactttcagatttgcctccattttcttttccctgaaatcctaaagcagtccctgaagacactgcttttgatgaaacgttggtttagttgggtcacatatcaatggggctttcccactcacttttccagcagcgggtttagatctctccagatatccacttagactcacccaaggccttgtctatgctgattgcaaataatgatttatttactaataatttttaaatgagttatctaaaatgcctctaaagaaaataaggaatggaaaagagaaaaaaatacccaaagagtctagattggaattaggagatcaatagtgtcattggcccgactggaggctaaagtccatatgtgacaggcaaatgggatgttaggtgaatattagatgttcccttgttgagtgaatgactgattatgtcataaaagacagagaagagagtagaatgtagctaaagacatccattttaaggaagaagaaaaggagtgttcaagaacctacaattttcatatcttgttgaaacccaccacaagagctcctttgcctgagataaatcagtacctgctgcattctttctttctgatggcaacaggcactttccctgaggcaaacttgaggaccgtgcagacaccatgcacagtagaccaagaggatgtctggcttgaaggagactttgggatgtttggggtttcagagaggaagaggatatagtttaggtgttgtaaaacttggcacttcccagaaaattgtaacatgtttgatcttaactgaattgtggatatttctcctaccgggtttccttcaatagcattcacacacagacacacacacacacacacacacacacacacacacacacacaccacagaccacataccaatgcctaccttcaccatcaaaagtcatcgtcagatacgtaaagtctaacaaggaaatgtttctcttttatttcttttttagatacagggtctcactgtgtcacccaggctggagtgcactgctgtgatctcagctcaccatagccttgatctcccaagcacaagtgatcctcccgcctcatcccctcaagtagctgggactacaggccagcaccaccatgcccagctaattttttttttttctggtaaggacagggttttgtcatgttgcccaggctggtcttaactcctgggctcaagcaatccacccacctagacctccccaagtgctaggattacaagagcaagccaccactttctaatttgtggaaatctggacctgcttctctgaacctcaatatagaatattagattgaaataataaggtggagactacactgtctcatctttgctttattttaccagtagcaattgcatgaagagatcactcctttggagtttttccctctggttcccttgcctttaagctgactgtgtgatttaggtagctctgatttatttactgagagtggatgtttttgatctcacaaactctctgtggctctcaaatctggagctcacaacttctcgatttctgtttgcagtttggctgtgactgcaccaaggaaaggggtgcttaaacataaagacaaaatgttaaactaactcattatgaaaacagcctggttttaggagaaccagccaacagtctagtaagatcggatctactctcaacaatggcttccagtaccccactcaggcaaagaatcttgcaatgaaagataaagtcatgggattaacattcaattaacctgacatcaaagtcttaatatgcactaatcttatctcttttataattatttcttatatagttgtttactcccaaatcacaataattataaaacaaattcataggatgtataatcatattactcttatttttaatagctgaggacactaaatatttaaaggttaaatggcttggctaggccaggcacggtggctcacacctgtaatcccagcactttgggaggccaaggcaggaggatcacctgaggtcaggagtttgagcctggctaacatggtgaaaccctatctctactaaaaatacaaaaattacctgggtgtggtggtgggcacctatagtcccaggtactcggcaggctgaggcaggagaatcacttgaacctgggaggtggaggctgcagtgagcagagatcataccactgcactccagcctgggtgacagagcaagactgtctcaaacataaaaaaaataaaattaaaaaaataaataataaaaattaatagcttggctaaaatagtacggaaaataaataaccatgttcaaaccagcaatattaattgacaacaaataagactacaacatcttaggaagcaagactccacaaataaataatgagctaattgttttaaatggccaaatattccagtggactagttgtacctaaagtttctatctctgacaatttctaaaaaaaaattcttatgatatgcactatgtgaaaatttgatttttaatatattctaggtaatctgtatttgttcaaattatgacaagaatctaaattgcaaattgaattgaattaaaattcatgtattggaagattatgtacataagggaaaatgttctttgttaggaaaagatatttcttaattattcaaacaggcataattcatactactaaatagtattattccaaacatatgtaatttctaaaccctcaataagattattactcagtattcaaattgctgaaagctttttgagctgggggagagacacatgctatcggaaatccactccagtttaactgtgcttacaaaaaatactaaatacttttcaattaatccgtgtcagggagatctttatttaataatctttcataattatctttacttataagctgtgtctacacaatgtcaaacatccaactgacagatgaaaactggagtaatttaattattttcacctagttgcatgttgatgttgattggttaaaacatctgtctcaccgtgttaacacagttttcgtttttcacctatattttgtgactgtatgcgtacaattggactttgtgtgtctagacaagaagagaaagaaaattaatttctctttaatctcacacacaaagaatggtgttactgccttttcacggtttaaggaacttttccaaaaaagttaattctaatcctttcctagtgattaatttctctaattcacatatgctcaaaatccatttgataacacaggctcaaaaggactaaagttaggaataaagcagaatgataatagtgggctctttttaaaaatgttattcctcccaaaattcccttttgttaaaaccatactagaaactgccagaaatgatgggctatttattggtcttacttcttaagcttacccctctactactacaatagttatgtcacagacgttcaacatttattatgcctagactaatatacataccagacccactatgcacatgcaattttgctgaaattttcgggttcccttttctgttattaatgatgctgcactaacatcagattacagggtgcttgtacgtgctggctactaagcactttatatggattaaaaccttaaacctctcagccgcctctattttagacataaggacactgtggcccaagcaagctgggtcacttgcccataatgactgatctgctaaggggctaaactggcatttcaactccagcaaacaagttttggttggaggaggaaacaaggtgtagcttgaaaaggtcagagaatcactttgcccagaagagaccacagcttaaggtgtagccggaaggagtggggaacacagaggattttgtcagcagtgtttgtaagtaggaaaataagacatgtaaaggtgcagccgcgatcttgagtgaaactctgtggagacagatgaggaaagaacaatttcggtattttgttatatgtcattcaaagccatctactctggaaatctgttatagcttcctgaaaaaattctaaatgaccctttggtacctttctgtgtcaaaacagtattatcttttgaatataccatttaggacaattggccatgaggctatattaacatgatgcaaaatgtcaaatttgcaaaatgtcactgggcgtggtggctcacacctgtaatcccagaactctggagtttgagatgaaaggatcacttgaggctagggttccagaccagtctgggcaacataggaaggctccaactctttaaaaatttaaaaactagccagtcatggtggctgaaaattgtaatgtaaatctaatcagggataatttttcatcgtttcttttttaaaaaatctgccaccattttctaatttgcagacacctggacatgcttcttctctgaacctcaatatagtagtctcagcctatagtcccagacactcaggaggctgaagttgggggatcacttgcggccaggagttcgaggctgcagtgagctatgactgtgacactgcactgcagcatgggccacagtgcaagaccccattcagagacagggtacctatctctcaaatttttaaaaaatacatttttaaaaatctgaaaaatgtctgccctaaaataagaattgatatgatctccttagcatgcttgagcaaggtagaaagctctaagtgcccaagggtgttttcaactagaaattcttggaagtagaatcccagaatggagaggggtccagaaggcccgaaaccaaacaacttcagagactctgaacttttgttttcagagtaatacttcattatgaatttcaaataatattacagggtgataaaactcttccttagttttctattaccactaagacaaatctccacaaacttagtaagcttagaacagcacacatttattcttttacagttctaaggtcagagtttcttccatggggctagaatcaaggtatcaggagggctgtcgggctccttgctggaagctctaaggaaaaatctgtttccctgtctcttccggcttctagagactgccacctgcgttcctttctcctggctctctcatattcaaagccagcaatgtccaggtatctctttctcacgttgctttacaccaactctgatctccttttgagtcttctgcatccacagtggagggtctctgttaatatatatgagaatccaggatagattctccctattggaaggtctgctgattagcaaacctaattcaatcggcaaccttaattcccctttgccatttgaagtcattatttaaggcagagtattgaagaagtcaggtgccatgcctccaacctattcccaggttccaggaatgggcgagttggctggggggtaggggtggagggcggtgcttgcacatctctcagggaccatgacttttctgcctacaagtacctatctctcaaaattaggaatgcttgtatctctcacaatctcagcctctaaggcatgtctggcatataatcgatgctcaaaaatattttggacagtgaagtgaagtagtgcctgctcattccagacaccttatggtgagaactgtccttctccccctgccaactggtatacacaagaacagcccagttttatctcttcttactcctgagtcaagtgggccaatcaaaaccccgccctgggatttttagtatggaattatggaactttgtccctcactggtggtactgagaaaaacaaaatgcaactaacaaaaactgcagagaaccctcttactgccatttaaagcaagcctatttccagaaagaagcaaagaacgagatatgaagattggtgatgtccttggattcaatgcttccaggtgtgtctaaagtctagctgcatccctgccattctgccaatctgatttctcaacttttacagtaagtttggatatcccatagcccttctaataaatttccattttttccctcaaagtcagattgaggctaggttgccttctaccatttgaacacaaatatctcttgactaatgcagaatgccagaaaagtttgtaagaccctcagaaaagatgggagctattcaaggatgaaaaccatgctataaattatatcttgaattagatccagtggtatctataaaagaagcgaatacattttttttttgtaaaatcgctagcaaagctggttgactttccagcttctttccctgttgttctcctgccaccctttcatcttaggtagcttgtctaccctagaaagtatagggtcagcagctgtggataacataaaaaagtttatgggcccagtgcaatggcttatgctggtaatgccagcattttgggaggccgaggtgggaggatcacttgaacccaagaccagccagagcaacatagtgacaccccatctctacagaaactaaaaagattagccaggtatggtggagtgcacctgtagtcccagctactcaggaagctgagatggaaggatcccttgagcccaggaggttgaggctgcagggagctatgagtgcaccattgtacttcaccctggatgacagagcaagatcctgtttctaaaaggaaaaaaaaaaaaaaaagaactttcatgatatggcactgccagaaacagcccatgctaaagcacagcttctgttaccacgccacacttaacacccaagtagtaacaacagcaacgattgacaccaaactgcttaacatagatttctgtgttcaaatgttccattcatcagatgctttaatagatgaatcccttccatcacccatatattcttcatggcacagctcaacaacttaacagcttccatcaagtttttcctcaaaaaatagcctgtccctgagctgtcacagagctttctttgttccctaactaggatgctctggcttattatctacctctaggtttattaactgtgcaaactcctacaggtcattgtccatgtcgtgtctgtttatatttcatcataaagctccatgttttcaccaaataggtcctcaatcaacaatcatagcaagcttacttaagtcatagtattcaaagagtcaggtgtcatcttgggggaaaaagatgatagggacaccttgcatccaataatctgttcttttttaatatcttcctttttcaattgtattgctagcaaaaaaaaaaaacaacccaaaatttcacttttctagaaatcataatggcatttgctgttatgctacaatgaaaatacaatgataatgagtggtgctttgttttgttttgagagggattctcactctgttgcccaggctggagtgcagtggtgcgatctcggctcactgcaacctccctccacctctcgagttcaggtcattctcctgcctcagcctcctaagtagctgagattacaggcgcacaccaccatgcccagctaattttttgtatttgtagtaaagacggggtttcaccatattggccaggctggtcacgaattcctgacctcaagtgatccacccaccatgacctcccaaagtgctcggattagaggcatgagccactgtgcctgggcgataatgactttcatttatattttcctttatatttcccagtatttttagtcccatgatgaagaatggaagggcttctcgcccctgaaatctttcaagaataagaccttaagatgtatgtccaaggatccagagaaaaagcacaggtgtaggtcactcaggaagtggttccatgggtctgtccatttcccaaggcaatctggactcacttgtggctctttctcctccaagctttatatttaatatgatatcttgtctgagcaactccttcaaaatgtgtcttttatttttcccttactttttaacctcacttctaaacagtatcactggttctcattaaaaaccttaagtgtttccataactcatctttctgtgttcagtctccttggggaccaagacgaatcacgaactgtactgccatcccctcatgtatgaactcaagtggacttagtatgtgagactggaacttctcggcttgactttcacaatttatgtttaatcaagctaccaagccatattctgcattgcttcctcaaagtagtcactcagtcacactctctctgctatctctctctctctctctctctgtcacatacacacacacacacacaccatgcagattcggtcaatcggtctccaactgttccttgtcaacaatggcccacgtgtcctactagagcttccgactggcttgactgactttgaccttatttgagcacctatcaaaaggttaaatatgcaattcaagttaattaattagcctgttgtctaacaacaaagagaaattaataacctatgaaaatttaaataaagaaatttgtaaggtaggaaatagttataaagacccaagcctaagtttagtagatcatgatgccagtttaaatgaaaagactcaccttcagcaagacctgatttattttaaagggaattataaaaagtattgttttctacagaaaaaaaatatatgtttcataaactattgtactacgaagaaatttccaacacttttcctcatgcaagttagttcttaaatgtaaggataagtacgtatctaaaatagtctatttttgtatttttaatatacctacacattttatgaaagtagaaacatagaaatttgagccaatctgatcaaggcagaaagacaaagctaaacaaaaaaagtagatttttgctgttgttattgtttagatttgtctttctggctttgtcagactggtcagagtggaattttgaattccaaataataatattgctctctctcctgctaaataaaagcattgatctgaactgagatactccctaagagaaggcctttggagagaatcagcatgatgccaacatttcaatatgttgtggatgcggagttcattcatttagtgaataattaataattaaacatctaaagctctgcattggttctttttttgtttttgtttttttttgagacggagtcttgctatgttgccaggctggagtgcaatggcgcgattgtggctcactgcaacctccacctccttggttcaagcaattctcctgcctcagcctcctgagtagctgggattacagacacgcgccaccatgcccagctaatttttgtatttttagtagagatggggtttcaccatgttggccaggatggtctcgatctcctaaccacgtgatctgcctgcctcggcctcccaaagtactgggattacaggcgtgagccaccgcgcctggcctgcactggttcttcgttgatagagttaagaaaacaagcaagcaaccaaaaataaaaactcctaacccaataggctgtgacttgtggatggtacaaacatgcagggctgtagctttgaactctcaccagcaaaattctaaagtttacacatcgtggggagatcgattctaccttttcagtcactattagatttctgattcccttgtcaagatcatatgcacatattgcttcaaaaagcctaaagatctaaacaagtggaactgggtttattatgaagtttggattactttttcactgaatagcatttttcacatatttacattcctcaaattttaattcaataccgaattgcaatgaaacggccacaccgtttgtggtctccatccacacaattgtacatacagggctctgcagtcagggaggctattgattctttttcatgggtggtctcattctgtccaactcctatatgaggaggccttctatttgaagtgcattcattgttgccaaggctagctctacaaaatcaccagactctagcacatccaaagtattatgaaagcaattttaaccctttgtcctgtttggggggttttctccccatttttgtcttcctttctttttggtttttgtttgaatagttcattatgagaaagatctcaacccaggtggctgctcaaatgagaaccctaattgcttttgagagctcttattcatctcacacacacacacaaagagggactgttaggcacggagacagctcagaacaccccatggaagtacagcgtccaaatgtcagtttaactccttgaatcacattcagacctggactttatgagataattgagaggtctgtcaccataacgacaagggcaatatgccagaaaccactaatataatgaagcagaatcctttaatttctttctctgggctgttctttgtaatctcaatgacaatttgtaacctcagtgacacacaaccctggtatggtttttcatgacactctacttaaactatctggcatttatatggagaaagagtaatctgatagatgcaaaacaattttggagatcagtggattaacgtcgttgttgatttactattttcagccaaatcttactgaaaaatgttttccagggattgaagtttaaaaaaaaaaaaaaagaagaagaagaaatttctccataaaagaaatttatcacactttccacgaagaactttatacaaaggacacactctagtttctacattagatacatctatcattcccacaaattaacttcctttctttccaggtatattttattctctgttgttctttctcctcatctaaaaacggcatatggaaatgctaactgggaaatgtgataccattatggcatactttagtctggttattcttccaaggaaatctgaatttgaaatctatacagacataaaactattcatgttttactaacattaggttaatatattaaacgttattgtgtctacagactttcattgttgttttatataaaaaaggaaatttttaaaaatacaaacgcattcatctctaatgtagctagaatcatctgattacattttgccacttgattgcagcgaatattggaagaaaagaacatccaaatttacgttaagaaaaccgattctaaacaatgaaatccaaccattgtatgaactatcccctacttgtatattaaaaacaatcaagtttttctttgaaaactcaaaaaaggtgctaatatcttaagtcattaaggcagaaagaaccattttctctatctttcagtttgcaaactggagcataatagtgtacttaattctattatttttctatagattcattcctttacagatgattcaggtataacatgcaacattatatgctcatatttattttcatctgcaaataagcattataaaaagttaagaaggcaatatatgaaaataattaaagttattatttatagttttgtccagtcagtagatggcccaatacatacaagtggaacatgtggtaagttgctgcaagaattgcatttggaatatgaaaaataaattaaaataaaataaacgggttatagaagagatcatgcatgagacattataaaaccctcctagcaaatctctctacacactgcacaagaggtattgttttctgttccagtgaggtactcaccatcttccgtgggcacgtagatgtttaagtaaaggcagtcttcattttgatcttgaacataggtcatcaaagtatccaaattggcggtaaaccagatgggcagcatgtcatgcagtaaggatctctcatccaggtgctgggggcacacagcagcaaactgagtagtatttcggatgccagtccaggaggacgggggttctgggggctgaaaccgcctctctccagtggggggtgaggcataggggacccctaagtactgctccactggacccaagatctcattgggtaacggtgttcttaggccccggattttgccataatttgtgttgacaactggatactgtgcttggctgtcaatgagggtgaacttgatggcaagagcagttaaccacaggaggacattggagtttaacatgacgcagaccggggtgaacaacaaaggaagccatagcagtccctggggccgtgacatggttcaaatctgcatccacatccacagctgtcccagtgatgtggctccaaggagacaaagcccagaggcgagcctgcagagagatagggctttccagggagcagtagacctgggagagactctcagactgatcacagacagagcctgaggttaagaacaagcacagccgttttcttggcagcccattgcaaggaggcagccctcccttaatcctgaaactggattccagcaactgcaatgctccaaggaagctgtgatcatccaacacctccagggacaatttcttatgaaaactccaaggcagcctaaaagaggaagaaagcagacaagaataatgaagccacacaacgaccacctagaacactggctggctcttccacgaaatccacaacatctctctatgaaattcctattcatttgtatagaaatgtgtatagtgccatctccacatagtaggcaacagcaagaacatcacctgtctttatttattttgttttttttagagatggtgtcttgctatattgcccaagctgcagtgcagtggtgctgtcatagctcactgcagcctccaactcctgggctcaacccatcctcccgcctcaccctcccgagtagctgggaccacaagcatgcaccactatgtccggctaattcgttggatttttttgtagacattgggtcaccctatgttgtccaggctggcctcaagggatcctacccctcgacctttcaaagtgttgggattacaggcatgagtcaccatgcctagcagccaccacttgtcttaattcctctgtacatcctatcaccatgaacaatgcctgacatttagaaaacactaaacaaatctgtgttgaatgatcaaacagatgttcaagagttatacaggttatgcagattatagtaacaacacctcccagttttgctattgtttaccagactggttatcaatacatgggtacttccaaaacactgtttctcaaatgtttaaggaaattgtcacattttcctaaggagacatgcatggagctctaaaagttttccagtaggagaaagatggaagcatgcatccaagtcaatctggcatcatgatgtggatatttatcaggccacaaagggaacatcatcaaatgaaaagagtgtagactttggacacaaattctccttggtctggtcaagtgcatatatatttaggctacacacttcactgctctgaatctcagtttccttgtaaaacactatacaagatggtgcatttcaagtacatgctgtagtgctagtttcttgaagacttcattcataattaaaagtgttgatacaattatcctgactttccagtaagccactgcatgccttagagggtatcctcttcacccttcagcccatttaaaaagctgaggctgcatttgagttactttcccattgagcctggagtcaacttttaaagggtcaccacctcaatttgtctttacatagataatataactatccctacataagtcgctgctcctgtgacaataaaagaatgctgtgcaggaatggacattatgttgttaaatgatcccctaggaacagaaaatatttcactaggtgttgcaaggagggtgcctttagcatgttcttcaactcaaaatatacaaatgtgtttctaaggattttgtgggttattcagagcatctgcatcagaaaataattatccatttcatttaagtaatcagttgaacagaatacatcacatggctttttttttttaaataaaacatattggagctggatctatcacagaacaataatacaatggggggaaattccatagtacatgacatcctgggaaaagttcaccagagttggatgaaaacgcactgaaaatctggattataactttgaaagtgacaaatagcatctcaccaatgactgatttaggtgtttgcttctatctctgaattctactgtagacaacatttggatgtctgccatacagcaatcccatttctgaataattaagagacagacaagaaaaacaaagaggtgatgtcctgtttggttgcttctttcctgaaagatttttaaccagaggtagctgttactttcagcctgggggccaaaaccactctcaaatatttaaaagctacttgggactaaatgagatagtatgtatcctcaaggtattgcacattccctgaaacacagagctcaataaatgtagaattcagtgggtggacttcttccaaggtatataaagttagttccataaggaattccagcccacaccttaaattctcaaactcaatgtgaatgagactatgagtcacttattggttatgactgatccagctgtatgatcaaaaccctcctctgcctaaatctacatcccacaaggtcctgatgggcagtgagcgattatgaagcagcagcaacctaagaagacgcgcccaagggcatctgtacacttactaggtctagattgggcattcacaatattcacaggttgagagctatcttttttcactcccttgttttttgaaatttggctaatttgcacaaaattgctataattaaagcccagcgtttccccatctcagtataaatgacattgtgaaccatataattctttgttgtgggggcgtcgcctgtacaatgtacagtattttgcagcatccctgacctctactcactagatgatagtggcacctcctacccagttttaactatggaaaatgtctctagatagtgctaggtagcccaggggccaaaaccaccctcaagggagaattactggtttaaggcatcaagtataaaattatagtggctgtgtaaatgattaagtatctgtaggtatatttagtgaatataattagtgctgtcgtgtatgtgtgtgtgtgtgaaaatatagtcatattcaaaaaattggcaacttgtaaatttttagcattacaagaaatgttgatattgaagatatcaatatttattattgatatcaatcaaatgtgcattatcatcattaaagaaccactgtaaatttaaccaacctacatccttgtggggaaaaaaaaaaacaagatctcccatgtgagtttcaaaaactgaaaaggatttcacaaagggtgaaacgtggttattgatagttattcataaataggtagatatttaatatctctaagataaagaggatatgctacaaaatgaattctaaaattgttaatggattaaaaattttaataaaaaaggtgaaaacttcattaaatatatacatatactttgggagtgaagaagggctatatagcatgtattctctgcaaagactgcataaaataataatatctcagaatggcattttgactaatttataacttgattgggtattttaaatgattctctgcagggcagttattctgactcaggttgcaattaaggtgaggctcacactcttcaggcctatcagaatttaaagtgttctgaataaaaattgtaataaatttctccccaaagtatacattccttaaattgagattggtttaattttaagatacgtatttaattaaggtgagccctgatgacaggcattttggtatctggaccttaaaaagaataaagtcacatctcctgggtgtttatggccttgtctttcaaaggcctgggaatatattagaaaacaggaagctttgtagatgcttttaaaaaaaaataggataactgagaaagagcacccttccctgtgttttacttccagccacgctgaacgtctgggcccactgagatgtctgctgccaggaggtttctgagaacaagaagcacttgagacatccgcttccatctcacattcattacggagcatccagaaaacaaaagcaacagaatctgatccttgcccaaattactgggcttgtacaataatccttctatactgttcactaagaaagtctagaatagctattcccaaaactctgcataagctacagacatctctggcttccttttcttttgtgtctagtggagacaacattttagggtacctgagtgggatgtggcttatcttttgttctgaagcccaaagctctatgctgttaccaaaatgaatgaccactctccacgcatggccatgcatgcatgcacacacaagtcctccatccctgctcaacatccatccaacaccagcaatctgccactttgtctatttttgtacatgtagatattttaatattctggtttttatttcccctcctacataaaggagattacaatctaatttgccttttgtcaaatcttaagagttctttgcacagtcacctatgcagtttctattaaatctaaaaatgaaatcccatttaaaaatccaccatttttcaccagagaaatgcaagtcaaaaccacaatgagataccatctcacactagtcagaatggctattcataaaacatcaaaaaacaacagatgctgttgcggctgcagagaaaagagaaggctatatacaccgttggtgagaacgtcaattagttcagccattgtgtaaagcagtatggagatttctcaaggaacttaaaagaggaactaccatttgacctagcaatcacattactgggtatatatacaaaggaaaataaattgttctaccaaaaagacacatgcacatgtatgctcatcacagcactattcacaatagcaaagacatggaatcaatctaagagtccatcaacagtagattgaataaagaaaatgtgatgcgtatataccacggaatactatgcagccataaaaacaaatcagccggcgcggtggctcacgcctgtaatcccagcactttgggaggccgaggcaggtggatcacgaggtcaggagatcgagaccatcctggctaacacagtgaaaccccatctctactaaaaatacaaaaaattagctgggcgtggtggcgggcacctgtagtcccagctactcaggaggctgaggcaggagaatagcgtgaacccaggaggcggagcttgcagtgagccaagatcgcgccactgcactccagcctgggcaacagagcgagactccgtctcaaaaaaacaaaacaaacaaacaaaaaaaaacaaatgaaatcatgtcctttgcagcaacatggatgcagctggaagccattattttaagttaattaatgcagaaacagaaaatcaaataccacatgttctcacttagaagtgggagctaaacattgggtactcatggacataaagcaataacaaacttgggactactacagcagggagagggagggggaaaaggtagaaaaactacctgttgggtgctatactccatacctgtgtggcagaatcaactgtacctcaaacctcagcaccatccaatacacccaggtaaaaaatcctgcagatatatcccatgaataaaaaaaaaaagttgaaattttaaaaaattgtcaaataaagattgaatatgtttaaggtaaaaaaaaatgttattggtatacacacaaaaaaaatttaccattttgaaccattatctttactatatattaagcaattggagagtaaaaatgtggccaggcatggtggcacatgcctgtattgccaggtaattgggaggctgagccaggagcatcacttgagcccaggagtttgagtttagcctgggcaaattagcaagaccccatctcttaaaaaaaaaaaggatgccaaatgttctatcttcaagatgatcttgcaccatatggcagctcaaggtatcaactccatcacctccctcaccatttctgttcttccactgaagtttaatgggtcaggaacatgcatgagccataattgtagaaaccagaattttcagcaggggcctcagcagaacccaaactaaacccaagggtaaagagttaatggcttatatgttgcccagccaagacgaattggataagaggatattccacagataggaaagacaaatataccatgaggaatagggcatacatctttctagagtaaactatgtggacagaaagatcctacaccgaccaaagaaataagacaacaccaaaacttagaagttggcttagtccattcaggctgctgtaacaaaatatcatagcttggggggcttataaaccacagatattcattgctcacagctctggaggctggaagtccaagatcaaggcatggtagattcagtgtatggtgagggcctgcttcctagagggctgtattttccttataactttggaaaaggggaaaagggcaaggaatctccctggggtatcttttaaaatgtcattaataccattctggggcatccaccctcatgatctcatcagctccaaaggccctacctcctagcaccatcactttggggttacaacgtcaacatggggattctggaaagacacaagccttcagaccacagaagtatcccgtaaagatcactatgctaggtaagggtacgtaatggggtaaagaaggagttcctgcccactaggagcttacattctcatgaaggtatctatccctacctgtgatgcattttttcttcttattcatcttctgcatatctaaagctagcacaaggactggcaaataataaaagtgcgttaatgcttgattttctgtgtgaaattaaatgttttccagacacaatttctaaatctaaatcaaatgatttgcagatctctctaggctttgtgttcatctctctcaccgaactcaaagtcatatgtcctcaaggtcatggaggcatacacctgtagtgccagctgataacatggtatgtgccaccatgcctgtagtgccatgactattttctcttcaagaatatagtcagatagacatcttatggtgctcctaaaaatctcattctccaatccccaaactgcttccatgcttttgtttcatatttggataactagatcattacttttctagtaattcagcctacactcaaagccatctttgttggtttctccaccataaatccacatccaggaaggagtcctcaaatctacagatagcctcaacataggacaagaggctcaatgtcattcattattggtgaaatgcagatgaaatcacaataggattaataaaaatacaaacaaacaatgataccaagtactgagcaacgatgtggagcaactagaactcccatgcatcaggaaacatgcacggaaatgtccactgcagccccatttttttttcttcaacttttaagttccaaggtacatgtgcaggatgtgcaggtttgtgacataggtaaacatgtgccatggtggtttgctgcacaaatcaacccatcacctatgtattaagcccagcatctattagctagtcttcctgatgctctcccctccgggcatccccagacaggcccaactgtgtgttgtttccctcccccatgtgtccatgtgttctcatcattcagctcccacttatgagtgagaacatgcggtgtttggttttctgttcctgcgttagtttgctgaggataaataagccccaattataattgcaaaaaatattgccacaatccagatatccataaataggataatgaataaataaatgttggcatattaaaacagaaggctttacaaaacagtcaaaaatgaataaaatacagatatatggaggaaaatgggaaaatctcaaacataaaaggcaagtcacagaagactacaaatagtgtgattttatttacataatagtaaaactaaacaatatattgctcagagctatgtttgtcctgaaatatacagcaaggacagtatgaaaaccaaatcttgggggattagatttcactgaaaggtaggagagagggaagcaactcacactgatatataaaaacagtgggaatgttctctttccttgtctgtcagtgggtacaatactatgtatctgattattttttactctttaaaatgaatatccaaatacacattttgatacactttttatgactatgattattttacaatgaaaatttaatcaaaagattctcatccgtataagttttactcaatgactttattttcccatgtgctatcaaactatcttggatttaaaaattgaagggaaaatataaactgttttctccatgattatgcgacaagcccaaggcaatagaccatccacccacatattacacagaaaagccctgggatcctgccagccatggtaagcacagtcatggaacctgagcctgctatagccctggtcactaattagccaagtgccctcgccatcaactccctccactgcaaaacgagggcttgtgccagtgacctcttaagttgctttcaccactaagacgctctgacatctcagactattatctccaaagcagactcagtataggagcccagtgggaacagaaagtccttcactgaagtagcaaggcataactgaagcgagacaatccctactgcagaaaatggcaaggtttagtgtgccagaaacagtgagagtcagtgtggccttccagcctattctttaaaaatatttctttcagttgcagtcagggagacagagagtagaatgatggctaccagaggctgggaagggtaatgggagagagagagaagtgaggatggttaatgggcacaaaaatatagacagaatgaataagatctagtatttgatagcacaacagggtgactgcagtcaacattaatttactgtatatttttaaataactaaaagcataattggaaagtctgtaacacaaagaaatgataaatgcttcaggtgatgtatactccatttattctaatgtgatttttacacatatgcctatatcaaaatatctcatgtacccacaaatatatacacctactatgtacatgtaaaaataaaatatgttttccaacaccagataacctttattagcaggatataaaaatgccaccagatttttctttacttgaattgtacatgaggatttgaaatgagtatttactgactttttcccagaattcactgtactaattgtactgtacaaataatcttcttctttcccctcatatataagaggagttgtttcaagagtttgtactttaacttatcatatatgaaattatatctataaaataattttttttttttttgagacagagtttcactctgtcacccaggctggagtgcagtggtgagatctcggctcactacaacttctgcctcccggattatcttgcctcagcctcctgagtagccaggactacaagcatatgcccccatgcccagctaattttttgtatttttagtagagacagggtttcaccatattggccaggctagtcttgaactcctgacctcattatccgcccgccttggcctcccagagtgctgggattacaggcgtgagccaacgcgcctggccaaaaataaattttaatatattatacgtatagatatcttcaaactaacctgctatatatagagagagaataatataaaatatattattctatatataaaaaacatatatattacaaaatatattataaaaataaaatataaataaaatatattattctatatataatataggatataaaatatattattctatatataatataggatataaaatatattattctatatataatataggatataaaatatattattctatatataatataggatataaaatatattattctatatattatataggatataaaatatattattctatatattatataggatataaaatatattattctatatattatataggatataaaatatattattctatatattatataggatataaaatatattattctatatattatataggatataaaatatattattctatatattatataggatataaaatatattattctatatataatataggatataaaatatattattctatatataatataggatatataatatattattctatatataatataggatataaaatatattattctatatataatataggatataaaatatattattctacatatagaataatataaaatataataaaaaacatataaaatatattattctatatacatagaataatataaaacattcacaggagcttaatacctcaatattttgcttggttatttggagaaatactttatatatataaaacatagaagcttaatatttcaattggttagtttgaagaaataatataatagataaaagaaatattatatttaggagtttaattgctttaatattttggttggctatttgcagaaatacatataaaacatagataggagcttaatatttcagttggttagtttgcagaaatatttatatataaatacgtggaaagagagagagggagaaagagagggagagactgacaaataattagtttggatatatacattttttgaggtttaaagagatttatatagatacaatacattaaaacttattttatccatgtcatttcatgcatgtgcatatgaacatatatattcgaactaaccaagtgaaatattaaactattaagctgcttaggttcaggaatttttcctactccattccctgaaaatcccgtgttccatgcctttatgctacagataatcaatactacctgttgcatatgatgctgatcatctgttttcagagagatggtcctacataagagcaaactaagaacaacaggctcaaatgcactataacaggcacaaaaacacctactcatgtgtgtattatgtatctgggaggtagtatggggcagaggttttgtgcagttttatgactatgattcaaatcctggctctcactttaactccatcagcaaccagagaagggtgtatacaccattgtgatggttaatgctgagtgtcaacttcattggattgaagaatgcaaagtattgatcctgggtgtgtctctgagggtgttgccaaaggagattaatatttgagtcagagggctggggaaggcagacccacccttaatctgggtgggcaccatctaatcagctgccagcaaatataaagcagagacagaaaaacatgaaaagactagactagcttagcctctaagtctacatctttctcctgtgctagatgcttcctgccctcaaacatcagactccaagtccttcagctttgggattcggactggcttccttgctcctcagcttgcagatggcctgttgtgggaccttgtgatcgtgtgaacaaatactacttgataaactcccctttatatatctatctgtcctattagttctgttcctctagagaaccctacctaatataaccatcaatgcttccatctcttatgtgtaaaatgggcagagtagcagatgtaactcaaggatattattgcacgtgctatggtttgtgtttgagaaagtacaagagtatatgaatatacacacctatattcacacaccttacataaagatatgcatatgtatgtgatatggtttgactgtgtccccacacaaatctcatcttgaattgtagctcccataattcccacgtatagggagagggaccctgtgggagataactgaatcaagagggcagtttcccccatactgttctcgtgatagtaagtctcatgagatctgatggttttataatgaggagttcccctgaacaagctctctctttttgccttccgccatgtaagacatgcctttgttcttaccttgccttttgccataattgtgaagcctccccaaccacatggaactgtgagtccattaaatctctttttctttataaattacccagtctccggtatgtctttatcagcagtgtgaaaaaagactaatacagtacatatatgtaaacacatataaatttagaacaataagtattccccaaagaaatcctagctaattacaattattcactgaggtaccactgaatgcttccaaggtgaaacccattttgataaaatgtaaagatacaccaatcaagtacccatcctcaagtagtaaacactccagctgatgagatgaagcttgcctttcaattgctacaattaagccagcctgtgctccattgcttttcaactgttaccatgaagccagcctgtgctccattgcttttcaattgctaccatgcagccagcctgtggtccactgcctcccacctgctccttctgtgggatggtgggcttctgcagaatggactttgcaatggagtgcccagaagatgcttctacaattttagacatgtagagagagctaggccagaggacttctgtaaagacagcatagagggggtaagcattgacattcaagaattaagaccaccaagatttacaaagagtggggaagatgataccacactgaacattcacattatgtcaccattacttcctcaatgcttacattcattgctagactatgataagtatctaagggcaaagcccagagatgactaatacttgaacttggaagacagaaggtcttcagtaaacactattaaattaaaaggaagaaaagagacacaaggaaaccagaaggaaccaggacacagaagacagaaaattggcaaggttaggtttcagggcattctccttagctcatctcctgtgggtaccacaaccacagaagatgagctacttccaccacctgctccactcatgtttccaccataaaattctcataggcttcacgatgtagtccctattgtttttgcctgcaggaatttcactcattgacacagcagtaaagtgttagagtattactttcagccaatgtcaaataagccagtttctgaaaaggtatcacaactagttctgggaatatatttgcctgcaatttagcaaacaaaataaagaattctagatacccagtcacttttaacctcatttcctttaaaaggctttctcattgctgtatctgatggacagagataatattgatcatgtaaaggaaatatttaagccagagtggaagctgagtgagttcttctacaaaggaaaactgtcagtttgagtaagaaaaaaacactcaatttctaaatagcacagtttaacctgcagttagtacttctgacctggcacgaccctcaactggcagtgggtctgcagatggttgatcatgtggacagttggaggttaatgtggacaagaacaagtgtgtactcccaagtgcaagacaggagccagaaccctctggagtaatactgttgagtgtatctctatgtctcttacataaggagcttcataaccactgcccatacctctcctaatgaactgtgcaatatccgaaaagctgagtgtcttcagaacgtttcccaagacaccacctgtgaccccaggaccagctccatctcacaaccctggctagagtgctccattttctgtagcacagatcctatttgctaaggttactttgttttaggcagacggctctatctgagaagttcctatttcggtgtgatgcttgctctggcagcctacactcttttctcatgtgcttctgacagtgcagaatgacaaggtgagggccttacaaggtgttcggctctagattactaaacaccacctttcccacacagtttatttcctgagtatgacactgtacaagctcccaggaaaggcaagcttcatcctcaggcttgaacctcatcacctccacccactccccaaaatgtttcctctgccctccccagacaggaatattaatttgtgaaaacaggctctatcccagtgagtcagttactccagagaggcttcttgtcctggggtcagaacttaactgagatcagaccttccatctctaggaaataaccaaggcttccaagatccagcatatagacaacaggcttctcataaaaacctctgtgtctcacattagcatgggaaggaagaataggatggaagaaaagagtcgtaaaaggaaggctcttttaaacagggttcaggaaggaaagaggtgcaaagtcaagagacagaatcagggtagacccaagaatatacctcaggaatcaaaggcaactatctcctaaaactacctccaaagccttacaaacattcaaacaagacaaaattcattaaaatgaaatgttttttgccaaaaatgtcagtaaatagcagtcaatattaattgatattgacacttccaagctttttaaatgaaaataacatgaagattctaatctgccagattcttcactttctttttgacataaaaataattatctcagtatagaatgctctatgctgcaaactagtgactctcacattcccacctctggcaaaattcctactacacatgcaggttttttaaagaaaacagaggtataataaataaatcaaaacctttcctctacacaattctaaatgcagatgttctccaccctaagtccaaaaaccccaatcccacccaggtgtctttatttatttttttgtgagtacatagcaggtgtatatacatatacatatatatatatatggggcacatgagttgttttgatacaggcatgcaatatgtaataatcacatcatgaagaatggggtatcataccctcaagcatttatcctttgccacccaggagtctttagatagattccatgggttctacaaattgcaatgggcaaaagtaattacatctttagtttcactaccatgcactgaaatttagtatttgcttccattacccgtgtaggtaggacacttaacactgttatcacagatatcccaaaatactgtttacgcttattgtactttgaaattgtgactattacgaacctcttaagtagatccaggtacttagcacacaataaagatgcacatgtattactgtagcccagtttaaatatatctttttatttttattttttattttattgattgtagaaacagagtctcactttgttggccaggctggtcttgaactcctggcctcaagcaatcctctcacctcagcctccccaaatgctggtgtttacaggcatgagccactgcaccaactttaaatattaatattaatataccttggtaactatttcaataaaaccgatttccttttatgcgttatttaccttattgtatgacttaaacatatcatttttacaaaatgtatcaattttccaccaaaccgccaaagggatctgtcacacacactcacacatgtagcgtgcacagctgagaatccttggctaattgccagtctgtggtcatcacctgcgtatctacctatcatgacctagtggggacagcaaaggttacagctttctgcttgtggataaggagcatgtgcatggaaggatgaaatgccacctcctcagctatctcatacgagtcttatctggctgttctcttcccttggaagacctgccctgagcataagtacttgagaataaatgggtcaggcaacatggctcatgcctataatcccaacactttcggaggctgaggcgggaggatcacttgagcctaagagttcaagaccagtctgggcaacatggcaaaaccttgtttctaaaaataatttaaaaattagctggacatggtgttgcatgcctgtagccctagctactcaagaggctgaggtgggaggatggcttgagctcgagacggggaggttggtgtgagccatgatcgcaccactacacttcagcccgggtgacagagtgaaactgtctcaaaaaaaaaaaaaaaaaaaaaagaaagaataaaaggcaaatatctccaccaggaggtcttgcctagctcttgccataccctcccaagtgagacaggtcttcctgtcttcctagtcatctctccccggtaacctttggtggaacctgagaccacctcagctgagcttccctagaggccacagctgtgcacacaagtaatgaataaaaaaactctagcgcttctctcatgtagaaaattaaacatctatgccacctgcatagggcagggagatctttcccaagaccagggaacctccaagctagagagcagtcccagcaactgcacacatggtccttctctgtctgaaccaaagctacttaaatatcaagactaagacgtgaaactaaaggaaggtcaaagacaaacatgtccttccattcacaaacacatagaaaaccacagtccaagtaagttttcatctgaattcccacaaattaatggaggaagggaacttatctgaggaaataaagtttcattaattggccactggatgtcatgcaccgggaaggagtctctactctttaaggcccatggagaagaattccgggaatgaacagaatcaaaagaggcatttcaaaccctgcttcttctccatccccatcttatccactccccacatcccaagtccaagaaaaaataggatgaaaggatcaacgttatagaagctccaaaattatttcacagcaagtggcaaaatcctcccccttcctgaaactcaagaagagtaggactatcatttgcctctcttttgaattataacctgaaccatggccctttgaaatctcaaacctccccactgtttttcttaaatatgtccgtgggaagatttccttctccctatcacttctttctgtatagataggatttttaaaggtggatctttctttcactacagtaatcagatgtcacagattttctgcaattaatgctttccttggctatttctagacctcctattaagagctattctttcactccggcctattcttcctaacccaattaaaccctattaaatcctctgccatgactgttctatttcccccacgtttaattatcccttaacaagcctgtgtttctgcatgttcttttcaattggcccaccccagactgtgtaacttagagggtgtgactgtccacatctataacatcttcaagctaaattatcatctggcaaaaattccctccatggaaatctatcaacaaagcgagtgctatcttaagactaagttctgtccgcaacttcaaatactaaagcgtcatagactgattcagtcaaaaaggtttttaaacaaaaaacgtaaaataatttgcatctattatgtttatgccctttgaattaattggataattaggaaaacatactgaatttgtgggaggacatatactaattctccaataactggtttcactatgtattaacacatacatattgctcactgcatcctggaattcctaggctctagaagtcctcctgctggtctcagccccacaagaagctgggactacaggggtgtgccatcatgtccagctattttttttttattttttgaagagatgggtctctctatgttgcaggctggtctagaactctggcttcaagcaatcctcctgcttcagcctcccaaagtgctgggattataggcgtgagccactgcacctgtcctttttatttttttgagacagggtcttgctctgtcacccaggctggaatacagtggcaggatcacaactcactgcagcctcgaccttttgggctcaagcaatcttcctgccccagtctttcaagtagatgaagagcttttagtaatacactagagaacattaaaaaatcattagctttaaggacattctaagagtaaagttataaagccaaaacccataaaagataaaggaaaatcggaagaggcggtatgaagactgtcctctctcagagggtcccttcttgtggaaataggctgctattccaggtcagagggagggtcccccaaggcaagacagatcaaaggtatccccaagacagaagggagccagtaagtcctactgaaatcaataatttgagcaacagaccaaaggataagatcatgtcacctcccagctgtaaatatcagcactgcatggatttgagttatcatccaggataaaaatgacttctcaaaagccaatgcttttaagccactgggttcttatttaacaacacaaagaactacaccctgaggatgatcaacaaataatctgacatttaccaggcagaaggtacattgaagaaatgtagaacacactagctgcaaaagatagagaaagcattcacttcctaggtgccaatactctttagtaggaactcaatccccttcactttgaagcttggcaaaggccaaattataatgaaagaaaatttggcctctgcacaagcatccttgaccacggaacgaatttctagagctggtaattatgtccttggccctcgagttaaagggcatcacagaattagaccagtggaatgcacagagctcctccaagaagccacttaggacgactgcctgggaaatgcaaactgaggaaattatatttaattcaacctcatgtgtggtcggagaaacaggaggaattggaacaattaagccagcatggcgccatgagccatgcacaattggcttcccgtaggatagacaaagcattccacacacgagaacattctgtgacttcagttaagaaagggaaaaaaaaatgggaagcttgggagaagcattaggtcattttcaagcaattaaagcctttccataaagaacatatcagataacaaagaaatgactgagtgatgaagttggctcaatctaaatcatcatgttagtagtagtttattactgaaaccactgtatcttggtgaagagaacactggacaagattttttttttttttgaaacagggtctcactctgttgcccaggcttgagtgcagcggtataatctcagctcactgcagccttgacctccagggctcaagcgaacctcccacctcagtctcctgaatagctgggaacacaggcacgctatgttgcccaggctggtctggaactcttgggctcaagcaatcctcccacctcagcccagcacaaagtgctgggattgcaggcatgagccactgcacccagctagagatttttaaattcaagtaagaatctgagctacctagatccatgcttcctaaactctgctgcatcttagaatccctaaggagaattgaaaaatttcactgcccagtctgcattgcagaccgagcaagtcagaatctctggaggaccacagcacaggcattaatacctattacattctccaggtgattccaatgggcaggtacatttgagaaatcatgcttttaactgtcatattcacattcacataccattcaatcttggccttatcatttttcttttgaaaaaattttgtttcaataaagaaaggcatgcatgaagttttaaaggtcaaactactacaagtgttatttgcacaacaaacagcactttcttgcccaacatacaacatcccatgaccacacttgctttagaaagcaaatgctttcagatttcttagcttctcctctccaaatatatgctctatgatatttctaagtaatagtttatgctattttttcttgatatattatttttagatattacctataaattatcaatgggcaaccaccactctatttgccccttctgcctttttgttttttcgagacagggtcttgctctgttgcccaggctggagtgcaatggtacagtcacaactcaccgcagccccaaccttccaggctccagcaatcttcccacctcagcctctgcagtaactgggactacagccacacaccaccatgcccagataatttttgaattttttgtagaggtgggatttcgccacattgcccaggctggtctcgaactgttggactcaagagatctgcctatcttggcctcccagagtgctgggattacaggcgtgagccactacacctggccttctctctttaactttattgtaactgtgcaattaataatcactcctgaatgaagcattctactctaattaaatctccttcattgaattgcctcctgttttatctggagacaacaacaacttcacattttcatttcatgcttttctgtgtgtctattgttcaatttttctgaatgttccaagggaactaaagcccatctcaagtactatttctacatggtcaaatggctcatttccttttcttttatgtactttctccttgaagtctcactctaggattccagctgtcccagcctgctctgggcattaatctgagacctgcattctttcagctctcttctgtgaaggccactgttccttggattccccatctttctatttgtcatttattccgctgtttgaaggaagacataatcacacagctttccaagaaagggtgcacaaaaggtaaattttcggaaatgctacatcagtgtaaatgccttgaccctgcctgcccatggacagtttgctccaagagttctacgtagtaaattgttttttcttagaattgtgaaagtttctatcttttaacgttcagtgaagacatgaagcattctatgacattacaaattcttgattcttaataagttttttttctttgcctctgatatgatttggatctgtgtccctgcccaaatctcatattgaattgtaatccccagtgttggagatggggcctggtgggaggtgatggcatcatggggagcagagttctcttgaatggtactgtacacaccccttggtactgtatagtgagtgagttctcaggagacctggtggtttgaaaggctgtagcacgtcctctctctctcttcctcgtgctccagccatgtaagatgtgcctgctttcccttcaccttctgtcatgattgacacgttcctgaggcctccccaggagccgccatgcttcctgtacggcctgcagaaccatgagccaattaaacctcttttctttgtaaattacccagtctcgggtatttctttatatcaatgcaagaacggcctaatacagcctccaagctcttaggatcttccctatatatttgttcttctgaaatctcgcaatgtgcttttgtagtttggagtttcaattcattcactatggtgagccctgagtgttgtttcataagcctggaagtgtagatccctcaatgctgggattattttaaaaattattcataagtcacttttgcttatttgtattctgttgtccttcctgaaaatactcttcgaatgtcagattcctagagtctccatattcgttcctttccattttgctatctctctctcattaaagttttgtccattggagatatcctcataatcgttctccaatctgattatttaatttgcctaatatgtcacattttaatagaattcccatgttttttatgagtcactatttcatcatatctcctacaagttacagattagaaattttgtctcttgttttcttggttggtgttgtctgtgctacctccagatgattcttttttcaatttttaaaaagaatttcttattgaaagcttctcaaaaatatctaggatgtaagactgtcttttctcacttaagaatcaggtctgtgtggatagccaggggtccttcctcagcaggtgaacatattgtacagtaaataagtaataggcccaaatggcctccaaatgccagttatggaatacttttctctgccagttcagtttaccaagaaagggatcctccaggatggacttgaaggagtccagtgactttcaacttggaaggaagaacaagaaagctgatggctgtgagtatgcagagtgtagacaattcccttacagacacagagcgtgggccctcacccctactccactctctgatgtctgtgggtccttatgtcctaactttctcaggacagatacggagtctgggctctcgcccccactccactctctgacatctctgggtccttctattctgagttaacttcctccaaaataaatttcatctgctccctgtggagaggagggaaggaccgtactttagccacacagcgtagaaacctgtattctaggctcaactgacctaagagttttgcatgaagttaaaaaaatttgtgttgttggggctcagagaatgataccacaaaatgaaggcttcagcagcctcagaggcaaaaggtttttctctgaccctcccctgacctgttgtctctcaattccattctccccgaaggctggccataggaactggaatccctcctccctaaagcaggtcatacaaaccagaccccttccccacaaagcacccatgaaaccaaaaaaagatgacctcaactttcccctgcctttctgtaaacactggccataaataaatcctctgacctgcctttttgactgtaggtcctaagaccccccattccacagagggtcctacctcacacccagaaggaatgctgctcagagaggccaagaagaatctaggcagacagacctggctgggtttccccactcagtccattagctttagatcaggccctttttgtccaaccctatttctactgggttgtccacagttagttgaaccttagcataaaaactgagtttccaaataaccccattaaaaactgtgccaagggctggtagtggtcgctcacgcctgtaatcctagcacttcaggaggccgaggcagcagatcacttgaggtcaggagctcaaaactagcctggccaacatggtgaaaccctgtctctactaaaaaaatacaaaataattagccaggcatggtggtgggcacctgtaatcccacctacttaggaggctgaggcaggattttttgaacccaggaggtagaggttgcagtgagccgagatggtgctactgcactccagcctgggcaacagagctagactctgtctcaaacaaaacaaaacaaaacaaaacaaaaaacaaaaaaaaactgtgcctagaacatgaacacacacttctcaaaagagggcatataagcaatcaataaacatctgaaaaatgctccacatcattgatcattagggaaatgtaaatcaaaaccacaatgagaaaccatctcacaccagtcagaaaggccatcattaaatagtcaaaaaaaaaaatatataacagatgccagtgagtttgcagagaaaaagggaacacttatacattcttgctgagattgtaaattagttcagccactgtggaaagtagtttggagatttctcaaaggacttaaatgaaacaaaactaccatttgacccagcaatcccgttactgggtatatactcaaaggaaaataaatcgttctacaaaaaagacgcatgcatttgtatgttcactgtagtactattcacaatagcaaagacagacatggaatcaacctagatgccaatcagtggtgggtggaataaataaagaaaatgtggtctccacatatgcactgtggaatactatgcaaccatgaaaaagaacaaaatcaggtcccttgcagaaacatggatactgctggaggccattatcctaagtgagtcaacataaaaacagaaaaccaaatactgcatgttctcacttataagtgggagcttgagaaaacacggaaataaagacgggagcaataggcacaggggactactagaatgggaagtgagtagggtgaggactgaaaaactagctggtggtcactatgcttaccaccattgattgggatcaattgtaccctatacctcagcatcacgcaatattcccatctagcaaacctacacatgtaccccctgaatctaaaataagttgaaataaaaaaaaaattggacagtctcccctgtatctttgtgtcctcattctgaaggctcctgtgttacacaaatctacaacttaataaatatgtattgctttctattaatctgccttttgtgacatgattttccgtgaccctccagagggtgaagaggaaggtttccattggctaatacaacattcaatccaacctggatatagagaaacaccatgttctccatctatctttgaaataatttgctatgatttttcctctgagaaaaacagcacagcagcaatacaatcactcaaattctaacttgaattttaaaaaataatatgattaggagaaaggatgagtatagtataaaattatctctgtatttctgcctcagcgtagagaaaatgttctctatgaaatataatcattttattaaacactacccaacaccatctagtatttaaccagttccaatatttctcaagtactattacattcttttctcccacatatcgtcataaagcatttgtttttgtttttcctttttatctggcaaagatgctacttataccagtgattaacacaatttctaagtaagaaatagaactagaagtgaaaacttacatagaaaagtaagatggaaccagaagtgagggctaggatatgggatacatttgacaacctacagttgtttttcaaccccttcaagttatatcattatctattacagaaaaaaaaaaaaaaaaaacaagataaaaccacacctgagcagacagttttccaagggtgtctccaaggatcatttaattttcaaagagaactctttacaagttaatctctgttctaataatctcctcaacagaattcctcacctccccctcccatcacctgttttactgggatccaagcccccactctttctgtaacctcaggatggtgtataagcttctggacctcatttggagggtagatcttcattccaaaggctcctgtgtatctgcattaaatacacttgtaatgtcatttctcctgttaatcagtctgcctagtcagtgatttttcattaaaattttagggagtaaagagccttggcccctacagttatgacacagcgagcggggtcaacaaagacgctctgctcttttggaagccacagtgcagagaacccaggaacccacactgctggccaaagggtaagaatttctcaccagccagccaggctcctggtctctctctccctctgtgcaatccagttgagtggacagtaaaaatcactttgtctccatgatttttcattgaaccttcagggggccaaggcccttgaccacaacactgcctagcttccctgtgtacactcctaattttaactggctctaccatttagcagcccaacaaccctgagtaagtgatttaactctcactgtttgtctttcttgtctgtaaaatgaagataacaactgtgtggtctgcagaataacggaccccccgggatgaccatgtgttaatacaagaacttgtgactttgtgtgaccttacatggaaaagagattcaaatgaaagaggcaggtagaattaaggttcccagtcagcagacctcgaaatggggagatgattccaggttatccagtgggtccacataatcacaaggatccttataagtagaaaagggaaaaagaaaagaggaagaaccagaaagatgacagaatgagaaggactcaatctactggcattgaaggtgcagaaaggaacttatgagccaaggagagtaagaagtctctagaatctggaaaaggcagggaaatctgtcctctcctagagcctccaaaaagaacggtgtcctgatgataccttgattttagcctcctaaggctcattttggacttctgacctctagagctgtaagcagccactaagtctgtagtaacttgttactgcagcacagataggaaactaatactaatggtaactatcaggtagagtggttgagaccaatgagttaatataaaaagcacttggaacaggtcctagcacagaagaaacgctacataactgtcagcctatattataactaataaccaaagacataactctgaattaaggaagcaaattagcaggtagagtgacaaagtaaaagggaaaatattagactgtgcataatgacatttgagagcatacaactccccttacagttttcatttaaataataccctgttctatccatcattgctttttgtttgattgttttgtttttgagacagagtctcactctgttgcccaggctagaatgcagtgacaccatcttgactcattgcaacctctgcctcctgggctcaagcgattctcctgcctcagcctcctgagtagctggaattacaggcgtgcaccaccatgcctggctaatttttgtatttttagtagagatggggtttcaccatgttggccagggtggtctcgaactcctgacctcaagtgatccacccacctcagtgggtgtaatcccaaagtgctgggattacaggcgtgagccactgcgcctggccccatcattgttttgattacaaaagcattatagtatatcttgacacgtgcatttatttcctctatcaagatggtcaagatttatttataattgtactcatttgtcaaataacaacacgctactcacacaaaataatcatgtcctttgaatgtgaaaggtttaatattgatgatgaaagctctacaaagttttgaaaataccaggagacattaatagagttcaaaactcaacattaaaaaatggaaataggactgagactgaaaaaatctagatggcttcatggagttgggcaaggctcatctctctccctgctatgatctgaatgtttgtgcccctccaaattcctatgttgaaattgtgacccccaagatgatggtatcaggaggcgaggtccttgggaggtgatgaggtcatgaggttggagcctcatgaatgggattagtgccctcataaaagggaactcagctccctcaccccttctaccacatgaggatacagggagaaggcaccatctacaaaccaggatgtgggtgctcaccagacactgaatctgccataccttgatcttggactcccagcctccagaattgagcaataaatgtctgttgtttataagctacacagtctatggtatttccttatagtagcccaaatggactaaaacattccctatgtgctctctaatattactatggcttccagaccacctaatataaaatgcagatatccatcttttagttagacaaaggttgaaagcttgtgactccaaaaatgatgggtagcatcataacaaaggcagttagtagatattgattatataaagtaatttaggataattaaatgccatcgtgttcacccaccgagctctgatacctgactcaatgtttgctttgagtggaagtgggtcccctatgtacattaatacattgacttttcaaactctaaactccttgtgggaagatgccatgtgttatgatacttttgtaatcagtggacaaggcaacccctgggaagcaaaccacagtgattttccaacaactacttcacttcttcacactgtttctaccactggaaagtgggacagattgaatctgcctaaactgctagcagaatgaaatacgaccatgaatataaaaagaagtttccaaattctaaagaaacaaatgcctgtaagactattctagtgaacaatgaatatttcacttattttcaaaaaaagtattgtagtgcagtgacagccaccatcatagccatcgtgcaaatccttcaacatcatgatgtgcacagttgaacaaagcatgagaaatatagttctttcacggacttatgctaaaagtaaaatatagaaatactacgtggctgggcgtggcggcttatgcctgtaatccaaggagcacaagacaggaggatcactagagtccaggagttcgagaccagcctgaacaacataggaaaaccgtgtctctaaaaaaacaaattttaaatcagctgggtgtggtggtgcatgcctgtggtcccaggagaggctgaggtgtgagatgggaagattacttgagcccaggaactcaaagctgcagtgagctatgattgtactactacactccagcctgagcgacaaagcaagaccctgaaaaaaaggaaggaaggaaggaaggaaggaaggaattctaagcatctattgaccttttttggtaggggagtatgtgtgtatgcatacattgagataatttacaaagctacaacatcaaacacaagcttttgaaggactaagctaagagagctcctatccactaataactgaaaaacacccatcgactcattttgaaacaccatcatgaggaaaaagaggcatattttgttcacaaaagttagaaaatattcatatagccaagaggaaaggacaaggctttgggtcatattgtcttagcatcaagatcactccagttgcatagggctagagttttctacaatatcaacctgctccgatgagtgttagggctgtgagtaagtcattttttaaaatgatagtaggttaaaatttagaatagtgctacttatataattttgatggaattcctaagaggcaggaaacctaaatgtcagaatttcatggtgtgccttggtctgagaattggatgagtgtgtgctgactgtgatgtcccagtttgatccatatggtgttcacaccatattatatggctgtcattgctttcagttttctcagtagcgaccatttgccacctgcagcccaatctctcaggtccagcagctggaaagagacagactggtcttctctcaaaggcaattccaaagttacaaggacaccaccaaagctaggatgcaacccacttgcaaaaagaagacagagaagcaggcggcctattcaagactcatgtggctatgatgggggatgccatagcttctgttttctcataagcacgttccttactccttcgtatcttctaatgatgctgaagacaaggatggttagcaagcagtggatgctaaagttatcttttcagggcacctaataaacaagcaataaactagtatcaaggcagtaagatctcttctagtttttagtacatttaccatagaaaattaaatagatgcccttaataaattggttcaattggaaaggctttaaaacaagtaacaagcaagtaaaagctctaagtgaatttccatgcgagagaacaccaacctaaatctttcctatgaaactataccaaaatacaaattaagatgaaaatgtgtccctatccaaatctcctgtcgaactgtaattcccagtgatggaggtggggcctggtgggaggagactggatgatgggggcggagttctcatgaatggtttagcatcggcccccttggtactgtatagtgagtgagttctcatgagatctggttgtttaaaagtgtgcagcaccttgcccctctctctctcttcctcctgctccggccatgtaagaaagctcactccccctttaccttccgccaagattgtaagttccctgaggactctccagaagcaaaaacccctatgcttcctgtacatcctgcagaaccatgaaccaattaaacctctttcctttataaattacccagcctcaggtattttcttaaagcaatgcaagaacggactaatacaacattcaacgttcgagtgtaatgctgggtatgagagttgattctaggtaactagcactgaatgcatctgttcattgtttataaacatagaaagtagtggcagaactgtactaaaaaaaaatgtctcagagttgctataaactccagttaagccactctccacaggactttggaacacctaaagtactgacagcttttttttttttatgttaactttcatttcttgatgttattttcaaagcattaccctttaatgtcttccctggagcagagttatatccacagacacaaggttatcagttcatttccactgccctgccctgcttttttctttaagtaaagcgaagataaagcattctttggggaaaaccaatattgcattcggaggcaccaatagtttgcttctctctctctctaagtgacagcaactcttaagtctctgtgcttaggatggaacttaattttcagtctccctggtatatcagctgctatcagaaatatgagggtaggcctgtggggaataaggatagttaagggcatctgaaactctctacctcttttgacaagtgtgtatggatgtaaataaatttgagcggtggtacaaagaaccctcaagtgtttcatgactgctttagtaatctattacactataattacagctatgcacacagacgctcataccacggaactaacatgaatacgtagatttaaaagtgatagactaaaaggagtgaaactatctctaaacacagatttaactactatgattttatggtaatattattaatttaataaataatttttgactgtgtgtcttagtagtcctgtttcccgctgcttataagagaacatctgaaactgagtaactttatgaacaaaaggaatttatttcttaaagttctgggggctgagaagtccaaggttaaggggctgcatctgatgagaagcttcttgctaatagggactctctgctgattcctgaggtggcccatgttatcacatagccaaagggctcagtgctacctcaggtctctctccttcttcttaaccaattaatccttttacacattaatccattaatccttgatccaatcacctcttaaaggcccacctcttaatactgccacactgagaattaagtttcaacataagtttcggaggggatattcaaaccatagcagtggggcactgcattagacggagtggtgattacaataacgtaagatatttcctgtattcaggggaatttttagtctggtagggaagtaaggcattgaaattaacaagagaggaaagagggttatcatgggggtactcttttggatacatgattatagagggggagcaggtcatggaaggctcccttgagaaatgactttcaggtgaatgtggaatcattaggacctccactgcagggagaaaagtcaggcaagggaggaaggtagcaataacagtgacacggaggtctgtggctaaacactgctggtaccagaaggttgtgtgtccttcaacatgcctgagacacaggatatgtagacagatgtcatgaaatgggatagaaaagggaacttagggccaaatcacctaagaccatttcactggccatcagtctttggtcacacacgtgataatattccaaacataccttccatcgagtatacaatgtacaatgggattcccaagggagatggagcaaggaggagggaaagagacaagggaagaaggaaaataaagagaaaagcagccatcagggagaaaaagggaaaacaagagtgttgtcaaagatgttgaggaaagcatcccaggaaaggtatcaagagggagaaagatgttgcagaggccaactaagatgacccctgagatgcatcaatcatacgattatagcatcctgaggctgaataatgcactgtccccaaagctatccacatcttaatccccagagtctgtgaatatgtgacctttcacggcaaagggactttgcagatgtgattaagttaaggattttgagataaagagatgatcctgggttagctgggtgagcccagtggcattacaagggcccttacaagagggaggcaggagggtcagagtcagagagggagatgtgacctgccacaacagctaaggaacgcaggtagcctccatgggggaaaacgacaaggagaaagattctcccttggagccttccgaaggaaggagccctgctgacactaagattgtagctccaccaggtccatttcagaaagtggcctccagaaccatgtttaccaatgagtgttcttcaaaccattaagtttgtgattatgtgttacagctgagaacatgaacatgctgaagaaggagtggaaagtaaggaaaaacaaatgtgactgctccttctggaatcctagttaagaagtatacaggagggatgaaacagggctgctagaaagtgtccattagatgtgaacgactgcatttccaaatagagaagacatcagaaagaaatcaattgaaacgattctctataaccatctagtggaaaacatttgtagaaaaaaagcatatactattagagctggagtctgctttctaagcccggaaaacccaaatcattttgaaatttctttccaaagcagtttaaccttttaaacaccaaaaaaataaatactggccgggcacggtggctcacgcctctaatcccagcactttgggaggctgaggcgggcagatcacgaggtcaggagatcgagaccatcctggctaacatggtgaaaccctgtctctactaaaaatacaaaaaattagccaggagtggtggtgggcgcctgtagtcccagccacttgggaggctgaggcaggagatatgcatgaacacgggaggcggagtttgcagtgagcggagatcgcgccactgcactccagcctggacgagagagcaagactccgtctcaaaaaaaaaaaagacaaaaaagaaatactgcaatttcttcctgagacataagatcaatgaactgatcttcaactacacaaaaacaagatggcactgctgttgaaaatgacgtcaaaggtccactcactttgaaggataattagattaaatagaatgtttcctaaaatcggtaattttttggttggatagtcaaggaatcccaactcatgtggtactattttatcccttttaattactttctcagatggttgatgccacatcatttcagagtgttgttctaagacttaaccatagaaatggtgatgattttaaaaacacctgaaaacactgagtgttagcaaaatgtgtccagtattctagttacactttaagtaaaatgtttaaactataacctaatatttcaaatataaaataataaatgacaattattcactctcagttaattaactgatttttaagcaagtatctggcttaaacattgaaaaatacaacctatgatatcttatcaaaagaattagttgagatttttaactaattattataaaaggctaaatggaaatagtagcaacaaaagctatcaaaaaaccaccttttatgaactttaaaatctgtagctggcaaattttccattttaaagtttaccttgattatcaatcttcaacttttgaaaggtaagaaattagtgaagacacatatcactggacacagtgtgctgttcttttcatttacctgatgccatttgcttattactttgccagattttatttgttaacttcttctcagaacagcataatttgaacaatccaatcaattaccattaaaaggacaagtgaaagactaaacattccccaaggaaggtttaaattttccaagtaattgagaagaaaatatagcagctaaaacagtagtccttttagaagacttaattacagataagtcaatgctaaataatttatatttttctgtacatatatatgagatcagaacaaatgctggggggggtggggaatctcttagactcaacactcaattgcttccaagttgctatcttctattaaaaaaaaaattcataagacattgcactgattttcttctccacccaggtttgcaaaactcaagaaggaaaattatacctactcatcccctggtgaaaacagaatgcttcgtttaccaaaacatgactaacatagcccagagcccaagataacttcatcttcccatccaatgttaaagcaccacagaaggttttctgcagaatgtgaaggaactccactcaggaagttggtgggctttggaccaatacacgggagagcgtaggcaaagaatggcgccttctgagagttggataaaaccagcattgcccaggggcactgcctgcccttcttagctgaggggatgggcaataggttagggaacccatttggactgctcagccaggacttagaccttacggctactggtttccagccagggcttgtttcacttcctctgaaactgctgagttgagaacactggcctgcatccaacacatataaagcatcttctacgtggcctgcactgtgatacatacttggcagcatgacattttcttatttatattttaaactgtgtacaaagaggaatagcacaaaggttcatggacaggaaagagtgaccgctgttccaggcctttgcactgaccacaattcacatggatcatgttaccttctacctttagtcctaactgctatttccccatcaccccatgtcacacttaaattgaccaagacttagaaacacaattgaaattcatgttttcagcaggcactgtggaaagggaagtataaaagattaagagaatgtttttcagcaaaagatccttaatcatctgtgtctaaaatatatttagttaatatttactacaggtccacagcatgccaggtgtggcagagaacaacatgccagcgaaagacaaaacaattccattccccattaatattaattatccactccaaggaagcgtactgagtcagaattacttctctctcaaaaattcccacaaaaaatagaatccaggaaccccctggttttaactgtacaaaatgcacttcattaaaaagttcagtgaagcggaataaaaatcacaataattgtttgcatttaagcgttcctttcttctagatcataaaacaaatggattggagtgtgaaaaaaacagtcaagatgtttctccaagatcaatctgtgcaataatgaaccttagccctaagagagatcaaccagcaactggaatccatcacttgagcagctagagaccaccaatgaaaacccacacgaaccagctgcagcttcttgtgttgttgaacgccactgaatctttccctggtgcacataaattttacaggtaaaattcaagggtgttcccaggccccactcatccatacaccccagatgccaggctttaaacttgctctgtgtttaagagttgtagtgcatgcattcatagaattcctaatacaaaagcatatgctctgttgttaatgctaatgtattacatatttctaatttaaaatgtatgcacggatgcattaactcataggcccaagatgatcaccatgaattgccaaagtatgcattgccaatgttttctggtaaaggatcacatgataaatattttaggctttgtaggccatgcagtgtctggggcaaccattccactctggcactgtagtataaaagaaccatatatgaaaatgtaaatttaagtgtgtggttgggttgcaaaacattttatttacaaaaattggccaccacccataggccatagttgactcaccataaggtagggcatgtgtgcggcaccatcatttgctcaaacttgagctcatttttatcctccagagatcaaacattagcttatgtataataacttacaaacagtgtaaaatgattcatttaactatatatgcttgcccttttttcccattctgaaatatagcctcttgacagaaaagcagcataaactagggaggaaaaacaggcaaaaaagtatctgcacaaaggaaaccttatgagtttgagaaagagatgaaaggaaaaggataaaggaagtctaaagacaaacacatacattagaaaccaccatagaatgaaaacgttccttaaaaatcatgttaaaagtctttgtttttctcttgacatttaagcactgaaagaacacagatacaagacataagccttactcaccatttgtgtcattgtggattcagaattgatggtttttaataaaagcagtgaacatattaataattactgtaaatttaccatctaattaaatcttagaaaaatcataattaagctacctgtatatcaccttcatcagtattttgtctctataaaaatacatgacaatctgttttctctagaaatttaaaggaaatataaactctaaccaggctggagtacagtggtacgatctcagctcactgcaagctccgcctcccgggttcacgccattctcctgcctcagcctcccgagtagctgggactacaggcgcccgccaccgcgcccggctaatttttttgtatttttagtagagacggggtttcaccgcgttagccaggatggtctccatctcctgacctagtgatccgcccgcctcggcctcccaaagtgctgggattacaggtttgagccaccgcgcccggccaactccaccttctttagtcagagtggcttaaaaatttcctagaccgtcctggctaacacggtgaaaccccgtccctactaaaaatacaaaaaaaaaaaaaaaaagcgagcgcccgtagccccagctaccccggaggctgaggccagggaatggcgtgaacccgggaggcggacgcatgcgcacgtacacgcacaggcacacgccagaaggcacgcacacgccaggaggcacgcacacatttccgcacccgatgccctacgcatcaccgacgtaatgtcccgcgtggagccccacagggaggaagtgccattagaagaaggtggggcgaaggtcccaggcgaagtctccactgaaggagcttctgagaaatgctgagataaaacagtcctcgccaaggccttcttttccttctttcttgtactaagcattaatcttcctatccccagaggccagtatgtcagtgcccatgggaatcctatcgctccaacatgtccctctttttctctagcagatgtcatggacccaccttgtaggattttggaggggaatggtccctggtgagagaggaatcaggaaattagttttgcagaatgggaaaactgaaactgttgcctcagcatgaaaaggtaattgacataaaataatctttgactcgacacaaaacaaagaaacacagatgagctttaaaaaattaagttacattttaaaaaaattaagtcggggaaatttttgaataaacaacaaaatatatttattttcgtttgatcaataacctacaacgcccttcccacttcttaatttagcaaatacttattagtttactgctatgggacaggcactcttgtggctgacagagaaagaaaagttaacaagaaccagcacccgtccctggtgtttccatgtatccaccatagtttacataaaaggattagatattgaagttttgataattgtacactttttaaaatgtccatcaagtactaattttaaaatctaaatattaaactaaactttattttccccatgtctgcacaactctgttcatctcttttaatttccgagaagacgaaatactctgattagctcctaaatactcccaagctagatagaggagaaatcttttttagcaattactcttcaattgatgagctttcatcccactttctaagtggaaggagcatatcatagagattgcgcgtgtatttcaatcacaatttaccccattgtctgcctttgaaatgtccttcaagaatcgcaggtgtctttgtaataacattcaaatactgtccttttttttttttagtcgttgattccctaacatctgaaggttatactgtagttgctgcaccacattgatttgcataactactctatgtcctttgaaaccacaaaatgtttaataaaagattcatttgggtaatatgtgttcagaacttagtatcaacaatctcaatgttcaaacttacaggcccctagaattatcctgatcatcccttgacttaaaaattatgttttcaggaatgccatgaaaggaatttttcttgatcatcagttttgaattggactaagtcatcctagcaataaaataaattctaacataagatcactaagactatccagattatcatgaaaatccattgcaaagaattttccctaataggggttacaaaaccagaaagtgttcagtcaactgtatgtagaaaaattgaatgaactgacataaattgaaattttcgagtattaaataggcttcacaaattatttgtacttctcagctagctgtggttcttaatttacattcacacattcttcatagtgaaaaggaatgaatgcctgtctctgcagtctttaaacataccaaaaacctagtaattgcaaacaactaattagcagcagagctggattacagcatagatgtcctcattatcaggcctatgtgtgtctccacgaaatcctccacccctcctcaaggacaactgatgtcactgaagagtcatgatgccttcagttcttactgaggattttgagaatactgggaaaggaaaaaccctttgtcacttgtttttcatccagccaactgattcttggtgtacaatgtaggaaattccaacctaggatcaccattcagcaaagaccactccaaattatcaggaaaacacactccaaagcattccccccttaagagaaaatgcagctaccaattaagcaaaagcagtagctgactcttgcagagacatactgataatgcccagtggtttcaaatgtagtttgaacctaagtgcatatggtaaaacaattttaaaaaagtcctaggttcagaagttctcatttccttctcatgattgtgcactttatataatgttccctttgggtttcataaagtgagtctatcatattataagctgtgactcgtctatagctctgagcctgatgccagacctgttactactgcttctccttggaactaggacagtctgattatattcacctgaatgtgctttgcactgcagctactgaaataattacaaccaatgctgcattgggttcctgttccaaaggctgtaagtgtgagagagaagacaaacatttcttagacttcaggccttgattatttattaagactcatccaggttgaaaaaaaagaaaatggaaaaaaagaaagtcgtgtaattcaggagccaaagggatttacataatgtatcattattgattatttagctgtatatgctgatgaaaaatgatgtgtacctttattcgttttacctttgataagacaaataaatctatactagataaaaatagcaaacagctgatcaatcatttttccaagtatgattttcttccaatttgtatgttaatgatcaaatgggggaggtgggacagcattaatctttctttataaattacaaattatctttgaaaaacaaaacctagtatttgtttatggcaggaaatatggagagatgtttaaaaatcaactttgttggaaacaagagttccataaaggacatgaccttgacaatcttctagaatcaaggaaaaatactgaagttttattctgtaaagagaaagccatggataggaaaattatctggcaatcattaaagagatactcaaaaggcctttgtggtctaaattttgacaaaagtttggaagctacaacattcaaattgataagaaaatttgtcaataaccaatatttaagcaatcaaattgtaaagacttcagatttgcagctgaaccatgaaaagacagagccatttacttgagatgtatgaaagcatcagatgaacctttctaaaatttgagtttgtggggaagggtccagattttcaattgtgaaatatctccactaacatgggctcacagctgtatatcacaaaagtattctacccatatcttttccttgggctctgctctctttctaatgtccagacagtgagaaggatctcatggtctgagtgtcccctctgcctgtactagtagtacctgtctgacattttgaaccccactctgcaggggctacaaatacaaagggtaaaatgagatgctggggtcattcaaatggcccaagatggactttttgagtcctagatcattgcaaatctttactctagaagaaaatggacttccggtgagcagtgcagccaagggtgaatttctgagaggtttacatacagtgagtcagacaggtgaccttcatctgtgtttgtctactttatgagatgtaccccgaagtgtggccatgaggaggagcagacaattatttcaaaatcctaaatttccaggcatgtcactttggacactccaaatgagcttgaaaccactgctttctacttttatttgtttcaaattgtttttttttttttaagtaaacaattttcaccaccaaagtaatccgaaagcactgctagacttggtttaaccaggctcaaaaatgcatcaatgaaataagtcagtagaggttaatgattaccaataattattttttcaaaattatccatcaactcatgcaacacaggatggggtagaacttcagtaaggagggaaaggaaatgttgcacacaggcagacagaatagcctaaatcaaaggctagagataggaaggcaccaggcttgggattgcctgggtggaacaagggactggaaaagaagttcagatgctctaaagggggcttgatccaaagtgaagtgtgtgctgggcacagtggctcatgcctgtaatcccagcacttttggaggccaaagcggatggatcacttgaggtcaggagttcgagaccagcctggtcaacatggtgaaaccctgcctctactaaaaatacaaaaattagctgggtgggaaggaagttgtggctcacacctgtaatcccagcactttgggaggcaaaagcaggcagatcacctgaggtcaggagttcaagaccagcctggccaacatggtaaaacctcacccctactaaaaatacaaaaactagctgagcgttgcagtgggtgcctgtaatcccagctactcgggaggctgaggcaggagaatcacttgaacctgggaggtggaggttgcagtgagctgaaattctgccactgcactacagcctggatgaaagagcgagattctatctcaaataaaaaaaaagtgtgtatgtacttcagaaaagtcgattaaccagtaagactgaccaatatggcatttttcagcattctaaagtttcctctgaattttctgttgaaatattttaattctggatcaggcactttcagcaatattgatgagttcccattcatgctcatccaatgggactctcacccaatgcatcccctaccccttacctagaaagtttgggcattccttagacatcaccaggcactgagcgttgcatagacattgttttcacctaattttttttttctttgagacagggtcttgctcgttggccaggctggagtgcagtggagcaatcacagctacacagcctcaaactcctgagctcaagcgatcctcccacctcagcctcccaagtagctgggactacaggtgtgcatcaccatgtctggctaatttttaaattttttgtagagatgaagtctcactgtgtggcccaggctggtctcgaactcctgaacccaagtgattctccctcctcagcctcccaacgtgttgggattacaggcatgacccactgcacctggcctcaattacttcttataatatgacaggttaggtattttattacccatgtttgacagcaaagaaagaggaagatattaaaaggtaatgaatgaaccatctacctaaggtcatgctgtagtgtgtgcttccatcctgcagcctaaagatccttcttggatgcctcttccaacagacaccctggcgtcctgataggcccaggggttacaaggagagcatgcaaacagaatgaaggggcctgcgtaacagcagcacatgtttcccataagtgtggccaatgatctggggctgaccctcccttgtggatctgtttccccttagaaaaatgaggtggtgagaatgaacctactgctctcccagccatgcatgactcacctgggctgtcctccaggcagaccccaactccaccacctttcttcccaatcttgcatctaagctctgatcagatgggaacaatcgggctcaaggaaggatgaggttcttagggttacaatgaatgacagtgagcctcccatacaaccctctggtctgagctccaggttcagggttttgaacaactgccggagcccacagcctggccacacagtggttcccgagtccaacggtgcagtccagaacacagtcattgactgctgtgctggactcgccaataactattcctgatacttaccattgcctcgtccttctgagatggtgcctttaaaaatgcctccctgggccgggcgcggtggctcacgcctgtaatcccagcactctgggaggccgaggtgggcggatcacgaggtcaggagatcgagaccacggtgaaaccccgtctctactaaaaatgcaaaaaattagccgggcgcagtggcgggcgcctgtagtcccagctactcgggaggctgaggcaagagaatggcgtgaacccggaaggcagagcttgcagtgagcggagatcgcgccacagcactcccgcctgggcgacagaacgagactccgtctcaaaaaaaaaaaaaaaaaaaaaaaaatgcctccctggaaacctacttgattttttttttccatcttagcacattgttccctatttaaaaaaaaaaagaaaaacatacctctctccatcagtaaaagagatgatattgtttcaaaaccaatgtgacattccttataagctttcttatgggtagttacaagaactagccgatcatgacatgaagtaattcttaacttgttccctaataagtcaaggaactagtctagtgggagcacctacacacatgcatggctgcatgtggaatctctatgcaaccattttagcacacacatgcagtttgagaatacaaaatcaatgaagactccttgaggtttccaatgggcaactcataatctggttggcattgatctgggtggcattaaagttttgttggagatcatcaactcactgtatttctccattagatataacttgtttaataaaagaaatctgcaaaatgtgtgaaaagaaccaatcaatcatttagaaatcacttatttgcaagaactaatcctcaacctgcagagatgttttgctgtggcagaaggtcagaacaacactgccattgactctactgcaagaaaacttatctcaaaattagctggatgtggcggcatgtgtctatggtcccagcggactcaggaagctgaggtgggaggatcacttgagcctgggaggttgaggctgcagtgagctgtgatcgcaccactacactacagcctgggcgacagagcaagaccctgtctccaaaagatatatatattaggttggtgcaagcgtaattgcagtttttgccttacattcacgggtataaaccgcaattatgtttgcgtcaactgaacagatatatcatctccattggatcagttatcatctcaggaccattcggagtttttcttgccatctcacccggaatgctctctttataggatgcgtctcatgcgacactcctccttctacttttaagcaagaaccatcgataagtaacacctgcgagatatctaacagagtaccacgtggcctttcacactcaggattttgcatctataggaaagatggtaagggaagaagaggatacatcactcaatacccttctgggcttacttccatgcttgaaaaaatattaatacaaagtagataaggcctttgggtttcatagctaatgagccagcacattattaaattacaggaagacaagatcatattttaactatgtttttgatttctcataacacctagcacattttgttattaataggcattatcataaatattgttgatgaaactgtatttgtaaaaatgaatttatatttaacaacaatcataataacattcatcttcactgacccttctacagccaagggcaggagttattatgacatcttattttacattgggaaaaaaatgatatccaggtgttaagtaacgcagctcactgaagcagggagtaagacctatcttgactccaaagaccatgcattttttcaagatatcaagctacctcctcatccaaacaattctaataatagtagtaataatagttatttttttattttttatttttattttactttaagttccgggatacatgttcagaatgtgcaggtttcttacataggtaaacgtgtgccatagtggtttgctgcacctatcaacccgtcacctaggtattaagctccacatgcattagctgtttgtccgaataataagttataatagctaatatgtacatagtgggtcagcatctaacttgctgaattctttacatatactaactcttaattgtctccaaaaacatataaggtatatgtgagctttatccccattagttgagaacactaatgcagggacagattagctaacctgcccaacaccacagaactataaaagtggagccagaactcaagctgggtggcttggctttcacctgcctgccataggacactggctcaggtggggattgagaccatcatttctctcccacatcccgcaatctccgcactgtggggatccatggctgaaacagttttcaacagtgacaaaaattaccagtggaagaaaaaataaagttttgtgatattagcaccaaacacagtcccatgatgcatgagtgtgcatatagtaaatgctcaattaatattagctcttgaaattgtattattaagactttgaaattgcctatacatttattttacttgatcatacctttgttcacaccctccaatcagtgttaaatttacaattatcaagttagtgatgtatgtgtgtttcagaaaattttacaataattagtgtgcattgtatctgactggctatattttttgtgatacggtaaaaattattattattattttacttatttattaactttggagacagacctcactcttttacccaggctggaattcaatggcacgatcacagctggctgtaatctcaaattcctaggctcaggtgatccccctgcctctcagcctcccaagtacctgggactacaggtggatgcctcgaaacctggctaattttttaaataatctttatagagataggatctcactattttgcccaggctggtctcgaactctgggctcaagcaattcttctgtattagcctaccaaagtgctgagattaataatagtcatgagccaccacccccagcctattattactgtattaggtttgaggttttgtttgtttcttggttcgcttagctttgtttacaggtttgtttaaatacacaagtgagatggtgaaactaattgtatctgtgtgtgcttcccctattttcaaatccgatattgctaaaatctgatggaacaaaatattcccactgaaagtgtttcggtggctcacgcctgtaatcccagctactcgggaggccgaggtgggcggatcacgaggtcaggagatcaagaccgtcctggctaacacggtttaaccctgtctctactaaaaatacaaaacaattagccgggcgtggtggcgggcgcctgtagtctcagctactcaggaggctgaggcaggagaatggcgtgaacccgggaggcggagcttgcagtgagccgagatggcgccactgcactccagcctgggcgacagagcgagactctgtctcaaaaaaaaaaaaaaaaaaaaaaaaaaaaaagtgtctcatgtgtagtcatctacctggtgagtctccctgaaaagaactctgttcatccattctagttctgcctagtaggagtgtgttcacagttgctgcccttgaggtcaggaatgtttccatgcatcctgcaggcctcggtcaccacctctccttttatggggtccctggtctctatcctccatgcagactcaactgtctttcctgcagtccatggttatgtatttcctaactaggtctgcctcttcataaaggaaaacccttcctgggggtactcacaacacagcattcttcctggcttctcttttgctgttgttggaaatcccaagcactgaggagggagagaaaggcaggggctttttatcacacccataggtgatgccatttgggtgcaaggcagaatgcagaccactaacactctctgttcaaataatcactatttcatgtttccccttggttctcagtgatgtgattcactctcgcaaacgttatttcatttatttagagctagttataagccattgtcatgtagctgatacaatatttcaaaggttaaagaataaattatctagattaaaattcttctggactttattccagaatttggacaagataacctattacagaaggccacaagacagaacgagatcctgtatcaaaaaatgcaatttcatattaatatgaagatgatcagccatttgtactcatatttatctgttgcctagactggagtgcaacggtgcaaccttggatcactgcagcctcaacctcccaggctcaagcaatcctctcacctcagtctcctgaatagctgggactacaggcatgcaccaccatgctcagctatttttttttttttttgtattttttatagagacggagtctcactatgttgccctggttgctctcgaactcctggaagcaagcggttggtgcctgctgggcctcccaaagtgctgggattacaggcatgagccaatgtgcctggctagaattgcattttataatctaagttgtcatataaaaactttatcctatggtattcatatcatttgtaataatttacattctacttaataaataagtttttgatcactatctaaaagtatcttttaaaaacattaattatacaggatgatagattttcaatagtcaacatgaactaaagcagaaaggtgctaattaaactaacagttatggggccgggcgtggtggctcatgcctgtaatcccagcacttcgggaggctgaggagggaggattgcttcagctcaggaatttgagaccagcctgggcaacatggcgaaactctgtctctacaaaaaaatacaaaaattagcgaggtttggtggtgcacgcctgtagtcccagctactccacaggctgaggtgggaggattgcttgagcccaggagcagaggctgcagtgagctgtagttacgccactgcactccaccctgggtgacagagtgaagccctgtctcaaaaaacaaaaaaaatcagcatttatggaacattcatatcattttaaagaaagcttagcataaagagaatacattagtcaaagcatacaaaactttggaggaatatcagctgtggaaactaagaaggttatcatccacactataatgacgtttcgaataagcctctccatgtaagttcatcattacaactaaagatttgggggttcagagagatgcacatagccattccaactcgccctgggtagtcagtcaagaagacacctaggacataagatataacgatataaatattttcatcaagatgacattgatagaactctgacttttcatatgatgctaatgttatccctttatatcaacagaaattacaatacagattgtctagaaaccctaagtcatgtcattgtacaagtgtttgctgaacgtggaccatgaatgtgctgtgaggacagggaagggatcctaaagatgaacgccacctgatccctctcctcagggtctttcagggagcgcatcattaaggcaagtgcttacaaattgcatgagctcctatactggtgatacaagaatagacagtgtcgtgctcagaagaggcagcatctcagaaaaagcttcagaagatgtcctcaaagatgaccttgaaagaggagagagagagaaggagcatgtttctcagagtgggacccatgaaaagcaagaggtggaaaatgtagccaaccacccagtgacctcaagaggtctagactatgattctagccaaggttctgacaacactgatgactaatatgaagatgtaggcctacacaaacacacacaaaaacaggaaaatacaaaggtatttttaaaacctgaggatatctcagagggatttttaagttaaaaagaagtatctctaggatggtccattatttattgaattttcttttgagtcccagtgaccccctaaatttctaaactaaaaagtaggaggacaaatttaattttggtagatttcttgattaactacaacaatatggtatgctcagctgagaaaagaatttacctgcaggttttagtgtagtcattctggatatttccggatgtgaatatgaatgttcaaatgaacataaatgaccttgatttgtaccctaagttatctcaacaaaattgtatgtcctttcctcaaacagagcaatctttcaaactgtatttatttttttaacttgcaaatttaataaatcatctgatttttggtcttggatttgctcccatttctcaacacaacattcatcttacttaatttttagcattatgaaatcaagaaaatattaatgaataaaaaaattctatttagaattttagaagaataagtttaaaaatagaggattgattttacacaattttgctcctcccaaatcatcccacaattctgataaactctcaagaaattaatttattgaccacactgctagttttgacccacatctttataaggaatttaaaaagcacatagactcatccatccagtgagcagtagaagtaagcaacactgcacggcagatttgtagctttagtgttagaatgtaaatgattaaacctcaaaatcctgaactttcttagactgcatcactgtcaatcttccaggcacggaccagaatgagaaatttgacaaaaattttctatgacatcatctttaatgaaatacaggcaaaaaatgtaaaaactctagggacattaatacagatgaggaagtttttttaaagatagccatttagaaaaaatcacatgcatgtactgagtgatccaaacatttttggtaaatcatgctaatttagaaataccaaagcaaacaatcaaggaagatcgatattcccttaggtgagagaggaactttcccctacagtgcgttgattttacaatgaaagacatccttccctcagtctccctggcttggctgcatatctcagaaaactgtgatagctgacttaacacttgtttttaccaggcaacatttgattttctcattcattaaatgaatatctatagagtgtcttacaactactcatttctttaataaatacccagtaagggctgatctattccagattcatgcaatacacatgtttagagaatgcagagaaaaattcactaaccccccagatcctccacacatatccataagtagacaaagaataaaaaagcctttgagatcaggtgagctcagagaagaaagtaaataatgggttaaataagaacacaatcgagggtggaacccactttaaatgggaacaggacagggtgctctgggcagagggagtggcacacaaaaatgtcctaacacggtatccactcagatcacaaaaccaaaagaggactgggacagcagttcagtgagaagaggatggcctgggatgaaggtggagaagtgagcaagaggcttactgtataaaagtggaataggtcagtgaaaggaatttggggttcattctcagtgtcatgagaaacagtcctttgtaaaacattttagactacgaaggagaaagacaaggatgggccaaagataagtaatgtcaaggccgccttcaacactttctaaatacctgttttaaagtgctttatatgcttaatttattcctttccttttcttttttttttttttttttttacaagatcttgctctgtcacacacgctggagtgcaatggtgcaatcctagctcattataaccttgaatacccaggctcaagcaatcctcctgtctcagcttcccaagtagctgggatcacaggcatgtgccatcatacctgcctaatttttattattattattattattctttgtacagacagggtctccctatgttgcccaggctggtctcgaactcctgggatcaagcagtcctcctgcctcagcctcccaaagtgcttggattacaggcatgagccacagtgcctgaccttaacttatttattttgcaaacatccctcgaggtaggtactcttctcacagccctcaacagctgaggaaactgagacacaagacgtcaactactgaaattcacactcaagaaagtatcaggtctcctggcctctgtaatggaaattgatgactaccacagaggaatacaaacaatgcatgttagagagagcagtgaaagaaacagcattttagccctcagtcatgaataaggtgtggagatgggaaaataacagtattccaggttgaaagagagcctgagaagaatgagaaaaagcaagaaaccaaggtgaaatgcagtgattcctatccatactcaggttgggtggaggatgaagtataacacccagaggagtaaaatgatgactgcagttgtaacggcggagatggggcaggtggtgaagcacagtggatgcttgtttatgaattttgaacgagatagtagtcttacataatcaattatttgtgaagatgaagaaagaatagctttaaaaatagattggagagtgtacaagtcatagacaggatatgattaaaatagtaacacataaagtgagaagatgaccaaggaaagtacagatgtatctcagaagaagaaatgacaggacctgttatttctgaaagtgatttacactggggatgggaaagagaggggattcaaatccaagatgaggaattgagaggagaagatgccatgagcagggagcagggtaagcttggcaagaaagatgatgggacaattttgggaacactgaattgagttttggccagagcatataggcaatgttgttgaaaggggagctgtaagggcaggaaggaacttggaagagaagtgagagcagaagatagagacccctgtggtctctccgatggaaataatcatcaaaccatgagtagatgcaaagctacataggacagtacggaaggaagaggagtgattcgaggatggaatttagggagcgacagtaactgcaaaggcaggaggaacagacaatcagaaaagtcagttcaattaataggcagtgaaggaaaattagaagaatagatttgaggaaggagaaagttactcaaagcaggagcaataaataagacagggcctatagagaaactccaagcaggatatgggtttgttgaggggtcagcccttccagtggtcagctagacaactgaggggatgccacctgctgtcagaaaaaaaggtataagggaagtgggaacaattacagaaatgtttctcaataagagtacctgctcttgaagtcaggacacaaataggtcttggaattatgattagaatggttgaaaaggtcttttcattttctttttttttttttttttgagacagggtctcactgtgtcacccaagatggagtgcagtagtgtgatctgggctcactgcagcctccgcctcccaggctcaagcaatcctccaacctcagcctcccgagtaggtaggactacaggcatatgctgccatgcctgactaatttttgtactttgtgtagagatggagtttcaccatgttgccccggctggtctccaactcctgagctcaagcaatcctgcttcagcctcccaaagtgctggatttacaggcatgagccaccatgcccctctgaaaacgtcttgataatggatatgtctgccaagtttcaggaaaaaagaaaaatgcatccaagcaacataatatggaagactgaaaaacagtaatctctcaaagtctattgattaccttataatcaccaaaaaaaatagtaaacatctctgtcagtctcatgtgtctccaaagcatctaataatgctgaccttcacctacctctgaactctctcccttttcttaactggacaactccacccataactgcaaccttggatggttattcattgtcttggcctctatccaatagtttgcaagattctatcagtatcatccttccaatgcctctgcagagcctcatgccatccccatttcctcaatctctaccacagttgaatctataactagatctcaacttgcattactgaccttctgtcttctatccctacctctactatcatgaaactgctattccttaaataattctgcaaaagtcctaatatgattgccccattgcctacagaataacatctatatggcttaccatcaagttgcaccacctgaaatgatctgatttcaatttcatcacccaaactcaacatgcccttgagacaacactcaacacaacacagcccattcctcaacacttgctgtacctatgtgtttgttcacactttctcctttgtccttatgacaaaattctatgcagctcataagccacctcctttggaagagcttctggtgatagtctagcttctgagatggccaactgacacctgcaattaacaccttcctggaatcctcatccacatggtgccagatttgatttgaacaaccaatagcatgtagcaaaagtgacaaggtgtcacctccaaatcaagtgcaaaagtgacaaggtgtcacctccaagatcaagttctaagagtgtgtggctttcaccttagactctctttcagcctccctctttctctcctcactttcagaaaagccagctgttaatgtcacacgtctagccctagggagaagcccatgtggccaagaactgaagcctcctgccaagtgacacataagtgagattctccaacaccgtcataaaactgcaagccctgtctacaacttgaccacaacatcatgacggaccctgagctagaactggccagctacactgctcctaaatccctgatgtatagaaatgcatgagatgataaatgtttgcagttttaacctaaggtttagaagaattttttatgcagcaatagataaccaatgcagtgtcctaaatgacacaaatggaaaacaagattctgtgctgccaaggtctgtgtttttacccacttatggaatgtgtgacgtgcatgccttgtagtataggtactttcatttctcattttctcttccttactgagagtctccctgggatcagaggttgaatcttatctgtgtttctatcactgacggtatctggcatggtgaccttctcaaagtaagatgtcagtacatagttatcaaatgtataaacgaagaaggaagaaaagatgttgtatgcatggtttctcagtctttaaaggaagaatagctgcatgcagcctggaattaccagaccttcgtttgagaagccatatacctgtggatccctgaaatgagaaacaatctgctgccttcaagttgctgtagtgttttgaatgataagcctagcatttgggggccatggggaaataaataatgcccagcacgtcaatgagtttttatggttgttgttattaatctttaagtccctcacagtccatagcacatggtagatgcccaataaatatgcattggcttgaattgactgggaaactgaaaacataaagataacttataaatcagtagagcacaactggatgacaaaaagcaaatgatgagacccagagctgtggatgccggcctctgaacaggaaggaataaaacagaatgttgagctcaaaacttaagcaggtcatgtgtgcacatgtaacccagaaataccctaaggcagtagttctaaaagagtgatcccaagaccagtaacggcaacttcaactggggaattatgggtcccatctcagatctgctgactcagaaactcctgggatggatcccagcaatttgcctttaacaagacctctaggacactctgatgcttatgtttgagaaacactacactggaccatctgcttcaaaagcaatgaagacattgggtttagcacctcctttcagtaacaatgtaccgaagactatcattctgagaaattcagcaacaaaatggatgggaattaaccccagaacccatggttttgtggatgcagcaatcaggcaaaccaggaaaccatgagccaattcttaccattacaacacatcgctgagggtctgcagcaggagctcaaactctatcccttttatcactaaaagatgtcaccctgcaacacgatcatcccccaatgtattcatctctacaaccatttctttcagttatttctacctcctcccaacttgcagttttctcatcattgggaagacctttcatgaaccctgacagcatccccatacctacgaattctcatattctcctagccccatgcccattggctgtgccactctgattagagtcatggtgtcagaagcatttatgctattgcttgataagtgtctttatcctccagcagagcacacactccaggagggagctggtgtctcttcttcacctacctcactgagcagcccagtgcctgccagtcaacgggcactcagtgatcagtgtactaaaagcacagctaagtttcaaaaagttctgacattcacatcaaatgtgaggttaaagagggtcgcattaatccaatttctaaaggttaagaaagatctcttcccagataagaaaagagaaggcatgaataacaaaactctatgtccatacaagagcagggaaagatgtagtgtttgatcatttgtttaatggtttacaattcacaagtttgaagttgaaaatacactggagaaacccaacgttgcagttcctatttcctgagagtcagacatagaataaagtgaaggcaaaaattgaatactatgaagtgtactccccaccaccaagttcaatttcagtgcaatttcaattatctaccataaattacacactgtgcttttaggatactacctgacttctgaggatctagatgtcttgcagtgtgtaaatacttgtgaatgggttttaaattacaccatttctactagcaagcctcctcttgccaattcatatccaacacttaaccaggtcacaatgaagtttatttagaaaacacacggagcatctcatatccctaatcatggtttaaaatgagcagtattcaagtcaagcgtcttaattacaatgatcattgttctcaaatcatatagcttagaaaggccctggagacaggtccaactcactcattttacagttgagggaagggaaacccaactgttgatcttcagacacctgcaatgaattatgagaccccccactccacaatgtgttgatgcagtgacatggagcagtggagtctctaaaatcctcatgacgatgtgaaagtgattctggaagacaagtgtggctgggtgaggagtctgcccttcaaacccagctctgccccaagctggctgcataacttcaggtccatccattatgtaccacatgggctatgagtgatatgttcattaatttgattgtgatcattgttacacaatgtatacgtacatccagtcatcacactggacactttccatattacagtctttgtcaaataagtatttttaaatgaaaaaaaatgaatttaaataaataactctgtgtcttggtgtatgagtttcctagagttactatcaaaaagaatcacaaggcttatgtctcaggaaacaggaatatactctctcaaagttctgaagtctagaagtccaaaatcatgatgttggccatgctccctctgagggttcttggtgaggatactttcctgtctcttctaaattcagggagttgccagtaatccttggcattccctttttgtagctgcatcatgccaaccttccatcatcagatggccgtcttcaccctgtgagtgtctgtgtcttcacatggtggttacgacaccagttgtacggaataagggccaccttaatcacctcattgtaattacatctgcaaagaccttatttcaaaataagatcacattctgaggtgctgggcattaggatttcaatatatctttttggggaacacaattcaatctgtaacacagttcaatccataacagtaaaccagattttatttgtaaaattagagggtaagaatcaaggtattttagtttcaatcactaaaatgtcaagcctggaacaaagtagaacaataaaattgcactagattctctctctctctctctcacacacacatacacacacacacacacagacatatttagaattgggaattgagaaaatgcaacctttggatggatgggtggatgagtttactttcaaacaggcattttatcatcatacaaaaatgaccttgccatttctacacatttgcatcacattgatgaatgaggtcagaatatattctctctgcacatattcaaaactgcatccaccataaatgtggagcacaactgcaaccaaactgtatttgggagcaatttgcatacatacatcaaacactgtgtgcaataatgtataataagttaacttttccttttctcctataattggctggagcctgatttattgacctatttccttgtagagcaaaaacttattgtaaacccatcccattacttagttggaatattttaaccatggcatcaacatctcaaaaatgtaaccaaatttttaaaaatgtacccaagaagaagtaaaacacttacgtttatgagtggcttaatgaaaataatatagattccttgtatcaaatataaatattaaataaatgcatatgggaaaagaacaggattcactgcattatacaattttatagaatgaaaatcttcttgactagttggtgagtatctcccagacttttagaaatttgatatggagtgaaagttggtgcttcaaatgaaatgaggcttattgctattttattaacattggaataaaaataactggttttgcatatatccttttattattaaagatgtaaaaggtgtccatttattatcaaaattaaaaacgatattataaaataacctattatgaggtcacttatgacaaatgttatactgcattctttggggttggcgacattaattctgaatctctgcggttaataatacatcttttaaaaacacatctgccacataaattcatctcatattcactcacagaatatcaaaagttcttattttgttggataatctaattttaatcaatcaatgtaacagttcagaaaatataacaccattttcaaacagtcttaaatttaattttctgtgcagcacatttctggtgttcccattgatgttaataagttctaataactgacagctctcatcaatgtgttcatatctgtggaacagtaaatctcatttttcacatcaaatgttcaaatactctcttcccatctactgagctttcatttggaacatgattttgcccaattttagataagctagctgcatttcgttctgcactttgttctatcagatacttatcaaggattttctttttctttatttccagtctttgttttctcgtaagctctcacttatataaatcaatgccacctcctttcggataacgtgcgttatattaactgtccccaaatgtcaatccgattctcattacaattgatagaattcataaagtctattctggttatgaaaaacatcttccaaaataatgtggttactatctctcattgcactctttgcccagtttatcttatctggtcatgcccagtatacacgtcggggctactagaacccaaaaaccagtgaaattccccatgtaaaacttggaataagtacacctcatttcataacagagctttttaactgggatggattttactcccaaggggatatctgagactgtctgcagacattgtggatgtcaaactcaaaacataacagaggttgatgaggatgcagagagaagggaatccacatacactgttgatgggaatgtaaattagtataagttctatggaaaacagtatggagagtcctcaaagaactaaaaatagaactaccatcttatctagcaatcccactactgggtatctacgcaaataaaaagaaatcgctatgtcaaaaggatacctgcacgcatacgtttaataccgcactattcacaatagcaaagatatggaatccagctaggcatccatcaatggataaatgaataaagaaaatgtggtatatatgaataacgaaatattattcagccataaaaagaacgaaactatctcttttgcaggagcatggatggaactggaggccattaccttaagtgaaacaactcggaaacagaaagtcaaaaaccacatgtcctcactcctaagtgggagctaaataatgtgtacacatggacacagagagtggaataatagaccctggagaatcaaaaaggtgggagggtggtaggatgatgaggaatgagaaattacttaatggatacaatgtatgttatttgggtggtggttacactaaaaacccagatttcatcactatgcaatatatccatgtaacaaaacagcacttgtgcccgttaaatttatataagttttttttaaaacaggaacgtgtatacaacgggcacctagaagcttgagtccagcaataccattcagcatcacgcaaggcacaggacagccaccacaacaaagaattatccagcctcaacgtcaagagcaccaaagttagtaaatcttgttttgtaagagacatgcatccttttaaaatatctgagtaaatcaagtcacattttaaattatacagaatttaatagtttgtaaaattctctagtgcatccttgtgtaacaggttccaatgatctactaataatagttcaccatccctgatactcgcttagaagtctggatttatatcatgcatacacacacactcacagatacacacacatacacacacacaactcttcttaaaatgaggcatacttacattagcataagaatgatagccaactatctataactgtatagattagattagtttggttttctttagtcatatttttcctgttttttagagacagaatctctctgtcacccaggctggagtgcagtggcactatcagagttcactgcagcctccaactcctcggctcaagccatcctcctgtctcagcctctccagtagctgggattacaggagcgagccatcacatctggctattttttttctttttttctgtagaaacgcggtctcattatgttgtcgaagctcgtcttgaactcctggcctcaagcaatcctccctctttggcctctctttagcctctatcattcaaaatatcacatgcaatgtggagttcaatagaactaataattttacttaactgtgggttggcaaagaggaaaaaattgcagttgattctttgtgcgtgcgtgtgcgcccgtttgtgtgtgtgtgtgtgtgtgtgtgtgtgtgtgtatgtatgtaatggtgcaacaaaagctaccttctgacacccctctatctttgcttctcatcagatctgtatctctgccaggtactagataatatgaggctgaggtgggaagattgcttgagcccagaagttcaagaccgcatcgagctatgattgcatcactgcactccagcatgggcgacagagcgagaccctgtcttcaaaataaaaccttgttaaaaatagataaaactgagatatactgagtccaaagagctgtcacgtagctggccaaatttacccagcagcattccttctgggtagaacactaccaagtcacacagcgtttgctcctaaggagttagtaacttaagactgtgcattacggaaaatacacacgttccttctaaaataacttgacaactacattttccaattctaaaacccactttcatgtagagtaaaaagagcagttttttcaacaagaatgtgcataaaaagatagggaagctatatcaattaaaagaaatgtaaaagacaaatcaacctattgcagtgctagaccttgaccttgcgtgagttacaaaactacgagaagatcattttgacagttacaactttatagtggatgatacagaggaactactgttgataattttaggcatggaaaagattctgcagctgtgtaaaataaaatggttcctatattttagagcaacgtacagacatatctttaaatgaattacatcatgccataataagaatggaaatatgaatgaagttagatactaaagattaggctatccattcataattgctgaagccaactgatgggcacatgggatcctttattctatcttctctgcctttttttatcataaccagaaattttctgtagtaaaatattccataaggtttcaagtgaatacaaatgtttacagaagggatacaagagggaaaaatgtgtacagaccaatgcagaatgttttttgaaacatacaaaagaaaataagcaatgcccctataatgaagaatgcccaatttgaaaattagaggcgggaggggtgtggagtaaaaaaagaaaaatacattagaggagcaaaaacattaaaataagccaaatgtcaaaaaatatataaagaactgggtatgttaaagcatagtcttttgagaaaattaaccatgaaaaacaatgcttatgaagatttttaataatcctaaaatagcttatgctatcatactgtaggaaatgtaaagttcaaaatggtatagatagagatatatatagatctagacatagaaatataatgtgaatatcggtaaagatatgtgtacagatacaaaaatagatatgattaagatatagataagaatagatactgttattgatatgctgtagctatagactctaatattggtacagataccatacaaagatgtgatctacaggcaaatatatatgtccatacgtacatatgatataaatgcaggtaaacacgtagatgtagatagagaattatcatctgtgtttaaaatattcacaaaatcccttgaacaaactatacagttatttactattaactactagcctatggaatgatgatccagttttacatttcttttttcaaagtttctgtatttctttcccatactactcttcattccttcaccataagaaaaaaaaacatcctgcccttaaaagcctccttgaggctgggcacagtggctcatgtctgtaatcccagcacgtcaggaggttgaggtgggcggctcatctgaggtcaggagttcgagaccagcctggctaacatggtgaaacaccatctctactaaaaacacaaaaatcagcctggtgtgctcgtgggcacctgtaatcccagctacttgggaggctgagacaggagaatggcttgaaccaggaggtggaggttgcagtgagccaaggtcgcgccactgcactccagcctgggcgacagagcaagactccatttaaaaaaaaaaaaaaagagtccttgaaatggctacgatttgcttatattccttattcagagaatagatccagttacatgaattaaaaaaaaaagactgcttcttaagcaatgcttaagtaataaccgcctgtatgcatattaaaattttatgttaaaacacatcataaggttaagaggatgatatcaccttttgaaatactgatggttgtgacaagacgcacacagccattcatctaccctgatcaatggggtcctctggaagtcttctggttagtaacatgttccttcaactttatacctctttatcaaaagacactaggatgagtgttgggaggaaagccccactcttaagctgtggtatgggtggttttgcttactgcataggaagttcgtagattaaagcaatgaagcatattcaaggacgctgtaatgtttgcccatccactgaggtttcctgatggaagaaggtgtttttgcaagctgagcatccatgaaccagcagggctgagagtttctctaagagtcatttaccattgagtcccctcatttacttgctattcaagtgaatagactctctggtgtctacatcatggccacaaggaatataaagtggaataagtcacagcaatgtagcccaaagcatatctaaaatatccatgtgtccatactgatataaatgattgattaagtaaataaaggggagagacccatctttcttagagaagaattccaaataatttatcgatattccaccatccggaaagtggagcttaattctgcctcttctcccacccccaccccactttagggacttggtttcaaagactagacttgggcagggaggggagagtacaactttacagcagagaaaagtgacaaactctctgtcagccaggtgatcaaagccaacaccagcagcaaaagtcttctggacagtagtcaccgttgctagggtgagatgaaggaaaccttcatctctgtggatttcctcccccaaacacatacccctgtctaaaacatcagactggctctagttggtggacattctccatgacattaatacctcaaaactattaaggtcatgaaaaacaaggaaaaactgagaaactgtcacagactagatgaggctaagaaaatagggcaaatccatgcagtgtggtatttcagatggtacctcagaagagaaaaaggacattaggtggacaccagtgaaatccaaacaaattgtgatgtcagttcttagtaacgtactaatgttggttccttaagtgtaacagatggtcacgtaagatgcgatatgcgtgtggagttaaagagtaactctctgtactatctttgcaacctttcagcaaacctgaaactatcctaaaatttttaaaaggttattttaaaaaatgaaaacagtagcgcacaaatgtcctttaaaaagattaaaacaggtttgtattttgtaaaagtagtcaatgtgtaagaatcaaagagtcagaattatcatctcagtggaacaattctgctggcttccactcctgaaactttccaccaaatggaataatcagcaccttcttttaatcctgcagaatcaatgcctcagtgtacaaaagcaacagcaacaaagttaaagtttggaaatgtctctcctctacataataaatggagcattcccagcgcacttactttaaagcattgtggaaaaaaataatgaacgtcagtcacacagttttatccactgcggcattctcaaatccttagatggggagttgtaaaaaccaaaaaacaccactgacaaggtcgtcaagctgtttgacaaaccataattaattctcaggtcaacagaaagcatctcgataaaagctgtgactgaaaatactccaggtttcacaggtctgcactgcaaaaaacagttaccccaaaatatgaatgtcaggagtggagtgggcttttgtcgttgacgcacaacacagcgggttctgttcttaacacatctgcaagtccttattctgcccttcgtttgcccttgaaccagccctctgagaaagactaatcatcacaaaatacagatttcaccaagtcatctctctcttggagagttgacagggcatatgtgaacccttcaattttacaagaccctccaagagactaactcctgcaaatccaacttcctattttgccttctgtgtctctttgaagctgaggatttcaatgcacaggctcacccgcaaaagagggtcgtggagcctctttgcctctaggcccttttgtttgactcttaatctaatgaaggtagatgtttcttttctcttgattatatctcccaggactaaacatagatggagagagaagtagaatccaccagtttttgcagaaagatagagccaagtgcggtggctcgcaccagtaatcccagtatttcaggaggtcagtccgaaggatcccttgagcccaggcgttcgagaccagcctgcgcaacatagtgagaccccgtctcttaaaaagaaaaatatgtgtatagaaagttctcatcacagacaaagccctgtaaggaaaggaaagaatcatccctgaaaaagatcttatcctttcttaacaatgcttgagacacagcaaggtgcattaaacaaaggcaattaattaacacttcaaaaaatgtaaaaatgctgggttctgacttacaaataaaaacagggaatgggagcggggttagaaacagctaaggtgcattcatcataactcataaaacaaaatgagttcccaccaacaagttcagcttttaatgtgggacatgtcttttcctgctttctctgctagtccctttcatagaaatgatttatctgtttaaatcgctgctgcataataaagaaaagtctgttttgaaaattaaataatgcactttgctttattttgcccatttaaaattacttctaattttgtaagcttgtcatgaactggcgtaagcagatatgttaaaaattgggggtattcctttttcattgcagggatagtgtttaaaattatggagataaatcacggccgggcatggtggctcacgcctgtaatcccagcactttgagaggccaaggcaggtggatcacctgaggtcgggagttcgagaccagctgaccaacatggagaaaccctgtctctactaaaaatacaaaattagccagcagtggtggtgtgtgcctgtaatcccagctacttgggagactgaggcaggagaaacacttgaacctgggaggcagaggttgcggtgagccgagactgcgccattgcactccagcgtgggtaacgaaagcgaaactccgtctcaaaaaaaaaaaaaaaggatgaggataaatcactgaaactctctgtgactcaatttccttgtgtacatgagggaatacaaatgattgctcaagtacattcaagtcctaacaatctgtgattctgttttccaatttcatcatgagtatcccaacaaactgtacttcaaattcaatgcaggcaatttagtagacactgaagcatatttttacctttccaaattggaagtggataacaaggtaacaatagcactgtccctggagccatcctgtcctgtctactcccagtgaagtgaaatagctgaaagatgtggagagtaaatactcaaacacttttttttttttttttgagagagagtcttgctctgtcgcccaggctggagtgcagtggcgtgatatcagcttactgcaacctccgactcctgagttcaagccattctcctgcctcagcctcctgagtagctgggactacaggcacgtgccaccacacctggctaatttttgtatttttagtagagatggggtttcactacttgaactcctgacctcatatgatccacccacctcgtcctcccaaagtgctgggattacaggcatgagccatcgtacccagaccagacccttttcttaatttgaagagagaatttttttcctgtcatataggtgttggaaggatgtcagatgagagctgggatggggagaggaagtaaggaggaaagataagcagctcccttccattctgacctgctgtggcaagaatcccgggactagcaagaccaacaggatgcagctggcttcactgaacataatttgctattagcatcttcaggaacacacactgctggataaattcccttccaggagaggccacaactgaccactacatggaagagacagctgcttcttcactagccaatgaggcatccccacccaagtgtgaccaaatgcctctgaggctcagcccctcactccagaatgcccccaggtacctgaggatgctccagatttgggggctgcaccgtctgtggtttctctacattaaacagtatttttgtggagtcaggggtgagggagtatggtttacttttaaatatagttttgcaaactcctctgtttggtttttgtttgtttgtttttcataagctatgtttaaagtcaatagagaaaaggtaaatgcataccctggaattattcagcaatagaataacaccaatcaaattctgtccagataaatgaggcatttgaattctttttaagagatggagtgtcactctgttgcccaggctgcaatgcagtagtgaggtcatagctcactgcagcctcaaactcctgatatactcctcaagtgagccttacacctcagcctcctgagtaacagggactacagacatgcaccaccacacctgacttatttttaaatttttttcgtatggatggtgtttcctagactggtctcaaagtcctgggctcaagtaaccctccttccttggcctctcaaaatgctggaattacaggcatgagccactgtacccagccacatttgaactttttacaaatactgctacagcattacaggtagaataattattctttgaaaaaccttcaggaagatgtgctccccaataaaaagtgagctatgtatgcatatgtaaatgtatgtgtattttacatatacaaatatatgtatataatttacatatgtatttataacatcaggatacatgttggtctagaaagaaacaattttttattatttgggatcttactagattaaatgcctaaatacatttgattgtgaaatgactagacacataacttcttgtgtaattttaagttaatttttataaattatgtcatattctggttattcacttacgggaggcttatcaattgagatatcaaataaatcctggaaggttattttactggtgaaattgtcatgacagactgaatcatagtacacaaccactgtcacacaaattctatgggaagccatgtgtgatttattgttctgtcctcataatatggtaccgtttaatctctaccatgaacctagattgtcagaagattttttttttgaggtattgattccctcactagggttggttggttggttttatgctgcaacaaattcagattttccccactttctactactgccattcctgtgtctgctttatgttttcagtctctgcacaggtaactggtatttaacttccatgtaacttgttaccctttctccctgggtcatccttactgtttgttactgtttgagacagcatgaggggccttgtcttgaccttcctactgggttacattttagctagtaaccagaaccctctgtggtaacaggcaactagaaacccaaatgtaagggttttgattgtggtttacttatatttgttttcattgctgttgctattttctaaatgtcttgtctacttctcattggttctgatgcactaagtctatccgttccgcctaattccctgtaatggcatctacattattcatttcttcccacagcatacagttggcatgtgggtaaatttgcaatacgggcatgcatgttaaggcttcttcagccaacagagcaagcctgctacctcaaggctaggacaaacctaccctcaaaagcattacctaagacaagcagccttctcccctccctcaagaatcatattaactccatgatgtttatcaaatactttcatctccttgctcatcaactgtagtagtcggtctgttgaagaagttaaaatcgaactatataattaccctctgagaattcgaacatgaacctaattcctaatatttgggctatgtagctctgatgattttgcccttaactatttaagaaagatgtatgaagactgaatcaagctgttgttttccttaacttttgaaataggacatgagagattaaacccacacacacacacacacacacacacacacacacaccagaagaaaaattctggtaaaacttatttgttcttaaacataaaaccagaggtgcaaaataacattagtgtatggttaatataggaaagataagcaatttcatcttctttgtaccccacttattggtactcaacaagttttgaataaattcgtgaaataaagaaaaaaaccaacaagttcatatctccaagtagtcttggtaatttaaacactttcaagtatcttcataccctgttagtacttctttctgctctgtgtcaacagaagtattctcaacactcttgtggttaatttggttaaaactcattacaaagaaccctaagttatccgtcacagctgctaaacccattagtacaggagactttaaggccataatgtgtccattttcaggatataattgaagagaggcaaatgatatatggttttccaaaaatattggaccaggcagcctcttcaagaaagaatccctgattcgggagttcttatactttttcaagaaataatatatagtaaaatccatatacatctataataaatatattccaatgtatatatattgtatatatatagttcttgttcttttgtatgaaaagtacatgcaaattttatatgtatatacatatatacgtatatatatgtatgtgtgtgtgtgtatatatatatatacacacacacaaaccatatatatagtttgacatgcattttccaaaagaaactatattgtatgtggtgaatgaacttccaggctggttcacaggagctattgttagttaatggtgcacagaaaccacagcttccttccctcttcccttcctttcttctttccttccttccttccctccttccttccttctttttctcttctttctttccttccttctttccttctttccttcattccctccctctctccttcctttttctcttctttctttccttcctttcttctttccctccttccctccttctctccttcccttcgatctatcatccttctccctccctccctgcttcctttcttccttccttttctcttttctttctttctttctttctttctttcttccttccttccttccttctttccttccctcccttcctcccttcgttcctccatcccttccttcttccttccgtcctttcttccttccttcttcccttccttctttcttccctcattcctttattctatttggatgagtgacaaggtctcagggatccttaaagtattaaagagaaaatgaagataattctatagaataacagatcaaataggaaagagtaatgaaaagaaagactcctggaatgacaaagaagcatgttcatgacaatttaatagaatttcccacatgccatatttgtatagctggttatattttaaaactttgtcaaaccctatatttataaaaccttgattttgattttagtaaattctatgaataaatgcatacataaagcagattactttgattcgacaaaaacatacaggcacctgtgagctttttttttttttatgtggtagtggaaacagcctcattaattaatggctatttcctatattctttttaaaattaataagcaacagtcagatatttcagcatttttaaggcatgaacaataccttggattctaatatattttagtctaaaatatctggtaacatcacagataattgtttcaaactctaccacccctcacacaatttatttttcaacaatttaaagtcttttagaataatgagataaccttaaaaatagacaacattactcatactggtgagctaggattgcttaaagatgaggcatagattgcattgtctcagaggaaaatatttctcagagggaccaagagaaataaaggtgagaatcttctacaaaggcagataaaagggttatgagtttagcgttggtaaagggtgcctagtttgatctttgtaaaagttgtctatttctccatacaagtacacaacattgcacaatattgatggacaagagagggtagaattttgtcacacatagatagtttcactataaacataggcggtaacaccttttttggaactagtactcaaattagaaaaaaaaagcttccaggagacctagagaaaatggacacctgtcccttaaacacatactttctacttacttaggtctcatgttaacgaatgtcttcactcctaaataaggagtacatccagacccatcataggtaactttataactttctttttttttttttttttttttgagacagagtctcgctctgtcacccaagctacagtgcaatggcacgatcttggctcactgcaacctccccctcccaggttcaagcaattctccggcctcagcctcctgtatagctgggattacaggcacacaccaccacacccagctagtttttgtatttttagtagagacaggatttcgccatgttggccaggctagtcttgaactactgacctcaggtgattcgcccacctcagcctcccaaagtgctgggattacaggcgtgagccaccacgcctggccaactttataactttcattgtacattttctatttttatttattatttatttatttatttatttatatttttagagatagggtcttgctctgtctcccaggctggagtacactggcgtaatcatagctcactgcagccctgaactcctgggctcaagtgatcctcccacctcagctggaaccacaggtacttgccatcaggcccggctaatttgtttttaatttttgtttctttgtggagttggggtctcactctattacccaggccagatgttatgagttgtttaatatagatttggtgaatgatgaggataagaaaaagaaaataatggaaaaccacatttttccttcttatattatatatatatatatatatatatatatatatatatatatttgcttttatctaatgtgttgcaatggctgagaaaaacattttcagcaaagactagttcctagttaatgtgttagcatatgcatacatgtatgtgtatacacccgctcatacacactgccattcttaccatgtagcttcagggcatgagggcatattgtctcacttaggaaaacagttaacaatgacatattttgtttgtgaaaacatgcatttacttttgtgagtttccccacctaacccattcacagagttatagtcacagagagtactgaagagtggaataagttaaaggcactcagttgcagcgagcttcttctgcccccatcccccatgcttttgagaccacagttccatgctgaacagctctgaccattggagtcacacggcatgcctcactgagttcttggacttgcccgtcccatactccagagccacatattggtggtgttgaaatactaaacatggaaaatggcaccgcatgcaacttcaccacagccatcatcacagaaccaaagaggccttttctgcactttacaaaaacaaaccacaattcaccatagctcttttatcagtgccaataacacttttagtaacctcagtcctttcttttttaaaggatccaaaaacttaccaagtaatgcaacttgaaacaacccaagttccttttcagcttatatgacaggctaagtttcactcctgaaaaaggtgcccttagcaaaatccgtgtcccctctccccaaccaaagcatacaaacaaccaaacaaaaacaaacagaaaatgagcctggatgaagggttgatgtgggagccggacagatgcccacagatgttaataaaatcacatgtctggggtgatggctttgagatccaagttttcatcatccaatcaggtaccagcctcttaaaaccaaaatgatcaccgatattaacaggtggagctaagaaagtcctgttgtaagccaaaaatagcactctgttactttgacaaaccatgatttctttatataatatacattttaaataaaacaacccaaacaaaattctgggccatttatccacatttccagagagcagtgaaagcctagatcgtttcattagcactatactgaaattaacatttctctctttgaaatgtattcctcaactaatgaggacctaaatgttcattgtacttcatctcctttctaaattatggaggattactcttttcctgtctcaaataaattcaataaaacctcatgatatggtttggctttgtccccaccaaacctcatcttggattgtagctcccataatccccacgtgtcgtggagggatgtggtgggaagtaattgaatcatgggggcagtttgccccatgctattcttatgatagtgagtaagttctcacaagatctgttgattttataaggggtttcccccttcactcggttctcattcctctccttcctgccatcatgtgaagaaggaagtatttgcttccccttccaccatgattgtaagtttcctgaggcctctccagccatgctgaactgtgagtcatttaaacctctttcctttacaaattacccagtcttgggtatgtcttttttagcagcctgagaatggattaatacacctcatctcactatatatataataataagatatatagtgtatttttatatacatgatgcagaccttactataatatgtattaccatatatatattatatagtaggatacatatcttactatatatagttttttatatacgtattttagtattgttggggttaggtctgttctccttcaggtaccatttctgggaagatgagagtgccttgggaagatgtggtgtatggaggtgttccgcacacacctgggacacgtgaactgaacacgagatgtctaaagtttgaaatctcagcccgaggtagatgggctgttttccaccaccaaccttccactcccgtaatgattttatgaggcttttatttacttattttttgtttaatgtaaccacctgcagagggaaagccttttcatctatacatttattcaaagcctataaatggcacaatgacaaactgctaggagctatcaccttcttttttttcttgttcatgtgtgctactgtgctccaagaaaaatgaggaagggcttcctacactgccgttcacttaacaaagaacagtggagcctttcaaagtccaaatgtaggttgtttagagaaaaatgacagaactggaaaatattcgttgagtgaatggtagtagagagcacagcagatgacctaattgcctcagcagcctgggcttcaattttgattctcacttcctctaattgactgtgcaaaagatgtatctttgatttaaaactggtagctcaggagtttaagaaatcagtggtggctattcaaatctgtctgaatatccattcacataattaaataggagacgaagtctctcctctgaaaaagtacagtactcagacaaaaacacacacaaaaagagcaacagatttaaactaaactgaacatatttccccatttgggaatagaatacatattgttaaaaggcagaaagcagtacagaaagaatacattctggtttacaaactaaaatcgtgtctcttacacttgacattcacatcttaagaccaactctcaccttatttggaatataagtatattttaaccagataagcctatctttagaaggaggatactaaaggacttaaaatatttgtatattgctacttcatttgaatgcaatgcattcgctcaacaagttgcattattggcaatattcaacagtattacaaaaggtttgaaatgtggcgtaccaattaaaaagaaagaatgttaaacggaggtcattccctcgtgcacttgaatgtttagttttttgagaaccttttggttgtggtctagaaataaaagcacagtattccaaatggcttttaaagagacccctgcacttccaaaagcaagtctctgttgcggagtcagtcaacactctcatctttgtggagagactataagctttccacaaattactacacacaaaacaatgaaatagccaagttcacaaattttaaaaaatctatatatttaccattaggctacattccaggccaacaactatgaactttcaaattctttcaagtctgcttgtaaatttcacagcatcaagataacttcattatctaccttatgcagccaccagtcccttatcaagtatctgttacattctcaggtttgggtaaaaatcagctaggttactggtttgagggccaactgtatactcggcattagtttatttaaataaaacgcaaagaaaagtagcaattcttccactggagaagaaaacatcaaagcatctttaaaactgcatccacgcacaggcattattatgaaaatgcaattattattctgatttcaaaaaaaaatgaagccttccattttaatctactgacttaaaactgatgaagtaattttccacttgctacaactggccctgattatgttcttacatgtcaaagaaaatactctttaaaatggccatatatatatatatatatatatatatatatatatacacacacacacacatatatgtagaaatgtagaatgcgtgtgtgtatgtctgtatacacacatacacacacacgcattctacatttcattgagtaataaaatactgaatttctaatctgagaaaatacatgcttgcagagttctccatgaaattcctgtattcttaattttaggatacacagaaattccatatttttttctggaaatacagggattaatgcaaccatgtgccattagccatccctcccccacttaacattttgctcatttccacaggaaaatctatgctgaggatttaatggattactgctaacatcttccccacagccaactaaaggtatgaaataattctccactctccaaatctgcccccacaaaacggcagatttctttgctatctgatttcaccccgctctgccatcccctaggaaaaggctcagtgcgtccattcaaaccatgcaggtctcttgcagtttctgccgctttgttctcatcaaagtcaggtgtttgcaccctggccatttaatttctagctggagaaggaagctaccccggatttcttaagcatgcacttctatgttgcccgcagaacgcccacacaaactggcaattctgcttcgtcaggataacgaggtctccctaaactttttcttttccttttttttctttctttttttcttttttttttttttttttttttttttttttttgcttttgccttcctcacatcaccggaagggctgattctgagatgggagctcacgcacaccaccccctttcaagaaaatataatgcaacgcgctccgatgtaaaccctacgggcaacggatgccttcaaaaagcataagataagagcaacaacaacaacaacaaaccaccgccccccccaaaaaaaatgaccaaatagaaataaaataaaataaaaataaaaagaagccatactaccaccttgtggatccagctcgcaagaacatcacctgcttagttccaaaacccccacccaacccccaccccaaatttcttaagttgggtccaaatgacagatcgggatcctctgtcctcactccccgcagactcgcccaagccctaggctgaattcgtgacgcgcgcgcccagcacccgggcgagttgcaagccccggcgcaccgcaggggccaaaaccccgccggaacctcctaggaccccttcacgctgcctcctgcaccccctcccccgccatccccgagatagcagcagcacatacacaaaaagaggctgacacctgccgtaggttcagaggaagaaggcagagaaaaagaaacccgcagtccggaaaaaaaaaaagccttctggggaaggggaggggtatgatgcggaggacgtcctccggctgcccctcgctctccatgcagaacatccgttcccagggtggcccgggccaggcctcgggggtgcaagggttggcctgacccccctgctcccgcccccgccgctccgggaagaaagggcgctgtgtctggcggcgagcaggcgccggaatcgtgcgctcgggcccagggttgcacggagcactgggcccggataccgggggcgcaaagcttcgggtgcggcccaggagaaccccgccgagggaccccagcctaccggttctcggaggggcgaaagagccaggtcaggttgagggacaggaggaggaaggggtgtccaggagactgactgaaggatgagagtgtcctccggggtagcgaccggcctcttggaaaaccagaggcggagggagcagccgcggagtggagggcgcaggccgggacctgggcctctcctcccacagcaagccccccacccacgcatcatctgcagccgagcggcacctacctccctctccctacctcatccccgctcgcgcttccgcaggtcaggccacgcgggtgccagcgcgggctgtgggcgccccagccgcggccttggggaggggtcaggactgaagttcactctctctctgcgtggtctcgaagcccctcgcccaccccgcactgtctcctccgccgccggctgcgcgcttggcggatcttctccatcagttctgcccactggagtgggaaggggctgagccgagccgcgcgggaattgggaggcggggaagcggggaggcgggggaagagacgagatgaaatcggcccgggacagcagagaggcttgggatgggatggaagggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcccccccgcgcccccctcaaaggttcagactacactcaaaggctccgaaagaagcaaaaccaccagctctaccctccttctgcggcttgcctcacccttcccacccgcctcgaaacccacacacacgggaaaggggtgcatggagcccgctccccggtttacagaagcagcccggagctaccgtcatttcatcttcacgcggggtctccagcgcgcctggatcgttccctagccaagccaagccaggtctaatcaatcacgtgcgttatttcgtgcatcacccaagccgtcatcttatccgaggcccggagatgaaggagggaaaaaaaatcgcttaaat

SEQ ID NO: 1350 - DNA, 338624 bp, Homo sapiens
ttagaaaatactgtgatattttattattaaaaatgctgctgaaaagtttatacatatgtgtccggccatatatatcttctatcattacttaaggcaaaataaaaaacaaaactgcaaaataataacccaaggaaccattaaaccctgcgtgcctttgaagatcaagagtaaaagcctaggacaggatttttttttttcttacttttttctcattttttttcttttttctcttttttatagatagcaagtatattttttctcatagaactctatgaagattctataacttctttccatgtagaaataagatatcatttaagatgtactaaaatcacttttgatcataatcccctgtaaaagctaaagttattcacttaacaggaactctgtttttccttattcaaatgtcacaagcctgacgcgttactgtacatattgctagcaggagacaactggaaatactaaacaaatactggaattcacattacagacagacgaaaccaacatggatgccacacataacttcctttgtagtttcacagagagcctatttgtggttgctcaggtggggtcatacattgcttgcagaaatggcctgatcatagctctatgaaacaatgaattcggaatgaaatcttaccatgacacctctctgtaggaaagaaatgttgcttcacgtgtgctaagttgagataataatatttcacatatttatatacagagaatcactctcaaatttaacccaagataagcaataggatttgggggtgacttgtacgcatttctaaaaacacttttcttttttctagaggtcactctcaaacactgatatatcactatagtttgagtgtagggattcagtaatcaaaggttgttattgcaaaagagccaggcagctggacaatttttatggggaatgtccactttagcggagagatttaagactggatttctagaataacccacaatggagccgaggaacatgatcttcaaatatctttggctactgtttcttggtaatgcaataatttttcaaaaaagtatccattgctactatgtttccttccaccttataacactcaaaactttcctgaaaaatgagaagagaaatgaaaaaatgacaagctgttggaaagacaaatctctgatccctaggtcaccaatttaaaatgggtgaataatttccattcaatgtcttctcagtgaagttatcctaatttcccagaaaacccatgcaaagcagttttaatattctatcctttcttcccccattcttctataatattcaccgtttggtgaccggatacacaaatccacaaaaagtgatgttttcagacaatcatatgtttgatcccataaatgatataaaagatttttaaaaacctgcttactgataaataagggaccgagtgcttaaacaaaaaggaaagacacatgtcttccttcaatctgattagctaagctgagcaggtacttcatcggccaaaccctcccgcagctgctagggaacacagagccgtatttactccaaggggcatagccccaccaaaggcaagctttcttctttttttggcagggccctgaaatgggaagcaactcttcctaaacatattcaaagggccagagctacagaacgggacttgtatttttgtttctccctactgattctttgtgtgtgcatgtctctaatttaacaagctgtaaatacactccactttggggacccatctctgtactgcaatttcatgaaggctaacacgtacaagtcaaaagtttttcaaaacagtggtctcctaagaatgctcttgcatgcacctgtgcaacctgacgggggaaataggccacacagaccgtctgggtcttctgtgggacatcacatcctcctacaaatgagaatctcatgtaagaaaatcccatgtctttgtttaccacaagtaattaagaagaaaagcctcttttgttggggaggaaacagaggtgatatgactaatgtgtgtgtgtgtgtgtatatatatatatatttatatacgtacagagcacaatgaaaagcacaaccttgctaaaagctctttcaaagtgaaaacaccaataaaagctttttttcttgtttgtctgtttgtggtttttgtttaaactcacagctatatacatttttcttttttacaaagtctcttaaatatagttcaggctggcaaaacacctctttgcacagaaccgtacagatttcgctgcacagtccattcttttaataataaatttctacgtttccttctctctggattacagctccatgtgctgggcaaaatctcattgactctttcttcacttaaggagagccatccattgtgtggcacagaaagaaatgtttaaacttccattgtaattaaaaaatatcaagtgtccttggctgagtttcagaagtgtcagctgcttccatgacgttggaaacacccggggccttgaaatggtgatgtcctatcacactaaacatcgattggagtggtagagatcttaaagcagttattttaacagaaatgtgtacttctcacatttcacagggtcagaagttgatcttgtaatactggaaaacaccaacgataagggtctgccgggatgggatgactgcctttttgcatttttgtcttaagtcagtgggacaaaaacattcctggtctggagactttctttctctctctctttccttctctctttccttccctcttctatgttgctgagcgggtagggcagagggataggaagggaaatagggcaaagctatactctagtggtggaatgtccgtggggtaaatttgtactgttttgtcctccactgaaggtgttaaaagtgtgcaaaggctgcatccccgtcagtgtgtttggaatcatggtgatggtgtttggcgtcataagtgggatgtcatctggcgaccggcgcagcgtgagggtgtagtctggcgggcaggtgagcctcagtgtgtcgtgtgcctgcagcgactcacactcgtgatcgtgttccagctgcttcatctgcagagacatgatctcttcgttctggatgtgagcgatatcatttgtggtgtttctctggggactggggcgcctgtgagtctcatggcgcctcttgtcctttttgtagtacagcgccgcaaaagctaagatgttgaggaagaggagcgacgccccgacggcaatggtgacacttaattcggtggaataatctcgtttggtttcaatgaggacagttgtgtcctcaggccctgttttgtgagggtccttagagtgtttgggattgttggcaggagtgattgctgggcgtttggtggttggccatatcttggcgggagatcgccgggtgccatagggaaatgatgtcatgtctggtggaggaacctttgtggttgttgaaacatactggaatatctcgttcaagttgtgcaaatgaggaacgagttccaaccagaaagccactttcgttgcccggtagtgatctctcactctgggtttcaagccaatatgcagatagagctggtctttgggattatacttggaccaggccacttcttcaaagcggttgggttttgtgtgaatgaacttggtatcctgaggaactggttgatttggatcactgaggatagaaggaagaaaaaaagaaaggtcatactcttccacatgtgacgtgaaattatcttaaaccaataaatcaggaagttacaatctgctcttcatatatatttatcaatgagcacaaaatacccaagcagcaaaggtacattctgctttaatcctagacctgtctaccatgttgtcttttcctttaaaaattgctcttatttttcttttaaatataaatcctgatagcagcattatgcaatttttataacatgtttactattttttaaggcatcaaatgatcttcaaaaataaagggaaagaaggaaaactaagtgtctctaggaaaaatttcagtatttcaagtttcactcttgtcgaactgtaaaactcatccaggactgatttgctccaaagggatatttggcagtatctggagacacttttggtttccgtagacgaagggttgttctatgaagggtggaggtgagggatgctactaaataccctctggtgcacaggagagacccccacagcaaagaagttatctggacccaaatgttaacagtactgaggttgagaaattctgattaagaagctattgtccaagaaatgggtattctctttcttgctcaagaattgcttttgaagtaaatgaataaatgttgcagttttagcaatgaaaattgatattaacagtagaaataaaaataggctttataattacaaagtgtttgtaaatagacatatgcaccatgtgtttgctctctatttgaaggtaaaaagatgaaagcacgctatgttagctgtaagaagtttgctaaaatggtacatatagttatgatgaggttaacatgtttaagataaaaaagacacccagaaacaagtcaagggctgttacagatgctaagttgtgcttggaaactatgagccaaagaattatcttcttattatttgcacaagtggtcacaggtagaaggagaatcataaaaatttggagataattcataaaacatagggcctttaataaacatctttgcaactgactcttttaggataacacttccccttcaaaaaataaattaccaaatgctcatttcttccattttttttatggcttgtaaagtaagctaaaaaacaattacgtcttaaggtttatttgttataaaaacgatttgagattatgcatggcaaaatgttatgtactagttagcactgagcattgagatgtgatgtgcagaaccaggcaagcagggagttgcaacatcctgatcaatggctccaggtgtgagctaagggctatcttccaggtaacttctccttggcgggacttctgtgaaactgcctccagtcattgcatggcctgcatggcagaaggctgcaggaccaaggaagatcatgtatctgtagccattaccagacactgtgcaggattcaaacaatatacttgagccagaggcgccacacttgctgaaggaagattttatcccctcagtctgagtctgtggtggtgataaaataaatcatttccctgtattcaactttctgcagctctggctagttaagagctgtgaaatcttaagcaagttttccagccagtattggccttaacttactcctctacatggctgatgaaaatatcagggttggaggtaagtgatgaaggttgaaagataatgacaagatgtctggcatatggtaagaattcaggaaatattaccccctctcttccaatataaaaaatagaacacctataatattgcaagggagggagaagtagggagtgatatactgtatatcagagtacatactgaatttctatattgtatacattgtagagtgcataaaagtatattgtatattacatactatatacaagtatactgcataccacagtttatactgcatactaactatatactatatgcagtatatatatgtatgtcatgtgtatatatgtgtatgtgtatatctatctatagatatagatattagatgtataacataatacaggagaaaaagaaagttgacctctaccctttagttgaatgcacactaactgctgtgttttcactttactaatagggtgagaacaaatatatataatctcataggttctaataccatgagttttcttatttactgataaacaatatatttgaaaagtcttctgctttttttatttattatgcatgtattcttacatggttttgaaaaaatgttggattcaatgcagcaactcatgtttcttttgctctttaagtcctctgaaataattttaaaattttcagttatttaacgtgtactgaaagaaaaataagtgaatgaatattttaggaaaaaaatccactaatattagttattgatttttaatattctaaagaaacaaatggaagtgaagattctacctttttttccatggatccaattttactgaattggatctattagatgtgtggctacctcatctattaagcagtgagcatctaggaaaaggagtattctgttcatgttgggtacaaggctattttcgaaggaactcagggtatatttgaaaggtaaagaaaacacattatattttgttcttgaagaataaagcagaggatttggaaaatccatataaatgagctgccacctgataccgtctgtctattaaagatctcggagatgcacagccagaattcttaaagccagataaacttgtggagattatgatagcccaagtcattctcccttaccaaaccctccagacagtgaggtctagatgtggggtatcagtgttttgttttttagactttattcagcctaagaagtgtttaaactcctgtgagtaaaattaaagactataatgattgaggacagaaacacaagttggtctctctagtaaaagactcaatgcatgtcttcctccttatcccccagcacctaacacagccatttccacctgtcctgttttatttgagatgtcatcttggcagcagagactcaagtgcctttctaaggtctagttcatttctttagctggagatggatatagtactatgatctctctaaaaatatctgtgaatcctctcagctgttcctttaagtagtacaggttttcctcatacccaaaacattgttcgcagttaacgattattaccggactagtttattatgcattcagtgactcctcttccacaccaggtggggatgttcattcattcagcttaaaattcctttttggtaataaaggtcgcctttacagccagaattacgctgcaactctctgtaacccatccccactaaatacctcattggaacttcttttttttcccaaagatttaacaatagttgaacgtaaattaatcataggataccagcacattcaaaagcagtgatggtagctgatgcaaacaggacagaaatcaatctgccgtacaaaccccagactcgatggaacaacataaaaaaatcaaaatatgtgttgatctgattttccattacaaaactctcttctcatatctgacttccaatagcacataaggtcttctattctatattataatgcattgtttggttactttaaagcactgttctttgtcataccttataaataaaccaagattccccactcctttttgtccatctctttccacacagagctcaaaatgaaagaatcctggatcactgagcacctgaatttcattgatcagcttggacgaaccctttttctcctattcccaaagtaattttccaggaaaaggactttaatgctctagaacccttttgaaactttagagttagttttcacttctccttgacactgcagctgatttccaaaaacggtctcaatctaccttatttctacaatgcctctgcatgtttgggctcacacggttctcttccagcatgattttagtcctctgacctggactaacattgaaacacctccttgctacaggggaggatccccctcaggcacaggcctgggcaactgcttccctattcaaaataataataaaaaagaaatagcaaggattacttgaggccctggcattcaatgatttcaacatcctttcttgatcaaggttttcataatttagagcctccgtagggacttcctcctcatttctactatgcgtactcgctgactccgcctttctaagatgggagagccctctcacctaatgctaccatgaaaatatacaggtgacataatttataagcaaagatccaattgtccctccctccctccttctttccttcctcctctcccccttccctcttttctctctcttaccctccttttccctgttttccttctttccctccctcccttcttcctctcctcctccattccctttttcctccctcttccttcctccctcccttccttctttctctctccctccattttttccttccttccctcgctactttccttccttcctctcttctttctcccttctcccttcctctcttccctcttttctctctttcctttccttccttccatcttttcttccttcctccctttcttcctttcaccttccctccctccttccttcccttcttctttccttcctctcctccccccttacctctttctttcctcccttcctcccttcctttactcctttcttgattccctcccgccctccttttcttttcctccctccctccctccttccctcccttcgttcctttgtctgaactctctttcctccattccctccctccttccttccttttctccgccatgcacatcccaacatcatttttctgtgctcatcccaaaaccaaaggtttatgtataccaggtatatgtgccttcaaacctagactaaaggtcagaaccatctactttgagatgtctatatagaagcatccagaccccatccacttcatcttggcaaacacatgcgccatcgagagactggctgtgcctgcaggtttagaacgcttgacttaacgcccactgagagtggtgaagtatgtcctggcacaatgcgatcctttctccacggcaccgtgtagtgacagacacgctgggagctattcttgtttcctcctgtcacctccagtgctggaagggaacagtgatggtatgcagaaatatgccctcctgttctgtgagtcatcatctgagtgtgtgctctgcaaaatggcgttaaacttggcagctcacaccatgacagcagataaggtgcatcccatactttctccttgcgggcatcagtttggttcattctctgcacctggtgaccagggaatccttctctgccctggagtgatcgggccaccacccaatttacaataaacaaataactaccaactgcaactgaagtccttgtcatccactgacgaatacctagctcaccagactgtgcccgacagtgaaattccccatttccttcttttatggggctgccatggaggtgtgatcacttaaactatttgtatttgaatccacacgttgcatttcacatgagatgtaagttctgagtaacttccttgaggaatcatttgagtcattctaatacctttccaatgaattaaaagagctcactgcattaatacactcagtgttatttcagggatgtttcccatgggcggaagaaacaaaaatagaggcttcagacggactgacattcgagctctgggtacctcaatgaactctctctacctgcagcttttgatttcagtagcatcagagcgtctctccaagttctagcagttattccttcctcatctcttccagccatgtcagggccttcatgaaagctagaagcaccctcaacacagaccatgaatggcaacgtgaatgtattccctaaatgcagggtggaaatcacaggctctaagccaagtgattttaagaaacagattcatggcattaaaagcactcaataacagagagatcattgtggtattctcttctcacggctctctcagaccttcgtgatgtcttggtaaaagcgtccatttggtgtcagcagtgataacgatcacctcatggaactaattaacttcctttatctttttctgtcttttttcctttttttttttttttatttttttttaataatgagagagccagcctcagtctcatagcctttggaagtcaggaagagctaatgagaatttaacagcattatttagatttcactattgttttaatggttccataaaatgtatgaggaatgattctagctttccacttaagataatcatataaagtttattttcaaatcatgtaaggaggaaaagaaaaagcatatgtttttaatgagagtaagtaaagagagtgtttgcagaccaagtcggtaatacgtttggatgccaatgtagcgaagattgaatgagtatagccatgttgggaaactctcatggaagtctttaggcttcaagaggatgaaattctctgcaagggcagacaccgcctatctcagtgctgtcacaaaagagggcctggccctgatttcacagggtattagagattgaatactgtctccccataaattaagatacgctgaagtcataaccccagtatctcagtatgtgagcttatttggaaatagggtaactgcagatatgactatttatgttaagttgaggtcatactagagtagggtgagcttctaatgcaccttggcagatgctcttatatgaagacggccatgtggagacagagacacacagggaggccgtaagatgacaaagacacagagtgggatggtgcacctgcaaggtaggaatgccaaagactgcacccaaacaccagtaactaagaaggagcaaggaaataccctccccctacagatttggagggaacttggccctgcaagcaccttcatttgcaacttctggccttagaaagcgtgaaccgatacatttctgttgttataagacacaccgtttttggtgctttttttttttttttttttttttttttttaaagataaaggtttcggtctgtcacccaggttggagtgcagtggtgcaaacatggcccactgcagccttgacctcctgagctcaagtgatccctctgcctcagcctcctgagaagctgagactctcggcatatgctaccatgcacagctaaattttttcatttgttttgtagagacggactctcactatgttgcctaggctggtcttaaactcttggcctcctcaggtgatcctcctgcctcggcctcccaaagtgctggggttacaggcatgagccactgcgcccagcatagccatacagttttggatactctgataacagcagtcccaacaaactaataaacaaggtttactttaaaaaaagtattaatttgatttcaatcatttcttcacacaaaaaagaaccgttgagtgatagacaagcatttgcatcaaatgtgggtccctcctctcttctcctctgggtagcctttctcagaccaaatctacaaagtctgattattgaaaggtggtatccaggtgataccttttccactccaaaaacatgctgtactttcgccaagggcacaaaacattctcaaaccactccctacccaaaccactttggaatctttgtacagtatgccagctgctaaacacgtaggcattgaaaccaccagcatccccagatcttctaaggattactgtgcataactcatgtgtggcagggccactgcagtctcagagcctcattccgcacgggaagatttaccctccctgggcgacaggcacatctttctctctcattcagtgtaaagaggctcagggtgatgatggaggcacacactggtagaacagaatgacaccccatccatttccacagttacattattagacaagagaaaatgaaaaaatgccacaatgtttggagctatttaggttgttttgggttcttttctcccatggtttgcagagaatccgctcagcagaatattggcagactctgttgtatatatgctttttgtatattttatattttctactatatttaggccaataaatgagctttcctgtgagatacacatgtatgtgtgtttgtgtgtgtgtgtttatgtatgcatgacatatagcaatatgatacaaatatcatatattttcattttctctctctagttatttatatagcagagaaaatacaaacgtatttgtgtatatatatatttgtatttgtatatatattgtatatatatagtatttgtatatatatttgtatttgtatatacaaatatatttgtgtgtatatatatacaaatacaaatataaatgtactatattatacaaataggaatatctatatttttatatagacattaaatatatataggaatatatatttatatttctttataattattatgatatttgttttcattcctatggccaggcaatcaacacagttccccaagtggtacatgtgctgtgatatccttgcaaattaacaaaagagatatggttgaaattagacttaaaactctgtaatgagggctggtgtgatggctcacacctgtaatctcagcacttttggaggctgaggtgggaagatcacttgagcccaagagtttgagaccagctcgggtgacacagcaaaaccctgtctctaacaaaataaaattagctgagtaaggtggtgtgcacctgtagtcccagctattcagaaggctgatgtgggaggatcccttgagcccaggagtttgagagaagcctgggcaacatagcaaaccctgtgtctacaaaaatccatgtaagggcatggtggtgcacgcctgtagtcccagctactcaagaggctgagatgggaggatcacatgaacccatgagctcgaggcttcagtgagctatgattgcgccactatactccagcctaggcaacagagtgagaccctctttctaccaaaaaaaaaaaattaaaaattagccaggcatggtggcaggcacctgtagtcccagctactcaggaggctgaggcaggaggatggcttgagcctaggagttcaaggaggctgtagtgagctactgttgcaccactgcactccagtgtgggcaacagagtgagactgtgtctctaaaacaacaaggacaaaaacaaaaccgtttaatcagctgttaacagaaccatcatatatgtatgagtcctgcacctgcaggtaggaactctggaattcccaatgggcaattagaactctagtaaaaatctggtttgacagttaagtgttttactcctataacactttaggagtaaagaaaaaaatgagttgccatagatgttgggggagaagctgcctgttactgctgtgtgtgtaagcgtgtgtctgtgtgtatgtgtgtgcatgcatgtgtatgtgtgtgtatgcgtgtgtgctcctgcacgtggcagtagaagcaacacctatattgaggacacaaacaagtggcaaggatagtgataccccaacacgaagatgaacgtacccagttttggcgaagttcgtccagtaggtcatgaccacggcgctgagcatgacgtcgttcttggaaaagttacaactgaagagctcggtgggaccgatcatggggatgccgaagacataggggacctcatcaccatgggccgaatctgcccagctgggcttcatttcgctttggcagtgatgatagaaggcatagaagtaggtgggggagccgtactgcgcgtgcaggtcggcggtggccacggcgggggccacccactggtggtcagtaaagagagccaccagggttttccgccgcgtctccgggttttccttatcggcccagtctgtgtacatgaacttgatagtctcccgcaaagtgtctttcccttcagggtagccgtaaaggttgtccacgaagttggacacggagaagtcaaagtcgttgggcgtcacaccgtcctcgttatccacgatgccgtccacgaacttcaggccttccccttggttgacgcccagcatgatgtcgtagttgaggaactcgccttgctccatcaggatctgggggtcgtctgggatgacgtcgccgtcgatcaccggcccgaaggctatgtggtaggtggccggggtgatggtctgctggatgagctccttgtagttcttgttccgcaggcattctaccatgtccgtggtgtccagcatgttgcagccgaccttgtctgccaatatccgagtgtacttggccggctggtagttcactgcccagctggacagggcggtgccgctctgaatgatggccttctggaagagacctgcaggtgcaaaattgtggacatgcaaatgaaaacccacaggacagaaatgcagcttttactgagcaatgaaggctgtgattgtctctcaggcatgtgagtttctggatgtagtagcattcagctctgtcaggggcccttttacccattttcatttccattcccccttcacccctcctcctgaacattcattttagggaatgttattctacacacacacacacacacacgagtttaaggaaatgaaaccacattgacacttctcctgcactggtaaaatacatgtgatttctttttccttccacaatttagtgtcgtttttgcttccttgcctccagatgccatatataaaaactccaagagcaactgcattccccatttccaagaaaaaaaatgctttaagctagtaccagttcaaaggccctcttgtctcacaagcaaaactaggtatctcttcattatgggaaaaaaagaaatccacttgaatcaacttcagagtgctaattcaggagcgcatttctacttctaccttgagtctaatgaagatattaagatttgccaattaaaataaatacattcagctagctatgcttaaagaaatcctcaactgggtgcccaagtaaggagtattttttaggtcacttctttcaaaactacatccattggaaactcagagatgtgtatattttattttgccacatataaaaatgctccacttgctgagaaacttgaaaaagcatgggcaattttaggagtaaaattctgtgtagcttaaaattctccatgagttcagtctactacacggatgtccagaagtataaaatctgtatttttaactacgataggacaagagaggtgcgctgtaaaaatcagcattccatttacacttgcttcctgccatttccgtgaatcccagcccgagtcgggcactaaagaataaggcattcagttgtgagtccagaagttcatgccctgtcgatttttaaggtcacagaagcaatcaaatatgaggaaaatataactgtcatcaggaagacgtgattttaaagactggaggattgcccaaagatgacacacaggaccgcaacttgaaaccaatatggctttgaccagtatgtcatcaaagccatcctgggaacgtttctgtcagaaatgtgcaagtattgacttgagtgcttggctctgaagattattttaaaatgtccaaaaaaaaaaaaaccaaaagagaaagtcaatatgtattctattggatactttcattagttaaaacattcagaattggaaaaaatgctgtgagaagttcctttcccgcccttctcataagtactggcaataatttaggcagtagtgtatataaagtaacatacataaaacatttatttgtatgttagggaagtaacagaactcctgataagactaaaatagttggataatgaaaaaaatcacccagaattcatactttaaacacaactcaccttagcgtaatgagtatgctaggagttcacataattcttagctctttccctccattcaaatgtctgttttgcatagctgagcccaatatttatatagctgtctaaactgtttttccagctgatgtatatcttaggtaaattcttaaattattattgagtaaatacatatggttcattataattttcctctccttttgatcttgtagcttttcatttcattctttgctacgatactaatactgtggtgaacatcttcataaaactatcactttccacgtgtactttgtcttcattagaccatataaccaggcaaggaattcctaaggcaaacagtctggctatatttatttttattttagacaaggtatcactctgctacccaggctggagtgcagtggcgggatcttggctcgctggagcctctgccttccaggctcaaatgatccttccacctcagcctcccaagtagctgggacaacagatgcgtctcttttttgtagagacggggtttcgccatgttgttcaggcttgtcttgaactcctggactcaagcaatctgcccaccttggcctcccaaattgctgggatgatagacaggcaggagcctcagtgcctggcttgtatttttcataattcgtgattatattgatgggctgtttagaagcatgccttgcagaaatgaccgatgcaaaagtataataatttccaacctattgacttaaataattaacacctccctccaattaatgtggcttacatgtgtttgattactcctgaagttggttctgactgctttctaaatctacaattgtgattatatcaattgagaaaagtgaaaatcgaggtattttcaaaaatgccatagaaatctctctaccaaatggttcatcagattcttcacttatcgtgtttttgaaataaagttaatacaaatatgagcctttcctctcattagcactagtaagaaatcaaaggccatttggtctcatgggcaaaacattatgaactaaaaactcaaggaattcagagtttggaggatttcaggaaaccctcatctgtcctatcttgccaatgaagacactgaggagcacagcgatccagaaacttgtccagacggtgccgaagtgaagaaagtcctgcagttactctaaagaaagatactttttaattttatgtatgtatgtatgtatgttgagacagggtctcactctgtcacccaggctggagtggaacctcacagctcactgcagcctcgacatccctggctcaagcgatcctcccacctcagccccccaagtaactgggaccacaagcatgcgccaccaggcccagctggtttttattttcatttttgtacaaacggggtctcgctatgttgaccaggctggtctcaaactcctgggctcaagccatcctccccgctcagcctcccaaagtgctgggataacagccatgagccaccatatccagctgataactttaaaaataatcattcgggaggtcgaggtgggtgggccacttgaggtcaggaagttcgagactagcctggccaacacggtgaaagcccatctctactaaaaatacaaaaattagccgggcacagtggtgggcgcctgtaatcccagcaactcgggaggctgaggcaggagaatcgctttgaatccagaaggtggatgttgcggtaagccaagattgtgccactgcactcctgcctgggagacagagtgagactccctgaaaaaaaaaaaaaattccatgaaggttttgagaacttcaggttcagtcagtgtggtgccattctgaagaccactgacaacacagaacaaattacaaagctgtcttgatgactgagacggctattaggaatattcacttgcgtgtggccaggcaacccagggctggatctgcactgcagattttcctgcctcttccttttaggccacagccaggaatttgtgatcctgcttccagaaccaattgcctcaaattcctgtggactcctctttgaagtctctcatcggatactgcagggagcctccttcacaaagggacagctgggaatccactgagtgagcctccggggaaagcctcaggcactccagcagggctcaggggtgtggctgcctatgctgaccattacttaggcagcataaccatctactgcttaggcgtccaagtgcacatctggttgggtacgggtgcctatgctgactacacgttcaagtgcacatctggttgaggtaacatgatgcacatgtgtttttgtggtttcctctttctccactttgccaacatcagctttttccaggttaatagcagggccccagggagggtttggagctcccacggggacaagcagaggacctcgtgctgactggcccagcaaggaggtccttcgtgaaagtcatatttgcaggagagagagagaggaagggagaggggaaagcaaactctggacactccctagtgctgcatgctgacctgaccaggaaggaggtcctttggtgaaagtcatatttgcaggagaagaagaaagggagggagagagagagaaagaaacaaagagagagagggacagagggaaaggggggaaagagagagaggaaaggagatagtgagtaagagagtggggagacagagaaaaggagagagaggaagagagagagagggagaaagacagggagagtggggggacagtgtgagggggagagagagagggagggaggagagacagtggaaggagggggagagagagggtgagagacagagcaaaagagagagagggagcaggagagaggtagagggaggaggacatagagagggagagagacagagaggacgagagagggaaagagaagaatgggaggggaagagcaagggagggagggagaccatcagggagagagacactattcctctgggtagaatctacttctacccagaatctacttctaaatgaatgcaccagacgtgtttcaatatttccagaagatttaaagaattaatatgaattagagagaggagcgacttcttaaaaaacatgtggctaaaagccctgatggttacaaaatctatacacccgcatcccttatcgacatactgtctctcttccatactacttttactaagttgtagctagaagttaataaaatttcaaatagtcaaatacagtcagaatggcaaaaaaaaacaaaagtgtcaggacttctaaagtagttattttgttccaatcattgtaaccaacacctaattgtcacacatttaaattaggagaaaaatattactgatcaagcatggtggctcacatctgtcatcccagcactttgagaggccaaggcaggaggatcgcttgagtcctggagtttgagaccagcccaggcaaacatagcaagaccacttctctataaaaaattttaaaaagcagccagtagtcccaggtattcaggagactgagatgggagaagccttaagcccaggagttggaagctacaatgagctatgatcataccactgcactccagcctgggtgacagagcaaatggaacaaaagctgagttaaaagacatgaagatggattcatttgatcttttgggcattttctgttgccagagtgacttctggtaaccaggacatgcatctgagatatgaactctgaccattcatttcttggttcagggtatttgcccgcccaccctgggggtgccattattaccttctgagtagtgggacagggtcaacaggctgacacaggaggccccagcccccgagccaaagatggtcactctcttggggtccccgccaaaggctcccacattctcctcaatccaccgcagtgcttgaatctgatccaggagcccatagttgccttttgctgcctggtcaccggtacttaaaaaccctacaaaagaacacaagatatttttggtggccaaatagaaaaagtgcatacgtgtctctgctatttgaaaagatatctcatagcttgtcttcttcattctctctctcctcaactctcacccccaccaattagaggaagaacaggagaaaaaattttgtggcagaaataattatataaataatggttattttaggttgatgttatgataccatggcatctttgtgtatatatgtggctaatagagaaggcaaaatgaatctaaaatattaataacatgaagcaatcccagaagacgtcgtaaattttactaggttcaaggtatcatttctgtgcacattttcattttcttttttgaaaaatgcaacagactcctacaagaaatttttcagggaaaacagtacgtgtgtgggggggggagggggcgtaagtgcacatgtgtgtctgtgtctaagaatatgtgcatgtatacaaaggcagtgtgcgcctgtctttctcactgaattagttattaacattttgttttaactcctttcaatgcttaagaaacaacgtaagttacagactccactagatccgactcgtaaatagtatacacctctattttcctacatagcgaaaatattagtcacatacaaaaaaatgtaattattgaacctcacccaaaagctaatgaatattcacatctccccaactgttcccaaaatatcaggaactggccttccttattttaaaaagaaggattctgtgagttgaggatctagattttactcaaggcatacgattcttaatttctccttagtagttgaaaaatggcaattttggtattaatgatagcaaagttatgagttaatctattttattttttgttccttctgtattgaaaaatagcttgacctggaaaaactgctttcttctgatgttttgaagtcaagtttgggaagacatacactctcctactcagattcaaaactaggaatattttctaaggcctcctgcaagtttagttcattgcataaactttaatccaactttatgtccaaatctgtactggatatgccttccaaaaagacaaagaatttttaaaagtttttttttttaaccattttcacgtccttatttgagccttccccaactacccaactatgatatttgccccttctatacaatttcttttttccaagagccatgtcattcactcatttcaagggatgctcagcacattattatggccacctgcagtcatgtttgtatgaagacaggctgctttaagccctaaaataacatcaaaccaattccctcaaagcacgtccctaaccaaagttgacggcattccaaggagtgactgagtgccggcttctacttttaaaacaaaaagagtagaggatgaggctgcataccaattgagtcaaccagcatttcttccatgagctttcctgagcacctgtggaaaaatgctctgagctggaaaggaggaaatggcctggctccaaagaaagtcacaggacgattttcgttcaacaatgacaataaaaactccaagcctgaatcgggagtcactatctcctgcagcttcaaagagaggcagcgtcgcaactgcgaggttggatacttaagacacatcctaccaatgtgatcttctttaaagttcagagggatgtgacgggagattagctacgattagtgggtgcgatcagacattacccaagcctcctcccccatttaattagcaattactaattagtgcttcatgccaaaaatgttctgcaacacctgtctccatcactatatctttgacacgatcgttcataaaaggcatcaggctttgcttgggagaaaagatcgaagatccttatatgacaatgacgaatcatgtcagtttaggtgccctataataccacagggcaatgctttcttcccctattaaagaaagaggtgattaattcctaaggcacgagcaattttctaacagaacgattctgtcttcagcacgtcttttcttcactcactgttctctctttctcaattctgcagaatgacttgttgacttattttgtttctgtggaggagtatgaagattttcaacacgcaggaaatcattggcctttcttccaccataaactcttcctccctagcaaaatcagagtgttttaacctttccaaaagcaggctaatgaatatcccctgccttcaaaaatcttagttcttctaacagcatcctattggatggtttgatctttgaggttctgaaattcttccaaatatcctacaggctggctgagggaaacgacaatccatggatctctgaagtttaacaaatcaatgtggtgttttgaggctggtgtttccacagtttctgccatggcattttcatttattgcaacatccagggattattatttttttctttttaaactatcaacaagggggagtgcctgtttcaggtacacaatgaatgcaataattttatgctctttaagagtatagtcctttcaccttgaaaccacctttgcaaaacttacaatagtcagacaattatgacagtgaaagagatctgacctaaccaactccatcttgcctttaacctccatactgttcttgatcattcctgggcacgggccaagctaactttgggagaaattgaacttgtagtttaaatgataatagcccctcttaaaactaaaccacctttgtaaaagtaatgaaaggccaccaggttaaagaatgagagaggcctgaattctgctaagatgtaagcttagttgaatgattaccagccattattccagaggtcacaagatttgcaacttccccaatcactagaagctaaaatttgcctttttaaaacttttattttaggttcaggggtatacctgtaggtttattatgtaggtgaactgcatgtcacaggggtttgatgtacaggttatctcattacccaggtaataagcatagtacagattggccttttaagatgtcttttcaggcttttgcatttctgacaactgattggtcctactaggaccagtgactcctctgtgtccccacatagaggccgactgggtgcaccagggctgttttccacacccctatcattgcatcctcaaccaatcagcagcactcattccctagcccctgtctgccaaagtattctggaaaaacccaagcctccaaatttttgggaaggctgatttgagtaacaataaaactccagtctcccatttagccagctctgcaggaattaaaccctttatctattgcaattcttctgtcttgactaatcagctctatctgtgtagtggtaaagatgaatctgttgggaggttacattgttttgagggccaaatcatgttttctataaatcagacttaaaaagcatgtgggcttactgatacagaattctatgagcccagaaagttagcatttgaaaataaaaagacctgttttcccaagtcgcctgatctgtgaaaattagatctcactatcaatctgtcttcttctttattcatcagcacctggccaggttttcctgtgaataagactggaggcaaggaacaggcagcacactacagctctgtgatgtgatggagcagggagagggaaggagggaaggagggagggagggagagcaggagggaggaaggaaggaaggaaggaaggcaggagggagggagggaaggagggagggagggaaggagggagggagggaaggagggagggagggaaggagggagggagggagagcaggaggaaggaaggaaggaaggtaggagggagggagggaaggaagtaaggaaggtgggagggagggagggaaggaaggaaggaaggaagaaaggaaggaaggaaggagggaaggaaagaaggaaggcaggcattttcctggcaaagctatcttcttaagtgtaaataaagagtgatcttaaaaaattctaatggtgtgattttttgcaagctttttgacaccaggaatcctggtatttattgtagcaaattaaaattaatatttttaggaatcctgcaaacctaaaccactgggttttgcctcctgattgtagaaagcaaaatgatggtagctcatcaacttggaaagagccacacatgataccaaagatgagtgctgctcctgagaagtcattcctcggatagatcacttaactttaaatatatgttcaaggtgaatgaagagaacaagctacttgattgtctaaaaccagagatttacaacaaatggctcctttaactgacaggtcctttaggctacaaactctctaagcattttagccgatgaaattttggtttctgagctttactctccctaatatgaagcttgtaatcagcaacctctcctccaataattgaacaacgaaagaaagatgcaaaagagaccatgtgaatgaatccatgttaatggctacattgatgccaagtttcatccagggtcctggaaggaacaacaataacaaatatacacacacaagagatatcaatagatacgttcagtgatctggtttggctgtctcctcacccaaatctcatcttgaactgtagctcccataatccccatgtgtcatgggagggacccagtaggaggtaactgaatcatgggggtgggtttttgtcatgctgttctcatgatagtgaataagtgtcatgaaatctgatggttttataaatggcagttcccctggacacattctcttgcctgccaccatgtaagatgtgactttgcttctcctttgtcttctgccatgatcgtgaggcctccccagccatgtggaactgtgagtccattaaacttcttttctttatacattacccagtctcaggtatgtctttattagcagcatgagaacagactagtacatttagttagtatggttatttagaaacaggtttcatggaaaagatgactaaaaataggaatcacagtttttcctgctgcatgttgactgaagtgaatatcatataaacatgaatatttctattcaggcttaatattgttgtcacaacagaaaagtttccaatttttattatagataataatgtagatgtttcctctcattttgaattacatcacagggcttaggagaatgactgcaggtcttttgtttctccatgcactgcaagtaaatggtaaggaacccaatggggtcagatattgtttttctttcaattaacaaaagacattgttacatgacgttaaagctgcaatccattttcttttaggagatcattccttgcataaacacagtaggcattttttggagacaagtaaccaggagataattaagtgaatacagaagttaaatatctttcaccatttcagtgtgtgtaattcacctgatatgtgtgtatgtatatatatataatatatgtatgtatatatatatatatatgcatatataaccatatatatgcatgtgtgactataaatgtatatgtacacagacatacatttgtgcacctttaaactaaagaagtgacaccaaacagaaaatgtttaaataaaaattcttcagtgagaataaacagaatttgtgttagatcatgcaaatgaggtcaaaaagaaatctgtttggttagaatgaaagcagaagcataaaaaacaaaaatcagtcaaacagatgcaaaactaatctttgacggttataggaaatcattcatgaaatgcatttattacaaggtgaacctttaactttctgactgaaaacatgtaggatttaacacagaagcacacattgcacaggatgggctggaagggagggaagctgatgcactgcattcaaattctgttgcctgataggcagggctgcttgaaattcagtgccttttatttttagtttttacttaaaaatggaatgagtactagcagaccattctccatttgtatcatgttatcacagcagtattgcacagaaccaaagtctatttccaatatcagtagagaaaatctaaaacaattataagagacaaatgatttttataccacaggtttccaaactctggggcctatgaactactactgagattccttgcagtattttcataaaagataatatctccacacatttatctagaattaagctgcataggtattttttaagtgctttagtttaaattacatgaaataaaaaaaaactgaaattgatcatattttaggaacaaaatataaaataataaatacagcttgtttattaaataataaaacatcaaaatctgaagataattgatacatgagtttcatgcaaatgaaaatttgggaatagccagcctggaaacaaatctctttgagtcaactttgagtctttttttgtttttgagacagactctcgctctgtcgcctaagctggagtgcagcagtgtgatcttggctcactgcaacctccacttcctggattcaagcaattctcctgcctcagcctcaagagtagctgggattacaggcacacgccaccacacccagctgatttttgtatgtttagtagagacggggtttcatcatgttggccaggctggtctcgaactcctgagctcaagtgatctccctgcctcagcctccaaaaagtgctgggattacaggtgtgaaccaccatgcccagccaactttgagtattttcaactgaacactttctccttagatatttctccagatttgctgctgactctcattcaattggctgtcacatcctttggttttagttttcaaagagcttgtacatcttgtccctccctgggtctgcatcctagtgtctgagatgagaactacagttccccaggacctgctcatttgggtgctacgtccttttagcttcctctgaatttccacaccatcaacatcatcatgatggtctccagtgtaagagaatgggtaaaacccaggaaaatgaaaattggaaacttctgacccaggagtcctaattctttgaatgctttctatgaaaatctttattctgatgcataaaaatagccacccaaggctccacaattcacacggattgtaattttaaaaacaaacaatagcagcaagctgaatgttcacaagtcagagatttgaatggattgtcttggttggatccatattatgagatgctgtttgtctgcataaagtgctaaggagtatttacactcatggacacagaaacacatctaaggtatctcaagaaaaaatagtgggctactgaatactacatatcatttattttattttatatttttatgtattttttttgagacagagtttcgctctgcttcccagactggagtgcagtggtgcaatctcagctcactacaacctctgcctcctggattcaagcgactctcctgcctcagcccaccaaatagctgggattacaggaatgtgccaccatttgctgctaatttttgtatattttgtagagatggggttttgcaatgttgtccaggctagtcttgaactcctgacttcaagtgatccacccgcctcggcctcccaaagtcctgggattaaggcatgaaccactgcgtccagcccatttgttttattaaaaaataaaatctggaaggaattcaaacagtggagggtgattatttcgaagcatgtgactatagggaatattcacgttttattgctaatatctgtttatatttagttcataatttaaatctccctttttagcaacaacaatcacacccacacaataaagtgaatgtgttggagaaacaaattcattactgggaatccaagggtcattctgtgtgggcccatgtgaccttctcaagggatgccctacttatgttctggagcctgcaaatccaccacaacacttgctagctatttccagaatatgccttgcattttgatatgcttgcctttttatataaaatccccaagatctagggcgccctctgcagggctgctgggcgaccataaattgccctgaacaccttgcctgagcacaccttcctgtgggctatggccgcacacaaagctgcacggctagctcatggacccagcaccatttgaaaggtcagtgtgacctgaaggtcagtctctgcatcttccgcaggggtcacctgcatactcaggtagaacctggccatctctttctaccaatgtgggcccctttccaaaagtgtcctgtgtgattatctttattctctcggcacagtaaatggctttcaatgaatttctgttacagaacgtatcactttacaccaagggcatttgcttggtgactgcttttggagttattgcttgcagtggattcagttggacatccttgtggtggaatctattgcaaagccttaagcacatgacttaagatttcaaagtcccactttctttatatgtgaaatggggaggagaatagtagccctcccatagcaagctgaggaactcaactggacaatgcacaagaaacagcattgcgcttggtgtggaatgtgttcaaaaatggttacctactagcctgctttcatgaatatcagaagccatgcagtttagttttgcttcatctacacatactaggaacaaagaaatgtccttcaaatatatgaaaggagtccaaagggaaaaaattgactgctggtcaaattagactctgactctaaaattatacagatggtaaagcgagattgtgtgttctctgatggtattttaaagaatgaattagataccatttatttgtgaataattttgcataaagggggtatgtatttattcaatctgcttactaagtgtttattatgtgtttaaagtgaaaagagaaagacaaggcaaaaaacacatcatagcttttacttatgctatgagatttacggcaaatgctcattcaacaatgtatgaagtagccatgatgacccaagcaaaatctgggggaaaatgatgcggtagttcagtgcatttccatagatatcttgaaaaattacagaaaaggtttttttttttttatttacgttttcatttgtttttaatgagactattttaaaactcatttgaatggaaagtaatatttttcaccatcaaagtatggagataaaacacatattaagatacatttttgtacttcagtgctattcagggcactgtaaaatgcacataagtaaaaagacaacttatacaacactatattagatgaactagaattcatattagatgaatgaaaaagtaatgcacatatattagacgaattagaacttaggtgtaatcacatgcacgctagcaaagtaaatatgacagcacataaaatagctaaaatcccagtggaatgcttagtttcaggaatagaaaggttattgaagaagacagacaatattttctagaattgaggaagggcaaattatgcatgtattgtaccttaagctacacactaaaattgtcctgctggcttgccgctttaaccaaactctctgcctctttaagttcttaattatttatactatttttatatgttctaacattaaggtttttcttttctttttgccacttttctttttgaagatagctacatcctaattctcatcttcctgttatcctcagccacaatgcataactgggatgtcttttctaagcctgaagtccgcaacttttcttacaaaacctgaaatggtggctcgattttgagactgcatcagagaaattagtgcaattctgttttcactaagcaggagggatgtttgatttgagagcagttacagagttccattatatctcttactatactgaagtttattgttagaattgccaatgatttgtcatttttggtaactgtcccagtggtgcttggaagtctttatttacggagagatttaaatagctggggctaagatttctctctgagaattaattaaacaaaaaaatgattaaatggatcacataccagagtagctacagtcaaactcatctctgttctaaaaactagattttaagcaaccatcatagtaacaattctccacttcagaacttttatctcacaaacctttataggctccaacaaagcaatcctcctgggcaatatatatatatatgtagcatagcatcttaatctctgtctgacgtctgtttcaccttcagctcttctattgttccaagcttccagtttctgtcttataaggatatttttattacactgagctcacttagatacttgaagatactctccccatctcaaaatctttatcacgtcagtcaagtccgtgttactgcataaggtaggatgtgaacatatgtagggggctgttattctgtcctctacagcaggggtccccaagccccaggccatggaccagttttggttagggactgggccagcaggaggtgagtggtgggcaagcgagggaagcttcatctgtatttacagccactccctaccactcacattaccacctgagctccacctctcgtcagttcagcggtggcattagattctcataggagtgtgaaccctactgtgaactgcacatgtgagggatctaggttgcctgctccttatgagaatctaatgcctgatgatctgaggtggaagtttcatactgaaaccgttcccctacttggaaaaaattatcttccgtgaaatcagtccctggtgccaaaagtgttgaggactgctgctctgcaggttgcctgacttatcattgagttgggagatatttttatatattctagttacaagtcaattctctgctatattagttgtaaatgttttctctcaatctgaagcttgctctctgagttcttcatggtgtctggaaggccccgtcaatacattctcttgcggttcttacattttgtgttctatgtaagaaacttttgcataaccctagctggcaaatatttgctcctatgttttcttctaaacaaagcctctctgaagaggtggaaatgaaaggaaatgatgacaacgaagcagctacaagatgatgaaagggaaacattcctgaaaagaattacgagttgcgaagtttcaaatgggaaatatgtttaaagggtgaggagaacagaaggagtcccggtgtagctgactcataattagcaaggaaatgtgaaagaacgttattccagtagtaggcaaagtgagttcacacttgaaagagagagtaaaatgttggaatttattgtaaagcaatgacaaggcataagagttggaacatggcagggatgtgataggatttatggtttcgtaaagctcacaggagccactggtggacaggactgcaggagcgtgcatttggaagaagtccactgcagttgtccaggtgaaagttggtcctggctttaaccaggttagtggcagtcagggtggaagacattcaacatcttctggacacatgttgtcagggtgcttcaggctttggtgttaatacaagatgtgaatatgtggtaggagtggggatttgatgtttgctctggtttgggttcatgataggtttggatacgtgtttgtgaagagtgcagcatcatccaaagagtgtcagttgtaaccaagttattgaacctgggtaggtgcccttgggatggggacgtatcttctgggattttcaccctgcctgagttacacacacattcaagagtcctaggactgtggccaaatgattgaatcaatcccagtttctctttctgcacactgggctttgaggttactgaagctccctctccctatgacattgaacaaaacgatgaatgtgaaagaccttcatgcattataaagctccatggaaatgtgagatgctattattatcttgtgcaagaagacaacggctgggtggtagtgatgattaagaaaaacgctaatagcatgttgtgtttacactgcctttagtccaaaacacaacatcttcattgctgaagcatggtgattcatgtgcttttgtatagaaaaaaggcatgtcaaacaagatcacatatggtaagtattttttatatatatatatacatatatatatatatatatatattagacatgtatatgtctaaaatgattccaaagaacagcataggcttatttcattatcactgcaacagtctcaaggtagccaaatttgacagacaaggtcagaaagagttaaaaatagagattcaaatgaaaacatattcactttttttctccgatgtttcaatctcttaatgaccctaagctgcttctcactgtatgactcagcggcattgaaaatgaaccagagagagagagagagagagagagagagagagagagagagagaggagagacagagacagagagagagagaggcagcctaatacttccaagcacaggggcattcctttatttccataacacatatttattaagagctgttctgcatcctgcaaggtgtttgcggggtaagtgagggcaatctctcccagcccctatggtaccaacagcctgggagggctgagctgtctcaggatatatccacaaaaccttgagttgtctgtaaaaatttaaactgcatagactcctccgctgacttccaaatcagaatctctgttggtacaattcagcagtaggcatgaaaactgaaaagttatttctatgcatattcaggatttggggagtgctgttttgggcagatgcattgggcagcggtagctacacggtgttaggcttttaagaataaacttagcacggcccaggtagtattttctagattcaagggtgaaggctgccgtgacacataatgggaagggtctgtctttagtgaggcggtctcaggctttcctgtcttactgttaatatcacaggcgaagctgacagccactgcagaaggaaagaacaaggaaccatcactgccatcttctccttttatctccaacatcataactgctcttcaccaagaatcagagggaaaagggagaaggtttctcttgccggaaatactaatcccagaaccaattgtttttctctctctttttgctttatctgccagaaattgtgaggtaaaatttatgctcaactccagtacctgaatgtctttgttccttttgctttgtgtgtcagatttcacctcttttatttcttcgtggggagggggggaaacaggagaaataggttctcgtgttccatagcactgcagggtgactgtagttaaaaataatataatatgtagtttcaaatagctagaaggaggaaattgaatgttcccaacacaaagaaatgataaatgttttagataatggatatgctaattacttagatctgatcactgtatattacatgtattggaacatcagtatgcaccccgtaaatatgtacaattattacttgtcaattaaaactaaataaatgaaatgtggggagtactttatgctgtactgcctcaaactgtctttaaattaagcaaaactaatattaaaacctatatgaaggcagggcgcagtggctcacacctgtaatcccagcactttgggaggctgaggcaggcggatcacctgaggtcaggagttcgagatcatcctggccaacatggtgaaacctcgtctctactaaaaatacaaaaattagcagagcatggtggcacaggcctgtaataccagctacttgagaggctgaggcaggagaatcgcttgaacctgggaggaggaggttgcagtgagccgagatcatgccactgcacaccagcctgggcgacagagggaggcaccatctcaaataaataaataaataaaataaaaaaataaaaaattaaaaaacaagaaaaaccatatgaagatatctatgtatatctatatctatttatttgtgtgtgggataagtttgccattttgatcattttaaaatgtacaattcagtgggattcattacattcacaatgtggtataattatcaccactacctatttccaaacctattcatcactacaaacaataaccctaactattaagccatatgtccccattggggaaatatttttttattttttgagacaggatctcactttgtcacccaggctgaagtggcgccatctcggctcactgcacccttgagatgcattgggcatctctagctcaagcaatcctgtgctcaagcaatcctcctgacccagtgtccccaagtagctgggaatacacacttgtgccactgcacccagctaatttttgtattttttatagagacagggtttcaccatgttgcccaggctggtctcaaactgcaaagctcaagcgatctgcctgccttgccctcccaaagtgctaggattacaggcgtaagccactatatcagtccattttcacactgctcatagagacatgcctgagactgggcaatttacaaaagaaacaggtttaatggacttaacagttccacgtgcctggggaggcctcacaatcatggtggaaggtaaaaggcatgtctcacatggcagcagacaacagaagagagcttatgcagggaaactcccctttttaaaaccatcagatctcatgagacttattcactatcatgagaacagcacaggaagggcctgcccccatgattcacttgcctcccgctgggtccctctcacaagaattcaagacgagatttgggtggggacacaaccaaaccatgtcagccaccatgccagccttttggggaaatactttgaatggtgttcatatgttgagttacccataccctgagctaaatctgcttgattatgtgtgatgtctgtatttaatgaccaatgtgattgcaccaaccattcctacaattgatcttgttgaccaggacacctaaatatacatgtctccaagagtaaacattcaaaatagccctcaacttcttaagactcttaaaatcatgttgttggtttgtaatctacatttacataagtaaatcaattgtggattgtgtttcctttaattagcagtggggggatatcggcaagtgatggaaaacagaatgcattttatctaattctacaagattgacttgtacatttactaaaatcttccactctggaaagacttctggtcagcgaagatgtatctgggtccacagcaatttgctgaatatggaatcatggctaaatttcaatgggatgcctccaaaacccaggacaatgttcagtttccaagaaagatcctattaggttcaacatattgtgttttacaaaatgaaattatatattctcatacttctaaatgctttcaaggcaaacataaaatgaaaaaaaaaaaacctctctaattgaccacatttaaatagaaacttcaaaaagcacctaacatctttatgcaaaatgccttacaatttttaaagttcttttcacacattacctcatttcctttgtgttcctgaaactaagatggctttcagtaaacaatttttctagtgttctggcttatgttcgtggccaaacacacacattattttaaaagcattgggtcacaatgtggaaccaacccaatgcccatcaatcaacgagcggataaagaaactgtggtacataaatatatgatggaatgctactcagccatacaaagaaatgaattaatggcattcacagctacctggatgggactggagactattattggaagtgaagtaactcaggaatggaaaaccaaacatcttatgttctcattcataagtgggagctgagctatgaggatgcaaaggcataagaatgacacaatggactctggggactcagagggaaagggtgggagggggttgggggataaaatactacaaattgggttcagtgtatactgcttgggtaatgggtgcaccaaaatctcacaaatcaccactaaagaagtgactcatgtaagcaaataccacttgttcccctaaaacctatgaaaataaaaaaaaaaatttaaagtcccaattcattaataataagttgttttgcaagtagacagctgcttatcacccaagttctttcactgccttcttctcctggccccaaactgcccatctcataagcttggtgaaaatatattctttctacactcatcaaccacactaaacacttagtgatattttaacaaatactgatgcctatgtcccagtggaagagattcttaatgagctgttttggggttagtgtataggcacatgtatttcaaatacgtatatatatctgaatacttttaatgaaaagcaaatcttgtgatccacacatttaaagagaaagcaagtgaaaatattgacaccctcttttccataatacaattcttcttctcattttcttacatcgttaattccttatggaaatcaatgaaccgtcccatcaaattttatcaagcataaacatcacagatgggtttgggaaagaaataatagtttgcaacccacaccctcaattttagattcaggaagcctcctcccaggtataggatcttaaattttgcatttctaacaagttgctgctttgtgaaccacattttgaacattactgctgaagaacaccccatgttctagaattaacagaatgtttcctaatcacatcttgtttttcttccttagggttatggtgccctttgtaggaaacaacgcacccaggaactgctctgtactttatactgaatttaataaggacttacatgatacctgctagtgttacttttaattatcttaagagtggttgataattacattcagttggtaatgaatcccaccatatatatatatatatatacatacacatatatatatatatatatatacatacacacatatatatatatatatatatatatatatatatatatatatatatatatataaacctgcgaagcttttcaaataatcagagataatttcctagatctcttattgatatggtttggctgtgtccccacccaaatcccatcttgaattgtagttccatggccacatgttgtgggaggaaccaggtggagataattgaatcatgggggcagtttcccccatggtgttctcgtggtagtgagtcagttttcacaagatctgatggttttataagggatttcccctttcaatgggcactcatttctctctcctgccaccaccatgtgaagaaagacacgtttgctgccctttctgccacaattgtaagcttcctgaggcctccccagccatgtggaactgcaagtcaagtaaacctctttccttaataaattacctagtgtccagcagttctttagatcagtgtgaggacagattaatatacttacttaatttggagtttcacaaaataatgattttcagatagtattgttctttctgcatatattatctgaaattttacttgtaatcaccaattttttagttactctgaaattcaatatatataggaaaagtgggaaaaaatcatgattcttttattgatcaagattcaggaaaatgcgatcgtggcctagtaatataaccagtgagttttattctgggtgtcatgatgaatacatgaacttttatgtctttatcattttaaatccagtacaaatattcttacagatgttctaattgtcccattacagctggtcagtttcttctggttgatatttgggcctttgtgtttttattgtttctttgttttatacatacatacacatgcataagtctctctccctacagagagatatattctacctctagagagcatacacacacacacacacacacacacacacacacacacgttcttatagactgtttcctaatcatttgtctagagagagagaatacagatattcttatctatctatctagagactatatctctatagctctaacatatctctatatcttctatctatctatctatctatctatctatctatctatctatctatctgtttcacaggtttgctctctactccgggccccagagtgctaagaggatacatgtatgtacatatgtatgtatgtaaactaaattatcaacaatggttttcttttgttaaaaaagatttttcttctgtatgatctttgatactgtaaatttatagcaatgcagatatattgttttggcaatcagacaattagaaaaatataaaagactgtatttaaaggaaagaagatatcatctgaaatgggatacagaaagacagttcacacaaaaaaggtgttttatggccttggaatagtttcaggaaggaacgaaaatgcagtcacaggactgttcttgaatccctacagccaacgtttgatcaattgtactttctgtagcatatctcagaaacgactgggagcaaattgtatgtggagatgtagaatgtgtcaacaaacttgaagagaaatcattaagtattacgtttggagttcagcccaaagcaaatatttctgtattataggttcttctaacagatggatggtataagtggttcaatactattcttgcctaggtcctcataaaagcaccagagggaacaagaatgcaggtaaaagagaatttactttacttcttgcagcgctaaaaccagtccttcaaaaagacactgcattccccatgcatctgcacaggcattaggactcacatcccccgtgtgactccaccacacatctggtaatgatttctgcctgtaacttgaaggattttacctgggtttcagctctaacttctcccatgcttgactaagtcttccaccactcagatgtcttattcgagcctaaagctcagtgtgtgctatattgagctaaacatctttttctcattcaaactcgtctcttttcttatttcccgtgttaatatcacaagaatgtatccagctatacaggttaaaacacttgaattcatatttttaccatggcatctctttgtagaatcccagtatatggttaatatttggggctcactgattagtgtttaaatcggttatcacacccattacttccttttcattcctacacgcatctgcaactccagggcaaaaatctgtatccactttaaatcactgcctgccagttattcctctgcgtctaaacttttcagaatgcccagacttggtgttctatcttcatgctaagtctcaattaaaatgtattttacgcaggaaggtttaatagttgtgttatataaacaagattaagatcctaggcttatcttccaaagccatacacacaagctttgttcatctaatatttgtttagtatcttccttctgctcaatcagaatagtcttttgaactctgtgttcttatattcacagtatgtctgtcttattctttcattacatggacactgaataaatgaatacaagtcctcttaggtgacaggtggcctcagggacaactctattccaagcaatcatgtgatgaggacgaggatgatctcagcttgaagtcttttccagcggaggggagggagatttatagtatgatagaggtgtttacattttataacagtgtacaaatattttaggcagtttacttgctggattcatttatctttcaatagacaataaatagcagagcttttgaaatgctattcatcaatagtgcaatcatatattatttaccaagaatgtgtaccctactttccgctgcagtgacttccatgtgaaaatgctgtcactgagcttcatggaagccccttggtgcccttccaaccatcagaaaagatatcatacggatagaacttggtacattgaaatttaattcctctgtcaaataaaatcaccttagccctgtcatacagttatagaaagacttatttttttttttaatttttagtttttttttagagatggtatcttgctatgttgcccaagctggtccttgaactcctgggctcaagtgatcctcctgcctcagtctcctgagtagctgggactatagacatgcaccaccgtgcccagagaaagactcattttggttttagttgatctgctgattaacctgttagaggaaaatgcaatgattattatttccaaagctttgttggaaagacagaagcttgttcattttgaaaaaaaaatctacataagatttaataaactattaattatttttaaatagactttgctaaatatattttacaagatgtattatgtgccggcttggcgtggtggctcacctctgtaatcccagcactttgggaggccgaggtgggaagatcacctgaggtcaggagttcgagaccagcctggccaacatggtgaaaccccatctctactaaaagaaaatacaaaaattagccgggcatggtggcacatggctgtaatctcagctactccagaggctgagacaggagaatcacttgaacccaggaggtggaggttgcagtgagcgccactgcagtccagcctggacaacagagcaagactctgtcacacacacacacatacaaaaatgtatatgtgtatacgcatcttataaaatatatatgtgtatatgtatatacatatatatacacacctacaatgtagtgtgtgtatatatatgcatgcacacatgtgtgcacacacacatatttcacacttattactttgatattctagaagcttttggttaagcttacatgtataactagaatattgttgaataatataagggaaaagaaatatcttttcttcctatcttagtttcatggctgaggcccctatgacaaaagacagattaagcaaagagtgcacttcatttaataacagttttatatgacacaggagccttcataaggcaatgaagacccaaaagaaacagggaaacctgtggatttttgtgcttagatacttaggtttgataaagagtggacagtcattggaaagtatgattgaagtaaaaatgtttattatctaatgggaaaaaactggggagaacttagcaaggcctgtgtgttcagattctcctctgtgtccttttgtcctcagagataagaatgttctattcctcttggtatagagagtcacctctcataggagggtcttatgacctggctttaggggagaaggatggggagaaggtcagagagaactttcctgcttcttctgttttttcaaatgctaaggtgccatatttatgggtggtatgccccatcaagaatgctcattaagtaggcttctctctgtagttatagactgggataaattaattcttagccctatataggacagatacatattttatgaaaagagtaactggcagttgagcaacaataagaaatgtagataacacacaatcttaatgacatctgatgcttctgtgcagtagcacttaaacggtgtgcccttataccagcagggaccctactttgtggaaagcaggtagatgcacaaatcctcacaccctcccctaaagcaacagaacacaaattgtgggggatggaccccagaatgtgcctttcacaagcccttggtgtcattcttttaaatgcaaaagcatgaagagtatcctggtagattgcatggatcacagaaacaactataacccaaaataatgaattccaataaatatatttcaaagccaccaattaattggatccagtgtcatctgctagataaaatatgtatgcaagaatatctccaggcttgcaaataaacatgatgcattatattctgtgctgccaaagaaactggggtgctccctctccccgctgaatctgacatttgcatgaggtctgtggaagtgaactgtggaatatccacctttgcaaagagaaatatctaccaggtgaggaatactggttttatcttgatgatagcataaaaagaattggctccaaatatatgtatcaccctttcaattgctctagctcatccttccctgttgctgtctttcctgatgcattcctaggtcctggatcctattgatttaccccatcctgtctgccacagttctttaaacttccagttcagctaccacttatcataagggactctcatggcagtaaatgttccatcactttcatccataatcaggggatattatatcctttgttttaatacaccacaaagaagtaaaaaagctccacaatggatctatatagtgatgggttgggaggcagagtggggaaatgtagtggatttgctctctggagctcatacaagtctttggttaaaaattcatattgcaataaaaaatactcaaagaagttctaatatacccttcattgtccaaattgtcattatgaattacttaatattttggcgtctatagtcatagctatgatatacgctgataaatgagctgtgatattcaaaaccagaacattaggaaattgttcctggaacatttgggattctttttagaaatagatgaaagccatttagaaagttttgacaagtaatgaaataagtatatatgttgcatttcctgggtaattttgttaattggtatattagctaactacatctgatgtggtctgtgggaatgaaggaagctatcaaatagttaagtatttcaccatttctcaatcctcttcagtccaaagtccaggggcaggtggtggcacagattcatttggatggtttagaatcctacctttaatgagaagcatacacaacgtgggaaaaatagtaatatatccaagaaagagagttatgcttcttttgagatggtgaatagaacataatgccccttcctccacagaaatctacttttgaaaaactacagaggataagacgaggcatcaatctgcggaaagagcaataatagaacatgaaatcagtaagctataagccatcccgaggagattacaagctgatgaatcatgtatatatggtgaatgggagtggctgcaccttctggcagagggtggaagtggtaatagaaagatgctggtttaaaaacaaagtattaagttcactcttgtctcttataaagaatgccttgagttaatcattgtctaatctccctcccatcttctcttctccatacaacttagaactcgagggcagccatcaggtagtgggactctggcaagcccacggaaaactcagctgcgttgaggagctggttaaaaactttcagggccaccagtcacttatggccactatgggcttttcctgtttcacccccttcccctccacacccccaggaatgaagctaaagaggctgtttcttcctaatgctggctcctttagagagtttaaagccaaatctcaaatttcaaacttcttcagtgcgccagagtgatctaaaagtgtttgttgaatgttaatctcatagaagaaacatagacttgggtctgcccttaggtcccatcacatgcgtaattacaaaccagagtgatggatgagtttccactcacctaaggagaacacaggctaaatgtttaacaaagagctatatacctgaacatttacaaaggtaccaaacgctctctctcaacagaaaaaaaaattcttctacgttaaatataatgattggaacagatcaatgaagaaattacaatagacaaaataaatatattcgatcacctaagggaatatatttcaaataggagattataataagaagtaaaagagaacttggtaaatatagtaggtatagaataaataatagtaaagatgaacaagaacctaatagttaagataaatcatagaatgaattaccaaattggaagatcagatggaagaaattcccagaaagcatcaggaaagaataaaggagagaaaggcatccttggaaaaatggatgactttgttagagataccaggatcaggtaacagaaagagaaaaaaaaatacagaggaagaactaagttgatgaaagaatgaaaatacacttgaaacaaacaaaaagaacaaaaaccttattttgaatgggctcaaagagtgccctgaatagatatattactaagaaatttaagaacatcaaagacaaacagaaaattctaatagccttcagagagaaaaatgggtgagctatgaatgaataggaatcagattgacatcaaacttcccagtcatagcacaagacattagcagacacaggagtcatatttgaaagtttgaagaaaaataactctgaatttaaaaaaatttaatactataggccaagttaaaaaaaaagatcaaaaagagattcaatcattttgctaagcaaagatttaaagactgaaaattatctttgagaaaatacttatcaaagaatataactaatttggtaagaattctgaaaaatatatgaaatgcaagcacaaccaataactataatttctatttggctaaaatgggtagaaaaaggaagacaaaaatcatatatggataatagcccagaacttaaattcttggaaatatctacttaaatagcactaggggtgggactaaaaaagatgcatgtttgaaaaaagtttatcttgttagaaattcccagatctgtcaatgaattccttgatgtattctatatatttttgattttcatatagaaattgaacaaaattggtataaaccaatattatgttgttaaatttataaaaacaactgggaaaaataaacagcattccctgtgatcagttatggttaaccatagtaaggataaaaaatagataacagagttttaaataactatgtatttaaatatctattaaatgacaggtagaaacttatgttttcaaaaacaaaatgtacagttacgcttatcctgaagtaactaaattgaacatataaaacaagatggcagaaataagcatcggtaaaattaacgttcaacaaacataaatggtttaaactcatgaatttaaaaaaatttccagacaatctcatgtttgtaacaaaacctaagatgaagaatgcatccaactcaagagacaaatttaaacccaaaagatatagaaagactaaaattatcaagaatataaaaaatgcaagcataaataagacctaaaatgctgatatggaaatcctaatagctcaaaaactagaacataggaacataatattataagaagaagaaagatgtctatgcctcttgaccaaaattcccccatgaacccaacttccagtccctgacaaccatgagtctactctctgtttctctgagtttgacttctttagattccacatataattgagatcatgcagtgtttacctttctgtgcctggcttatttcacttaacataatgtcctccaggtacatccatcttgtcacaaattacatgaattccttcttatttccttcttttttaaggctgaagaatagttcattgtgtgtgcttatatattcacaatatacatctcaagtataacacagatatgatgaaaatattaggtcaaactttacataaaacagagaaaaccccttgtttaaagcataagaataaatacatatgaaaacctgtaacaatctgacgatgttgtaagatagaaagaaagcttccataagactcgaatgatcaatatgacaggaattcaccctatgaatctaatgtggtaaaatcagaagttagtgcaaataattagattttaaaaatctatatgttgtgatatattcatccctacagcacccagaaaggaatgcagccctgccaatctcttgatttcagccatgggagaccctaagaagaggaccaagctaggctccactgcaccaggatttctgacctacagatccctgatgtaataaatggctattcgtttatgctgctaaatttctcataatttgttatgacagtttagcaaaatgtatatagcagacagacaaatgcagaaagggaacataatagagtgataacagacatgtgcagacatacaaacatgtttttcttcatatatacaagaagtcaatatgtaatgtagtccacaaatcaaggaggaaataaatgatggttttaagtacaacaaagaaataatctgtccaaggtggactgaatggcaagtctaccacctattaatgaatgaataatttgtgtttttatatgaactctcccagaaagcataaacaaatgttctcttactctttctacacagctactattagtcgatgctaaaaccagggaagctcaacaaagaaaaattatagtctatcttgttttgtacagagatagaaaaaaatgattaatatctaacaacaaatacaaaaacagtattaaagaagatactgaatatcaagctaagtttaacatttgaaagttaagttatttaatttgctacatgaaaaaattaaatgcaaagcaaggataatcttacaagataaagaaaaatgccttgaaccaatttatgattgtatgttatcaaattaaggaaagaaataaacatttctttatctgaaaatggtagtttatttatatcttacttcaaacattatacataatgatacaacattggaagccttttgtctaaagagagaacaaatcaaagacagctaatttcatttctattcaattttggattcagtgcagtgaatgcagagaggacagggaactctgatactgttcttgggtgaataaaactgtccaaccacttaaacagtttttaacctgagagtgtatatccaaatatgcacataaaatatggtccagtaaatacatttctagttggagaaacttctgcattttttttcaacaagagacacgcacagaatcctaatagctgaactctttacataaggccaattcaaatttccagcttctgaaagagttaaatatcttgtggtataaccatcgggtgaggttccatatatcagtgaacacaaataaactacagctccaagcatcttcatggttaaaatcaaaaacatactattcaatgaaaagggaaatgccaggtcaagaagaacataggatgatcctatttataaaagatcaaaagcagagcgaacaatatattctttgggttatgctggtcatgacaattttgcagaaataaaacttaataaaagaaggaaataatgaatcagattcacaaaagtggttatccttaggacaggtccaaagaaatacaatttataaaaggaactgaggggaatcccaaaatcttcgtgttctaatcttaatttgtgcacagaaggatgttcatttaattcttcacatccatgttatgaaacattatctgataagaaaaaacaaaaataaatgattaaaattgtctatggaagttggaagcagaactgcacaaaacagcttgaggtataaaaaaatgatacatccttgcagtaattttaggtaaaatccagcagtttaacaacgggagtgattactaaccttaaaatttctaatcctacgaaacccaggaatttaagtttgtggtcaaataccagataaacattaaaataattgtttatctggaatgaagaaaattatacgtgttctaatttttcccagtcttgtgctaagagatctttcattaactggaacaaattaatctaaataattaagtctcaatatttataaaggcattttattaaaatggtttttaaaactaatgttctaccattctcagttgctgtgcctggagaaattattactgattataaattttactggtggtttccagacaggaatgaacacgtgggagttgttttgcaagaaagttcccagctacgtcccctgagagttctgatgtattggctatgttactggaattggtacatagtaattactcaaattgcacgcacagctaagagacgtgataaagcttctaaaggagttccctcgtgtatacaaaactattttaacagcagcacacattattttaacacagagaagcaaaactctttttcaaaagagaactgcctttcagagaattatttgttaaatcacgagtggcagagggtgaaatccaaaaacaagaagtgatggtgaatctgctctagccgatcagtggagctgagagttgtagcatccagaagaatatttcatgttaggatagccaaaaggtagtcagcaaaagggcgagatgtttaatttaaaaggtttatttttccctcttatcccataggataaaatgcccccaagtttctccccaaatcctcagttaaatctaataaacacctctctctctctcttacacatagttgaatgaattttttttttaagcagggtctcactctgttgcccaggctggagtgtagtggcatgatcacagctcactgcagcctcaaactcctgggatcaggtatcctccagcctcagcctcccaagcagccaggactacaggcaggtggtaccacacccagctaatttttttctattttttgtagagacaggatttaaccatttggccaggctggtcttgaacacctgggctcaagcgatcctcccacttcgacctcccaaagtgcctaaccttgagtggatttctgaattgagaagtgacccagtctttcatgttgatatctgaggtggaaaacacatcatctataaaggacaataggtaagacgggctccaaaaataaccatattaacctgagtcatcacccatcctctgaaagtaatcggcggacatgtttggacagggtttggacttccagagcgactaaagttcacatttgagtctagattatttctttatttaccttatttctttattacattcattatgaggatgccaattccatagtcagggattccagaagcagggatctgggatgcttttgcttacggctgcctccaggaacccaaaatggtccctggtgcactgctggtacaagtaactattggttggatgaacacattttcagggatagggaaacccacattatctcaacataatacaattttgtggctggaaatatcacaattccaaccacatgtatttcaccctgaagtctgtacaaacagagattatggatgaaagtttcaacatcttgttctctaatggttgcatccttttttcccaaaaatacgttggagattttgtccaagtctgtggtgtccatagtggctgcagggctgcaaacaccacatctaccctacgggactaagagactcaaatccccaactttagaatagggataggttttgtattcagatttgtaattgggtagggtcagggtttgggttcaagttcaggtttgggtaacgattcagaacaaaaaagattttgagtgtgtgtatacattttagtccaggctgggatctcacagtcaggagtcaaggagaaaaataaagatcaaaggtcaagggttaggatagctttcaggtatggaggaaggttcatgttaggatttgggttcaagttcaggttgtggtatggttagatcactaattgaatgtcagggtaggagcaaagttcaatgttatgatcaagggattatattcattattagggacagtgatcaaaagtcaagattaggatcaaaggccatgggtcggagaatttgggggatgccttcagtgttcagatcaggggtcaagagtcaagggctactggcaaaagttaagggtaagttcaaaggtttacattaaagttagattaggtgttcggttggctttgcttttgagtttagaattgagttctttttcaaagttgggtaggattaggtttcatatccagtcactagttagggtttgggttcaaatttgggttcaatttctcattctctgttcagggttatgggttaactcaacggtcaagaagcaatggtcaaaggccatgggttagtttaaagcgttcaattctgtttagggtcagtattaggtttagagttagaacactacatgggacccttatcactttcacctttatgatagaaaatcataatcagaaaaacacaaggagaagggaaaacttaataatctatgcatatttttaggagacataacagttgaaatatatcagtaattaataattattataataagcttcaatgtggcacagggatatttttagcacaaaagatattaaccctagacaatcccaatctgagctacagagattatgtgtgtttgtatttgtgtgtgtgcgtgtgtgtgtgtgtgtgtgtgtgtgtgtacttcataccactgatgtcgaagcttggttttgcattatccagctcactcatgtggagacactattggatgaggatggatgcatgtcacagatttagccacctctacgaatgggaaacatatagattgaagatagttcccagcagacattccatctgcatggagaagggaacagaaagaggagtacctcagccatagagctctgggggtttgcaggatgggaacagtctgataggaaatttgtaaaacactgcatgtggagggagggagaatgcaaacatatttaatataataaatgtctaaatgcttaaattttggaagtggaaaaatagagagatggtgaaaaatcaaatcactcagatggggcaaacacacacacacagaagcagatgcacacacacacatacacatctctttggctccaagtggtctggtttagggttaatgctaatgtgcactcttagctacaaagaggacatgacatttgaattccatcaaataaattggctgaattactatattataaagtgtccattccatgattccttttctgctcaaaaaaaatgttttactaacccttcccattctaaactgattttatggttcatatctttccatatttttgtcttataaaaatatgtgtaagatattaagctttcccttttccaagcatctttcaaattatgattttcagtcataacaaagaaaagagataagggtcccatgtagtattctcagttcccagttatgttccagaattaaaataacacaagaaaaaaataaaaatgtcaggaagaaacacctaaaataatgtggtttacttagcaacactaagtcttcaggatgtggtgtatccgcaaattgccctatttttaactacctggaggttctttctgcgtagatgttaattttttaaactattttctggacctaaatgtcttgccaaggtaaaacagcatttaaatactgatgagagcccagactcacctgagaatgggcaagaacgtgtggaaaaatacaaaatgtcatctcatcacttttagtgcctcagctcagccatctgcaaggctactgagatcacactgttgcatattaaatatgctgggatacattatttctcatgcatttcttatccagtactagaaaccacatttcatcacggaaaaaaaaaaagaaaacaaaaactaatttctgatactggcttattgaaataaagccattattttccaggactaaatcagtgcctataactttattttaaatgtatactatcccttaaaccactggcagatttaaaagacacttcatatcttataactacatttttcttaaaatttgtgttttagtctattcattaaactgcaatttaagagagaattttggaaagctaaatagatgaggcaaactgccttagagtgtgtcttcaatagagactgtgttataagaaacgaattttgctgccttgagtaaaatcacctaatagctactgtgctgctgatgaaccccagccttgtgaagatctgatgctgcaaaaataccccattaatgctcaatacactaaaaggaatatgtgatacagtgaacactgtttggttctattctctagaaaaaaaaaaaacttttttttttttagctaagcaaaatgagatccacattcataaattactttaaaatgcctttcttctatcacttattataacctatcatggtagcagagaagctgttaaaacatgaagagctaaaataataaatcaccaaagccaggttatggcttgaaaagtctgcctgacatagcgtaagtcaatgaaaatctcacagtcagtaaaagaataaaatgttagggctgggtgtggtggctcacgccagaaatctcagcactttgggaggctgaagcagaagaatcacttgagcccaggaattcaagaccaaccaaagcaacatggagaccttgtctccacaaaaaaaaaagttttttcaaaattaaattagctgggtgtgatggtgtgtgcctctagtcccagctacttgggaagctgaggctggaggatcacttgggttcaggaggtcgaggctgcagtgagctatgagggcaccactgcactccagcgtgggtgacagagtgagacactccctcctacaaaaaaaaaaaaaaaagataaaacgttgttctggatcgtatgctagggggtgtgtgtgtgtgtgtgtgtgtgtgtgtgtgtgtgtgtgtgtgtgtgtgtgttgaaagacagactgcttcatgttctaaggaatatttcctaagaaatagcaattaaaagtcctagagtggcctaagcaagaatttaaacctgcaaattaattcaaggaaaaacaaacaccagaaaatttccatggatcagattgcttctgacaactgaactcttcctacggagctatctcaggttgtaaaatctctttgaataaagtaagttgggatacaaataggataaaatgaggtgctgactctgaatttcaggaaaggagcactgtaaatattaacagttcagacatctggggcagagaactagaaaaagtcattgcacctttgtagctaagaacacagattccaaaggaggtaataaatctcccaagaacttcccttgttctttgatgtgatcgcaaactgattaaacattcaaatgttgccaaatggctgatttatgaaaatgaatgcacctttcactgactgctgaaaactgatgaaggaaaaaagttaacctgtgattacccaaaggaatggagaaagccagactggaattcaagagcacccgctcactgtctctgtaaggtaaaatgaaaactgtatcttaattagaaatattaaaataacaactgccatacaagtagagtgggttgatttcaaggagcaggatgttaagaaaaaggaagctcttaatgcacaaggtgaaggggtaaaatggtttctacatgttgagtcttttaaattaaaaaggacaaataggccaggctgggtggctcacacctgttaatttcagcactttgggaggcttaggtgggagaactgcttgagcctaaaagtttaagaccagcctgggcagcataacaacatcctgcgtcaacaaaaaatttaaaaattagtcatgcgaggtgacatgcacctgtagtcccagctactcgggaggctgaggtgggaggatcacgtgagcctgggaggtagaggctgcagtgggctatgattgcaccactgcattcaagactgggcgacagagtaagaccctgtctcaaaaaagaataaataaataaaaataaaaataaaaatagacaaattatttgcagtgggggcgagccacatcagggaggagtggttcactaattctccataactatgtgcactaccatctgaggattattacccagacttcgaaagggcatgacatgctgggcatggtgattcatgcctggaatcccagcactttgggaggctgaggcaggtggatcacctgaggttagaccagcctggccaacatggcgaaacctcgtctctactaaaaatagaaaaattaggtggtgtggtggcatggtcctgtagtctcagctactcgggaagctgaggcagaggttgcattgggccgagatcatgccactgcactcctgcctgggagacagagaaagactctgtctcaaaatgaaagagaaggaaaggaaaggggagaagaggggaggggagagaaggggagggaaggggaaaggaaaagcatgagaataatggcgttatcttccttgattgggcttttcctggaggagcccactggttgagtaaagataggaagccagtgttctgggtactcaaagtcagttgtaaggggcctgtccaccaaccttaagattagtttatagacaggaatgtggtaagcagaattataaagtcatccacccaagattctcgttcccctggttattaaatcaaacatgaatctaggtactgttgtgaattgtctttgcagatataattaaggttactaggcagctgatgtcaagataagctgattatcctagaatatccaagtgggtccatgatactgagaagcaggaaaatggtaatggaacaatcagtccagacaagccatgcaacttgggaaaggagacaagaggtagaaaaggaagtcggagagattcagtgcattagaagctgccactgctggctttgaagggggaggaaggaggccaggagtcaaggaatgctacggttctcaagaagccaaaatttgccctcagccaatagcctgcaaggaagcaggaacctcaaccccatggaactggatgtagccatcaacccaaatgttcctggaagtggatgcatccctggagtctggaggaagaaacacagcctttctgccaacacacagaaatcacccttgggtgatgatgaagagaaaccatccgagctactcacacttcagagcttcagaatggtgagataacaaatgcgtgtgttttaagccactacaggttggataatttgttacaggaacaataagaaacgcatacaaggacatgcaggcagtgtgaatcccctggataaacttgaggttgcaaaggatgggatttggagaaatgagggtttgtagaaaatgctcaaaaatatgcttacatgaagtctgcaatgctcagtacccacagggtggtaaacttgccttctaagttaaaggaataatttgaacacagagtgaccatttcttcctatgtcactgtgccctcctactagaatatccacattaactgaggatgaataccagccatatggcagcttgccatgatcatttaaggatagagctgccttgttactctatgcctaactgggaatccccagacatctttaagaactgagataggccagggaggtttgggaggaaactgtaactgtgggtgccatcttcaaccataaagtttataaatgcatgattctgtatctctgtacatgatggagataacccagaagttcaataaagagacccatctattttggggacaccctttttgcctcaccaaccctggatctggaatgaacaagggtagctcagattacctggcttggacatgaaatgtctgttgtgttataatgcaaaaagttgctgccagtctaaccaggagtgggaggcttccctaacttcttgcagaactcacagacagtagtattctaaaattcttgaaacagttacaccccctctgctgtgaacagcaagctgctttattctctaagaaacttgcatatcttcctaaccacccccaacactaagcagtgccctatcactgacattcagagtcagttcacttcaaaacacaaatgaatagggcataagagtccacatcaattagaagatacccaaattaaggccaggcatggtggcccatgtctgtaatctcagcactttgggaagtcaaggagggaggaatgttcaagcccaggagttcgagaccagcatgggcaacagatcaagactgtctcttaaaaaaataaaaataaaaagtagcctgacatggtggcatacccctgtattccagcactttgggaggccaagagaggaggactgcttgagcctaggaggccaaggctgcagtgtgctatgatggtgtcactgtgcttcaacctgggcaaaagaaccagaagactctgtctcaaaaaaaaaaaaaaaaaaaaaaagaagaagaaattgaaattaatgaactactttaaccttggaaacctctctggtctgaaagaagaaatcagccaaaagaaaaatactatttgagttctattttgtcattacttttgacaagataatagcaaatagcatggaaagaaccatctgtttggagctagaagacagaatttagatccctaattttatcaaataatggctaagaaatcctgacaagttatgaaaccatgctttgtcgtgtaaactatgaagttaataatagtactttcatcacagaactgttgtggaggataaaatgaaagaaaaaggtagaacacatacccagtgctgtaaagcctttgaaagtagtgtctaataaaacaaaataataagtaacactaataacaattaagaaaagtatacctacatttatcttgttgtagtgtaaccactggggatctcttttgaccatccaatatgcaagagtcacaataagtaatgataaataccaagaagagagaaaaatgggagctcataaaaagtgtggaggttctgcaagtagacaagtatagcagtaaaggctttataggaagaaaagatggatgggacaggtcagtgagtaccccatacgagaaaccatgctcaggaagcactgatagtgaacttactaaaaacaacactaaaacagatgcatggtgtgattcaaactcccagaataaaataaaatggcatatgcttctgaaaagaaaagtgacatatgattcattttgtgaaaggtcccggcataagaaagtaggctgactgaatgccttgttggtcagcctggcgggatcacatttggaagcgaacttggcgcagtgaaaaggtatttcacattaaaatccaacagcatacacataaatacatgatttcacagccatggcgcttgtctggaatcaggaaacaaggattcccaggaaagccaggaggtgctctgttgtttttaacatagaagattctaaggataatggcctccagctcagaaaaccaaatactgcgtgtcctctcttataaacggaagctaaagtatgagaacacatgcacacatagaggggaacaacacacactggggcctacttgagggtgaagggtgggggtagggagaggatcaaaaaaataactaatgcgtacttggctcaatacctggatgatgaaataatctgtacaaaaccccatgattctaggaagccacttgcatgatattcgcctctttgctccaagctgaggtttcacaagcacatgggcagaatattcctcatgacttccatagaaccaagggtttatttcttccaatgatcatttaaaacaatctatcacagccatatggaaaaagaggcttcaagctatactttgtgctcatcagtattactctatacctgggttgctcaatctcatcgatattgacacatgtagatgaaagactctttgtcatggggggctgttctgtgccttgtgggtcccttaaaagcatccctggcctctgtcctctagatgcaagtgatacccacccccatgatctagctgtggcaaccaaaattttttccagacgtcgacaaatgtctcctgaagtaaaaagctcgtgtctttgcaaaaacgtccatacttgaggacggaaaacaattaagacacctatgtatctattacacttcttttaactgatttttccaaaatttacttatcatttattgtccatattggataccattacacaactcaaaaaatattttgtacagtctctgtacaaatcctaaaggaaaaataagagaatatggcaccattttatgtagagaatcaaattagtatgtggagctcctatagtttatttaaaaatcaagtagaacacataggaaacagagagggggctaagacacacacacagagctatcattaacaaatagtctaaatagtcataacttgaattttaggagtgtttctctgaggtgaaactcagaaagaccgcccataaatgtagtggatactggcattctttaaaacttttattttaggttcaggggtgcatgtgcaggtttgttatgcaggtaaactagtgtcatgggggtttgttgtacagattatttcatgacccaggtactaagccaagtactcaatagttatttttcctgatcctctccctctcctaccctccaccctccagcaggccccagtgtctgttgttccctactatgtgatcatgtgttctcatctttagctcccacttataagtgagaacatgcagtatttgattctctgttaccgacatagttggttaagcataatggcctccagctctattcatgttcctgcaaaagacatgatcttgctcttttttatggctgcatagttttccattctgtatatgtaccacattttctttatccagtctaccactgagggacatttaagttgactctgtgtctttgctattgtgaatagtgctacaatgaacatatgtgcgcatgtgtctttatgatggaacaacttataatcctttgagtatatacccagtaatggatgggattgctgggtctaatggtagttctgcttttagctttttacggaatggccacactgctttccacaatggctgaaccaatttacacttccaccaatagtgtataaggattcccttttctccacaaccttgccagcattgatacaggcattttgtttaggattaaagattcatagggatgaaggaacgtttgcacaagtgttttcaagtctgcagttcaaaatgcacgcaaggtcaggaaatttggggggaaagtggagtcaggtattttgtttagaattcgttaaaaattcacagggataaaggaatttgtccaaggcgttcaaagtctgaggcacaaaatgcatacaagttcatgaaattttgaggaaaaaaatatattctgaaattctccagagaatcaaaagtagcttcaagtgatttagagcctggggataagttgatattggtaacagaggatctgtgccttatacaaggaaataagatatattacgtggatgtaaagacatttctgatggagctgtcattttcccgacatggctggcatttctgtgagatgtatattatgcacacatgggtgtatgtgtatgtttgtgggtacaaaatttcaaatatcaaagtaatagatatttagaaaaaaaattctgaaagaaggcatagatgccctttttaaatgtatgtctcatccttaaaatgcaggcatttgcagaatagcatgagcacaaaaatggaaatatgtgtatttaagtaggaaatgatataaatatatacggaacctaaatatatgttaggcagatagagactgaaaagaatttaaagggtcattgccaactttccaaaaaacgttcaagagtaggtgggaatgtattgaaccaaagaatggaaagacatagtaacagaaaaaaaagaaaaactagttaaaatttcacttttaaaggaaagacatatacaaactgtgtgttttataatttgttctttcctgtgggaatatatgctgcaaaatttatactgtaaaaatagatttaatatgacccaaacaatagaaaagtcatgggatacaatagaaaataaaatggtgttcacaatttacatttaagtgtaaccaaaagaaattttaaaagaatatatttctgtaattatatccttgaccttttgctatccaatggaaattatactatagtaagattataaataacatacgccagtgaactttatgttaagtattatgcttattaggaactactcatgacaaatgtgttctttgagatgccatctttctattttaaaggacaaaatccagtttgcttgcagttgcacagtgctaaaagttacttctcgtcctgtaaggctgtgagtgagtcattcaaagagttctctttgtccattccatttccccagcctccaattttcttcccttgttcttcaagcctttagtcttgccctatggagggtccaacaccaacaccatgtactttaggtttctgttgaaacagaacctcacttccagtttcagtgcctgctctggttagctaatgttgtgtaacaaacatgcccataatgtggggcttcaaacaaccttttatgaggatctcccatgattctgtgagctgactgggcttagctgagaagttctctcttgagatctccttagtcagctaagggataggaagagacaggagtcctcaatcagctgggatgtccacaatgggtgactcacatggcggtactaatggttgtcaaccgggagtgaagctaaagctactgactggagcaccatgcatagcctctccatggggcttgaacactttgcaacatgagatgtggtttccaagagagaatgccctgagggtcagtactccaagtgccctaaatggaagcttaatagcttcttatgatccagccctggaagtcccagtgctttactcccagaacattctattcaagaagacagtcactgaggccagcacaagatgcaaagacaaagggttcaactcaatttgcaagagcatctgcatccatttctatctatcacaccctttatcttaaacctgattgatcaggtgtaatgattccaatagatatggaagagcacactacactaaaagtagtatcctacatagaggggaagttgcctcttgactcagaaaaacagactgctgtgatcagttggtgatgccttccagggataaagacgactgtcttatccactgaagacacttattctcaactgttcccttcacatacagggaatttgagaggctcagtacaaataaatgactgaccctcaaactgccccaaatcatacatcagacatcaaatcgcacatacagtgttgattcagaatcaagttatcatttgtgttcaaacattacataaggcctcaatttcaaccatgttactgttgaaatattatagattaatttctacagaagtaataagaatatagatgaaaactcgcattatttaaacattttaaaaatgatacatgacaaccacgtgagccctcagttacacttgcaggtgcaattgttcacacattaattcaattcaatcgatggagtgctttatatgctgtgttttatgtcctcaatgaggtttgatggattggtgcatgtggaaaaagggaggcatagtgtatgctgtcatgaaacttacaaccaacagcctacgacagatatacaccacccagtaaatgctgagtacaagtacagagtgcctggagtgactgcattagactagaaaacctggaatgtagcaaatgaagggaagatggcatgacaagagggaaaaacggcttagcaaatcagacgggtttgggacctgaaggccatgtgtaggaatgacctactataatacggtgatcagttgttctccctgaaaggcaataatcaatgcccggaaatcaattagaacacagttgcccaggagtaagtgagagacaatggttgatcatggcaggaagaatgcattttctagcactgtgttttccaaaatgctagccaataaccacatgtggctattgagcacataaaatgtggcttgttcaaaccgagatgtgttgtaagtgtaaaatgtactctgaatatcaaatatgtagtaaaaaatatgcaaactatattttgtctctattgtctgctgacttagtactttataaatattgggatacattaaatgtatttttaaaattggtatcaatggtttcttcgggcactcttgaatgcaactactagaaaacttaaaattacacatgtagtgcacattacctgtctatgggatgtggctgcactggaggaaatttgtggctcttaggtattttgatttgttatggttttctgtggtttcctcacataaataaccaaattcaacaggttaatatgtgtcatataatagtgggcagtttccagaaactttctgtacaaggagatgaaagtgtataaccataaggactctaaatgttacttaaacaccacgtcagtgggaaccccaagccctgatgtagcagtcatggaagacgttcagcagagaacagaggcacaagttctagtgttcaatcactgtgaccttgaaactccttgcctcactgtgaccttgaaactccttaccacagcatgaactatggaagcggctggaatatattcccagctgccttcactcttgcaaaacccttctgtcattctcaggaagtaggacggagaagaaacatccccaccacaacatgattataagaagggtcatatggttgtggttcctttattgcttttctcttgaactgctgtggctacgaatcagaataaacttgttctgagaacaataatcatcttcaataattaacattcacctacatccaaaatcatgtctgtttctttcttgacaatgaaacttacaatgattcccatggtttttaatgaatttattcttttacagaagacattatcttacttcacaggagtactacctgcctcaaattctcaggcacaagaaatgtcatatttatttatggctccataaaataagaactttcttccagtccaggaacacattgggatctagtcttctgtcttttctttttctactgcagaaatccatagcggccctttgagccatttttctgacatttgagcaatttgacaattggtcagatgaactaaaaagaataaaaatataaggcaatctgtctgtcataactgtgtgtagaagagcatcgaacctggaggaagtaagccttctctttcctgctctctctgctgggaggacggggggttggggagcagtatatgattcagggtgtttgtggacatctccattccttcccaacatgccctatcttacctcttttggctgctaaaacaaaagactgcagaccccacggcttgtaaaaaaaattgctcacagttctggagaccggaagtccaagatcaaggcatggcagattcagtggctggtgaggacccactttctgggtcatagacagcgccttcttgctgtgtcctcacatgataaaagggacgagggtgccctctggggtcccttttataatggtaggaattccactcatgaggctccactctccaaataccttccaaagccccacttccaaatacctacacagttgaggagtaggtttcaactatgatttctagggggacaactaccgcaaatgctgcaggataaggatctggaaatattgccagagcaagtagtatgaagccttggagatatcctctgcattcagcaatatttcatttccctccagagtgggaaaaaagttggtcttaaatgctttttcaaagatgaaactcttttccaaaaatagaggcagtggagattcgagggaaaatgcagaatggccattttttagaaacattaggaatagcaactccacttttgtggggcctaggatgcaatggtataattggcaagaggagtctggtgaagtggtgaggctatatactgattggagtgaatttaagaaaggataggtggagaggagttgagatgtgatcggtgaggactcttggaagacgaggagatggttgccagagaaacaaaaacatgcagccacatcaggcagagaaagtgaaggtcaggcacgtatttccaaacgggataaacaaaagaatgtggatgtgatgttaggtgcgcccagtggatataaactacaaaagatgtagatgttgggaacaacgttcttgagtaggtgtgagaaggatggggtttcttacgtaagaccctctatggctgcttctcatttcctgtatctattgcctatttttatatgaggctgtggctgtgaataggtctcggtgagtgggtgtgcatttataacatacacaccagatgacgaattagactttagtgttagttattcgaattccaatttttctaaaaataataagtggtactaatgtatatcaaagttctctgctaaatttgttcaccaatataggttaaatttattaaattgatctattttaaggaattggctcatgcaatgtgggagctggcaagtctggaatctgtaagacaggctggctggctggctggcaactcaggagggaggaaatgcagactagaggccgaatgccttcttctgctttgggggccctcaggttttgcatgccccgcagtaaaattgtacatgtcccgcaccttatattttaatttgcaatgctctgatattaaactgaaaatctgatgagcatcaatgtaactttctctgcttatacattaacagagaaacagacagcaacctcagtgtattcatataggtaacacaaggtccctggtcaggctggtgatatttagagagatctttgcagtatctcgttcactatccaaaatctttgaaagcccagatattgggaaactccatcaaaaattcctatcagccgggcacaggttcacacctgtaatcgttgcactgtgggaggacaaggcagggggatcatttgagctcgggagtttgagaccagcctgggcaacacagtgagacctaatctacacaaaattaaaaaaataataattagccagctgtggtagcatgtgcctgtggcctcagctactcaggaggctgaggtgggaggattgcttgagcccaggagattgaggcggcagtgagctatcatcacaaaactgcactccagcctgggtaacaaagcaagaccctgcctcgaaaaaaaaatctactatttgatagcacaccagagtgactatagtcaaaaataatctgttgtatattttaaaataactaaagagtggatttggaatgttcttaacacagagaagggataaatacttgaggtgatgaatgccccaattaccctaacttgattattacacattgtatgcctgtaggaaaacactgcatgtgccccatacatatatacatctattatgtatccataatagttaaaattaaagtgaaagacatcattgtgtgtatttgaagagaaacacttgagaattcaaaatcaagagccttctcttttaatttaaaggtaccatattctgatgcattcgtgttcgcctgtaatatgctcttcttttttcctagttttgaactgcaatatgcatcgtgttcatacaagcagcaaaaagatgttggaatatttggcctgggtttcaccacagcattattggcaatgataggagatgccccacggaagcccaaggcaggctgcagccttgaaggcctctttttccttatggattgtgaatttgaatgaaagtgcagaagctgcctctgccaacagactagccccatggagggtctcctggggctaaaggccatatgtgctcaacctaataaagttataatttatgcccgccctgtgaaacccagagaagagacagcaccagcattctgccagggattccaggagatgtggacagctgttgtcaaattctgagctctattttcccctcaattatctgagaaatttaggagaaaaacaatcaagttttggaaggttgcaaggcttctggggactaggcaaggctggagagtcagcatatacatagtacttatttatttatttagagacagggtcttgttctgtcacccaggctggagtgcagtggtgcaatcacagctcatttcagcctccaactgcaggactcaatgatcctccagcctcagcctctcaagtagctgggactacaggcaggcaccagcatgcttggctaactttttttttttttttttttttttttaagagatgaggtctcactatgttgcccaggctggtctcaaagtcctgggctcaagtaatcctcctgcctcgacctcccaaaagtgctgggattacagggatgagccaccacgccagcctcatacattgacactttgtagctaaatggttcactagcatcatcccttggtccctggcaatctctgtctctgtctctgtctctgtctctctctgtctctgtctctctctctctctctctctctctctctctgtctctcttgctcaatatttctcagatggtcaactgggagttaaacaaattgcaaatatctggatcttgcccagaatctagcacttccagggtccttgggggtaatttatactctcccactccccactcttttgaaatatctggcttttaaacttttagtttgacattcacatgtttctatgacagtaaggctccagcattaaaggatgttaccataactagtatctctgaatttctgtccactgttgatcaccatagttattagctagtctctgggtggggctttattttaaccatgaaaattcaggaccagaatgtagcatgtagatgctcttgaaattgatgaaagtgtttattaaggtaaatcagatacttaaaaatataaaatattccatttttttaaaacttgcaatgatatatctgacttcacaatatcgaaagtagtccctactattatcattttagcatttctaaaatccttaccatctggtaacacctcagggtttaagccaaaaatatccggatggtggaacagcaatacacttagtatcatgagagagccctttatttcttcatcagtaagtgatatagaaatagttcactggctttagctgcagtagctgacgtgtcaggtaagaaaataaacatatccatcaccaatgagaattccaaaccctgctcttttacagacagatattgaaagctttcgttttatttaaaacgtatctgaccataaaaagaaatatattctttagaaagtaaagtttctttttttcctgaaccagtagaaaagaattataatttccactctcacagggaagaaaaaaaattcagggtcaggtttaatatctcgaaagaaacaaggacctcagtaatgagtccatggaaatgaaaaccaattcccaatgctggaatcaaaggaggttatggaatagtaatgtaacataatacaaagtggcaaaataatgacagaaaaataatcagaacattaacaaaatttaagaagtatttttttttcagaaatgcattgtatgacattaccccaggaaaatgataggaaactctcattctccataaaaaccagtattaaaaattttaaagtacttcaatatttgttagattaaaggaaaaaaggagaaacaaccacactaaaaaaaaaaaaaagacaaaatcctgtataagaccacaccaacacaccacacagatcaacgagattcaagaaatgctgcttgtgtagtatatttgtttggaaagcaatgcaagatattcttaaacagtcaacaccataaaaagcattcaggaaaaatgcaagtaactaattacaaccatgtgtcttctaaatattccacctgagctgtagtgtcaatatgcaccctttcctgatatcaggaatatgaatacaaagtcctgcaaaactggaaatcaaactgtagaaaacaatatgactaatgaaattaaatatagataatatatatttaatctgtaatatataatatgaaatatatatatttaatctatatgtgtgtatatacacacatatatataatatacacacatatatataaatatataattttgactctcaagaaaaaaatgcatgtatatttatatttatatctatatttgcctgggagtcaaaatttttaagatcatagcactaaagttaaagaggcataaactggtttgtatgacaccaattatattctaagacatacacacattgataacttcataaaataaggaatagtttaattgtgaagttttggaagaaaatttatataagttatgcactgggtagaaatggaaaggctgagaaaaatcagtattgctggttgaaactgtggctgcctaagtttgcaatccaaaaaccacccaaactatctctctcattgtgtttccattgcctgaaatgtgtagaattatgggaactgagcagatcactttggggacaatcatctatgccccagttcaaaatctcttgtcagggcgcacggcatctctgagcaccagcacgtgcatcaccaacccaaagccagggaggcaggaggagggaaaacatttgaaaactgacagaaagctaagaaaccctccactcactgggcatttgtttcaggttactacataatgtaaacatgacaaaatgtatcctgatctgttgtcctcttgtttctttgatatgtgagagacaatagaatagaaagccacattgaaagaaaagaactgccagttttacaatctgattattggcattttttattggtgttgtgtgttaagaagttgggaatattctgtgtggtgtctgtgtgtgtgtgtgtgtgtgtttgtgtgtgtttaaagggaaagagaagcaaactgagagagagagacagtcagagacagagagagacaaagaagaaaagaaatgcaacaatcgtagtggacacccaaacatatatctccagaaactctttctcatacatccactaacatccttgggaatccctggtttttaacaaatgatagttactgatagatatttaataccctccagaataacctgcattacgtgcaaatagatatactattcatatgtaccttttttaccctttatttgcaatggatcctcctttccccgactgctttatttgggacagtccactcctcctgtatcaactttagcatctgagttccagaaaaaacggggagaggagaccccagattcgggatttaagaggttttcacataagcacgaatcagtacctttcacagcaaatatatatgacataaggatatgcctttgcatcacagtggatatttctgcttgctaacaaagacagttgtcattatatgaaatatttattcaaatatccttaactccacatctttcagtatctccatgtgtacgtcagagcagccattggtcaccctctgcctgatctctagatactgttagttgaccagggaaagttactggtgaagtaaaattgcaggacttgcaaagattgcaacatttcatgcatttaccaagacagctggtatgtattgcctggtgaatctgagaaatcaacgtgtaaggaactcaccaattatgcaatcccctaaaaaccacaccaagagcaacagcgattaagcagccctgaatcactctttgttgtccacatatttttatgtagtttcatgcctaacataaatttacccagtataaaataaactttgttccatcattagagtttaatttttgcaaaagcattaaaattttttccctattgtgtaggaaagtgaagcatttctgctttattgtattttttctaaagacttccttttaaattggccttttctttgtctttatcaccctgcagtattgagaaaatttttatgcatttaatataaaaagttgtcatcttctcccagcgaacaaacttctatttaaccaatcttgtgtaggacatctgatggacatgtggaatggagttaaataatagctggtgagaaattcccagatattcagggtttgttgatgggggaaggcagggagcagtgagaacaaaagttgaacatttccacaaaaaaagcatagatgaatttgacaagggtaataattctgaaactcatagagatgtctggattaaaaaaagaatatttcatcaaatttatcagagtaagtttaaataggtactgtcatgcatctttttgttaaaaaaaaatctgtcattaagtggagactgaggaagaaaatccagaatttttttctgtaaatttaagaatagcaagtccatctccttaatactatatactcacaatttcctgcttgacactcattaaggggtttagaaagtgtttctgcctgatgtctgaggaggtttgctaagcctctgagctatgtggcttttgcagaccacctgaaatgcttgacatattactgaaataaggtgaaaaatggttttccaaagtaaaaagctcctgaagttggtaatggaatatgagtacttgtaccatgtgggctcccattcaaaactgccatcttatcccttccctaaaatatctctgcacatcattctcttcttcttgctgagtcatggtttatttaagatttgcctacagcaaacacaagcagcatttccctatgtagaaaccaggttgcagaaaatgtagagatacaggctatcgcagttttaatataacctggctgagtttcattaggttcagcccgtggggctcccctaggtcaaactgtaaagtcaatgttgcaagctacctgagctaatttgttcatgcacaatttttaggttcattttagattacagttacctactgttaggtaaggtaacagtaatcgcagaaaaagaaggagaccagtgatagtttgtaattcctcccctcatcatgtgtgtctcaggcccaaatgtgttacacatataggcagtcattcatctgacttccacagcagacagaaaacagttcatatgtctccttccataaacttgtgagaggtacaacttctatcatgtagctctttgcctctcaagtctttaaggacaaaacaagtggtgttcttttatctttctcagtcagcatcaggtaatgagaaattttccttagtccatggctgagcgtaggactaaagagacttcaagttatgggcactggagcaggtcaaaggcataggcatttctggatttttataccttcatcatgccattgtgaacattttctctaaacgattttagccaatttgtatgttttgaatattttaatgttatgggccaatgagagttcatgctaacattcaccatgatgtaactagtaattcctttcatgaatgtagtgcatttctggcatgctaatgacaaaaggctgtgtggattgagatgtgaacagctgaagaactaagatgtggattttctgatgcaggtctagcaaaccactccaggaatgtggacataaggttaaaacaattttatcctcctcaaactgaagcgcaggtacataatagcatattatctattctattttcctacctcaatttccctgtcagccagatacataccgtgcatttgacatcacaggatggatggggtgggcaaacctgtcagttcttgctttaaaatttaattactgaaatattattcaaatactcaaaaccctcatgaaattgtttttgttgatttcttcgtggtgatgctgtttgttttggttatgatttagatttctacaccagggccctggcaactctgaatgagtaagatgcatttgcgtttcatcaatacgaaaagaattacccctggaaccctgagttaattggcactgtatgtctaacttattccactgacattataatgtgtctttgaatttgtgatacgattgcatcacaatcggtgtctgattatttatagaattatcataaagctgcaaaagtagaaagagggttttacactgcagtgttgtcgataagtgttccaaataacagtgaggtagtttaatcagttatagtatatcaattaagttcaatcaatattacacaactgcttgaaaattaacttcagtcaatttccatattaaaaacagtaaataaagcaagttgcagagtagtataattaatatgatgccaattttgcaaaaaaaaaaaaacactaaaaagaaatatgtgcaaatgaataaatgtgtgtgtgtgggtggtaaagttgtagaactgctgtttgtaattcaagaaagagctggagaaaatacacagaacacactgatggggaaatttcactatattatacatttccttatttttaaaactttaaagagtaaacatattttaaaagcaatatttcaaagaacttacttaaatactttcacaaaggaatttaggtataatgagctgcaggaaagcaaaaaaagtgccctattttgactgaaaataaataatttatcttttttatgctgttttctcttacacatcataagaaaatatataaattgtgtgtgacaagcttaattaactaccttttctaattagtactttaatgaatagccttctaaagatattgttccttaacccgaaagaaaactctaagtaaaatagcggcacatgagaggaagaagttttaggaaggcaggtggatagtcatgtattttttcatgatataaagtagttccttattcttcttaatcagtttgccatatgatccaataattagttcatttttagggcaaggttctagcaagttcgtgaatgttatacttcaccaccatattttccataacttacaatattttttacaaaattattttcttctaaaaatgcttaaaatattcacattaataataaatttcagacctcggggggagaatttatttattcatttacttatttatttactttattttatttttatttatttatttatttatttgagacggagtctccctctgtcgcccaggctggagtgcagtggcgcgatctcggctcactgcaagctccgccttcccgggttcacgccattctcctgcctcagcctcccgagggagaattttttatctttaaacaaagatacaataattctgtagaatgttcattgtggaaataagttaaaattgtgaataatgctttttgtaatgagagattggctttcagaatctaacagatattttggtagacttgtaataaaggcagtgaaaagattttgaagctctcagaagaaatctattgacactccattaacagtctgacttcttacagttcttatttaagtaaattacaataattccttcagaatttcaattttgttttcaacaggtatatagatttgccttcatcgacatgctaagttctcaaatttgaaattcgcatatacacagaaaaccttgcacaggttggatgggtatcaaaagctatattttaacaccatatccctttaagatctaaaaatgagaatgttaacttgttttatattaggttccatgacattttctggaatattcaattccataaaagtcagcacagccatttacataagacacaggagcttaaaaagaaaaagctaattctgatttactaaaatgtcaatgtcaatttgaaatcctattaaggttggaaaagcagttctttgccgtggatactaaaaaatgtgagtcatttcaaactttaaacatatttttacatttttgcgaacccctgaggtatcctgaagaggatttatcacctgaaactcatacaacattaaaaaatatatgattttgaactgctcaaaccgagttttcaaggatgttcttatttctactgcatgtaagaggacatctctctacgatatgtgataagccaaacaaagaaaaattgaacacattcagtctcatttcccttcatggcatcttatacctgctttttcctgttttgaatgaggtggttctgtctccatgttactgtaaatgtgaatcataaagctcattttgtgttgagttctaagagaaggcagttacacacagtcaaatgggaagagacagtacttatccatattagctagtaaaaagatataaactatttgacattaagtatgtatgtatgtttccataaaaagggctatggagtcaaatggattctaataacgcctaaacctgcagtctcaaaacatactctgttaaagaacatgcatactgcatgcatcattgggcagagcatcctataaggcaggtagagctaaggtcattttagtcactttaagactcaagacaacaagttctgagatatttggcagctttccaaggtcttatgaagtcagagaggagacttatagccaatgcataccaacacttttgcaaaaaagtcatggaagaattaactatcactatgtacgtttgttttctagatgaataataacaaagataaagtaaaatatgtacaccaaaaatgcacttgctatattttaatcaaaacagtagaagagtttattgatttctgtagttttcctatactatctccttttatgggctgaatgttggcattctcccaaaattcaaccttgaaatcctaaactcccttcccccaggagatggtattaggaggtggcatctttaagaggttgttagatcatgaggatggagtactcgtgaatgaggttagtgtccttcaagaaaagatctcaaagagctccctcaccctttttccatgtgaggacacagggagaagtcactgtctgtggaccaggaagtgggttgtcaacagagactgaatcttctgctgccttgatcttgggcttccagcctccagaactgtgagaaataaatgtctgttgtttattacccccccccacccccacccccagactatggtattttgttatagcagtctgagtggactaagacagaaattggtactgagagtgtggtgttaagataacaaatacctaaaaatgcagaagcagctctggaactgggtaataagtagaagccagaaaagttttgaagtgtatgctagacacagcctacgttgccatgaatagacctttgaaggtgattctagtgaggggagggctcagaaaaaaaaagagaagagctgtacagaaagcctcaatcatcttagggaaaatctatgcaattttgaacagaatgacactagaaatatggacaggaagctccatttttatgagctgtcagaggcaaatgagaaatatgccattgcacaatgaaagaaaggtgatctttgctacaaagtggcaaagaacttggctgaactgtgttcatgttttagtaatttgtggaaggcagatcgtgtgagtgataaaagtagatttagctgaagctatttctaagaaaagtgttgaaggaatggcttggttcctcctgactgcttaaagtaaaatttgagaagaaaaagatgtattagcagcccgaacagaccaaaacatctccttccctctaagtaacatcttcaaaacaacaaggtaggagaatttcatcttaaggctaacacaactaactgttcttaatactcaaatcctgggattactagaaaggttcagaggaaccacactaattccccaatgactggtccttggaaaagtttaaaagccacttgcatgtcgattatcaattctgctcactaaacaaacagaaaggagaccagaacattcaactttgcagagatgttctcttcactaatttttaactattgaagcctaagcctaatttgtaaagttctgctcaaatgcaagagtttccatgaaacattctcaaattatcgtttctctccttctataaaaaacccaagcatttgctctttcctgcttcggaatatatttacttttattactcttagtactttattgtacattcattataatatggtctatttcttgatgcccctgtatgggaaaacaatgcaaagtgtatgagagttaagagaaaggatgtaaaattcaaagacgacttcaggcagttcagtgtatttaagttaggtcttgaggaaggtgtaaagactggagccagtcaggggtgggttataaatgttcagggaagactatcaacaggatgaaacagtgcactcactcccgaataatttgctgggtatgcaaaaataaatgagaagaattctcctcctaagataaattctccatttagatggctagtagtacatttgactgaggaaagtgtctgacatagataattaaaatacaatgcaaggagacaaaaataatagtaaatatactatgtgaatacagtggtatttattctattcataagtattctaaaaaaagattacaactaaaataagaactagccgacacagaaagaatgacaggaaaaaaatgcaagtaaagttaaatttgaaaattaatgccctcaaagcataatgcaatcttgttattgctttttattttattttactcacttgttttctgaaacatggtctcactctgtcacccaggctgaactgcagtggcatgatcatagctcagcgtatctttgaactcctggactccagcaatcctcccaacttagcctctcgagcagctgtgactataggcacatgccaccatgactggctaattttttcactttttgtagagacagggtggggagggagggcttgctatgtggtccaagctagtcttgaactcctggcctcaaatgatcctcctgccttggcctccaaaagtactgggattacaggcatatgccaccacctggcccatgctttttatcttaaatgtgtatcgtttctagtcagatacaagagatagctcctatagctttactaatgctatgcaacttcaaaaagaagagaacctcttctagataaggttttcatcataatagttaaaatgtataaaatatgagctttccctccttatctatatgaaatcatctaatatacatagaacacggaacaggcataaagaaatgatacgcaactgtcttaggtggatcgtggggtagtgaatatacatgctaagtttaaagaaaagctgggcattcagagaacaccctattaaattgaatggcttatcaaaagcagaaagagcaccaaaacctgtcatacacacacaatgagcatctagagtagtttgacacacctggtgattaacagtcataatcaggcaagcacatgcaagcatcaaacgtttcatctgcacatccacctggtcttatttggagttactctaaaggccccacatgagacaagaagtcgggtgcaggtaaattacttggaaggtgggatagtcaataaatggaccatgcacaagtgtgtaaccaatgtggccaagttgggctccattcttcttgaaaaccttggaggcactctatagaatgtgcacatcttcgaggcactctatagaatgtgcacgcttcagttatgcctacacatggcatggtcctcagtagcttcagagaaagcacttctaagagagactgtcaagacacatttattccaagaggaatgctgatgaaatgatggtggaatgcagtgtttggaactgtccgctgtgcaggttctgaaaccagagaacccaggagataaggacagaccaccattcttcccagccacactccttatgtgataggcatattctcattggataagagataaaatagaagctggaactagctaagccactgacacaaggtgacacttttattaaatgagaaaacctcatttcaaagtaaatgttctacaacttcatgtaacactgacctcactgggcaacatatatataagtggttggatatgttcaacttgaatgagaggaaagtttctttatgtgttgcccaaaccccataaaaaatccaagaagcagatcttggtaactttatcactagactgcaactttaacatcattttcatttagtagaaaatgaatgtctcattgacgttccaccttcagggaaacatgtcacagtataaagagaaacaagtcacacatcggggtccttgcaaatggtattgatcattgatcaacttctccatagaaacagataagatatggctttgaaattttctttacagtcattaaaaaccatagcatgtgttcattggagctcctgaaaaggtagaacatgacatatactttatttatgcttcattgcagtgagagcaatattaaagataatatcctctcacaaaatagtacagacagtttggcaaagtacagtaacagactatgagtatgaatatgatgttgagtcatgtgtaaacttagcttaaatattaataaacacttagtaaattcatcactttgatttcttactcatatggcttaacttttcaagttgtactttgctgtttttttacaaagctcttctgttcctgtgtctcacaggacatgagaattcacagagtgtgatttgtattacatagtctgtaaatattatgctaagcgcatatgtagaatagtcaatgactactgtaaactgaacaatgaaaagtagtgttttacctcgtaccactttgcctgttattattagtaagtatacttaaaactgaaaaaatacagacacatgttatatgctttaatatcgtatttaaatatcctccccaaagatgcttttctgtgtttaatcttgagggagatacaagcattgcaactacacataaaatgtttactgtagtttcattgacttgagtagaagataggtcattttgtaaaatgtcaaggcttcactgcatttccagaatgcaaatgaaaatcatttgggaaattggctttaacacaaactggatgtcaggaaagattgttttgaaacttgattacttaaaacttggaagaggaaatacagctttgtaaccaaacctacaccagatagtagatgacaactctgtaagatcatttccatttctactatttctataaaattcagcatcaatgtacatttttcaccattaccctaaatacagtaggtggggtgggagcaaatgcaataaagatccttatcaggctggggataaatttggtctgttgtctgagaaaaagctagcaaagcctgtagttgacagaatgaggccattttatcatggggggaagagattagattctactgatgcaggcattggatgcaatgtaggtctcacatttactcctttcttgtgcctctatccatgacaaaatactaatgttcacaccaaaatttactgaggactcatttttaaatatttcaaaaatgatggtcagcgcaactccctttaaatttttattgcacagtttatttttatgttattttattggaatcaaccatctaggaactagaacatgctttggataggagccctaggtaggggcaatataggagaaaggtgtctcttttctctctgtcttggccctgtctgatttttcctgctggttctgtagcagcacatgagagacctcttataaaatcctgagaccacaaagctaaggaaggtggaaggaatttagttagaagctgagtcattccactacctttctgcttctgtgcatgaacctttgctgtcacattgtcttgcactggggagaaggaaactggtagctgggaaaatgcttctagtcaaaggttatttttttaatttgcatcagcagtgccatgccgggatgatgtgcacgggagagaagtatggacacagactggctccctttcctttaagcctcaagaatatgcacaaagaaaagcacatgaaggacacacaggaaaggttacttcctgtaatatttacaatgctggtcctgtgataccaagcccctgcatcctttctgctcaccctgcaggtagtgtgcagtccctcccccatcatggactataaaccttcttctctttatcatttgagctcctaggggtcctcaaatttagagtcttgaaaactgatttctaacctgggttggatgtcaaggaacatttcatcccatgcttacctgcagattgcagaaatccatttatagattttcctccacatcagactatgtgctgactccttgagagcagaagccacaagctaagcggctgatcaatacttctacttttttcaatgaagtaacaaatacttcatactgaaaggaaactggagaaatccgtaatgcaatatttttattacaactctcagctcccttttcgatggttcgttcttctctaaaaggaatgtgaatgagaattgacactcttaatgggtggtggggaagaaaatgagcagagtggaaaatggaaccttcttcccacttcctccattaaagggcatgctgtggatgtggctttgtgtattttcaatttgcctgtgtgttctggtacttttctcactttgttgctaccaattggatctagtatggctgtctttgattgtaagtacccctctctctctctctctctctgtgtgtgtgtgtgtgtgtgtgtgtgtgtgtgtgtgtgtgtgtgtgtgtgttggggtgctatctactaataatgtatcaatgtgtttgaaaagaaaatcaactctcatgaattaattaatgtgtgtgaggaatcatggtggtccctaaacagtttataaaatcttagtaccaatcatccacgaaagagcagttagttattttaaacaaatgtgcatttttaatgacatagtttttctggaccattcaccgtccagtgcttgagtcttgacttaacagaattgccccgatggagctgttgcagggaggactttcaccagttcaacactccagacttactcaaactcctgtggattgctgtgttcaatgtctcccccacctatttcttccataattagcttggtccttgtggtcaattcaacactgacatttagtgatttcacatgattacaatgattcagaaaaaaactattttcaattcctttccagataacaatgattaaagtctggaagaagcttagtcttctaccagtctcaacttccttacaccttacacaaaaattaattcaaaatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaatctactcatctgacaaagggctaacatccagaatctacaattaactccaacaaatttccaagaaaaaacaaaacaaccccatcaaaaagtgggcaaaggatatgaacagacacttctcaaaagaagacatttatgcagccaaaagacacatgaaaaaatgctcatcatcactggccaccagagaaatgcaaatcaaaaccacaatgagataccatgtcacaccagttagaatggcaatcattaaaaagtcaggaaacaacgggtgctggagaggatgtggagaaataggaatgcttttacactgttggcgggactgtaaactagttcaaccattgtggaagtcagtgtggcgatttctcagggatctagaactagaaataccatttgacccagccatcccactactgatcatatacccaaaggattataaatcatgctgctataaagacacatgcacacgtatgtttattgcgtcactattcgtaatagcaaagacttggaaccaacccaaatgtccaacaatgatagactggattaagaaaatgtggcacatatacaccatggaatactatgcagccataaaaatgatgagttcgtgtcctttgtagggacatggatgaagctggaaaccatcattctcagcaaactatcacaaggaaaaacaaccaaacaccgcatgttctcactcataggtgggaattgaacagtgagaacacatggacacaggaatgggaacatcacacaccggggcctgttgtggggtggggggaggggggagggatagcatttggagatatacctaatgttaattgacgagttactgggtgcagcacaccaaaatggcacatgtatacatatgtaactaacctgcacattgtgcacatgtaccctaaaacataaaagtataataaaaaataaataaataaatacaatagtaataatgatttaaaaaaaaggagataacctaatgtaaatgacgagttaatgggtgcagcacaccaacatggcacatgtatacatatgtaacaaacctgcacgttgtgcacatgtaccctagaacttaaagtataataataaaagaaaaagaaaaaaaaaggaatttattccctgcaggactctaagcattttccatgagaaccagtgacatgttcattcctagctttctgcaaggcctttgacttagaattcctcatttagcatctttctaggctgccattaccaatctgaatttttcctctgaagcaatttttaaaatcatatctcctctctgaaacattttttcttctctggatctaaactgttggaatggggatatactttcatccctacctcaagaaattcattcttcttactctccaactttaggtaacatgaataacatagttatatctaataatgtgggtgtctcttgcctacccatgtgcttttattgtcaactggtaagctcttagaaggtagggccataccttaactcagttaaattcaacctgatacagtgttgtaccaatcaattgatactatattcatcaactgatactatactgtataattcaatgtagttgccaataattagactaatgatgacagggaattggtacattaaaggcctggacttttaaaatctcagaatggcagggaatcacagacttaattcaatccaacttctcttataatatggaaatcatctctgcatgtcttgactactctcggtatagatactgtttaaactccttcagtaacagagaatccgctgttccctgaggaacctcacccaatagccatagagctcaattattaggaataatatgactagaaataataaatagatataactaataattattggaaatacattttctattttcagaaataattgtaagaacccatttgtcagaccagagtttctcaggaaaggaatgtcacccatgttcaggtgaataataagcatgttgaacaatgacatttcaccctacattaccctccctgggtaccagtcccaggagagttctctaactcagatcccatctgtgcctaactccatgcttggcagactggctactaaatttcaagcctgtgtttctggagcccaggaagatcatgatgaattctgtccactgagtctcagtgaaagccacaatgatgcatttgcaatacttttcccttcttattcacaccagctccaagaaaccttcagtcatcagtgtgaatcatcaccccttctctgagtttgaaacagctcctaatagaaggatcaagtcacaactgatcccaagacaattcaaggtaattttcacttcagagaaatgccttcaaatggtagatgttcattcaccacttttgtcttatcagtaacaatttcctcaacaatactttcctttttgcaaggagatgacacatttctttaatgaatttcttctctactgctcaaatcctcatttggacatgcactgcacaataacacacataatggacttggggaaaatgatactagacaaaactgggttttatatgcagccttcctgttaggcaaccacggtatgttctgttctggataagagggacaacagtattaaatgagtcataacgtgttttcctgaaagcaaagagcatcctagtgcatagaaaaagtgaaggatgacaatatttcaagacagaaactttaatttttaaaaaatgatttccctacctccagacatgggcttatccttaaagataatgaattgatttgtgctgcgagagcaacttttaagtaatggtaatctagtgtagtgcattttctcaataaagaatatctaacgaaaggggaaagtgtttaatatgcagaaataatgtaaacgtaacatacatacacacacatgtgcacacacaggcacacacacatatgtatatgtgtgtgtgcatgtatgtatgcatgcatgcatgtgtgtttgtgtgtgcatgtgtgtgggtgtgtgtgcattccccatcatctcatcctatttacttcattcactctaaagtattcaggtttaagacataccaatgcaaactaccaaactatgaataaataatttgcaatgtgtaccccatttattatactgatttaactaaggaaaactatgccccaaagcttctggttactccttgcctttccaaactatccctgttattttgcagtgactcatggaaacttgtattttgtggctaagttcttattgtaatccttctttcactaagaaacaatcaaaaacaaagttgtcactaaaagttctaaaaattgcctaccaaattccttacacatactcttttactaaacaaatgaatgaagcaaacttggcaaatgattataattaatacaaaatgaaaaagattcatacagaagttagtctattgcatctactgcatagtctatgaaaatgtgactacaagattcttgtcaattaccatgtctacacaaggtcaggcctgctggtttacaactataatcccaacactttgggaagacaaggtggggggcgggggcggggtgggggcggggatgtctcttgaagccaggagcttcaagagtgctgggattacaggcatgagacactgtgccttgcagatctaaatgtttttaagagtaactgttacaacccaaggtaacataatttttacttggttctatgtcaaatagaaatttatcagaaagccaactgttgcaacagctaacagatcaattatttttcagaatatataaaagtaattaagtttcaaatatatagattgcttttaataaaccaacaagagaaagttaaactgcattatgcaaaatgagcaacggatgtaattaacaggaaaaaaatacctaagtagatttttaaacagatgaacagcctaactcatacaaaagaaacaaactaaagattattattgttgttattagatagaccaggggtcagcaaactatgatccaggaagcaaacctggccaggacctccttttgtaaatacagatttattggaagagagccacaccactcatggacaaatcatctattgctgctctcacactgcaagggcagatttgagtagtcaggacagaaaccatgtggctcacatttactatctggtcctttacaggagtttcactgacctgagacagacaaaaatgacatgctttataacacactctgttggcaagaaagtggccaagatgcatttataggttatgcttggaagctaaattgtttagtcctctaaaactcaataacatctatatacatttaaaatagatatggaatcctacccccactcaaaggtgtgtgaagggctcatgcctgtaatcccagcactttgggaggccaaggcaggcagatcacaaggtcaggagatggagaccatcctggctaccacggcgaaaccccgtctctactaaaaatacaaaaaaattagccgggtgtggtggcgggcacctgtagtcccagctactcgggaggctgaggcaggggaatggcgtgaacccgggaggcggagcttgcagtgagccgagatcgtgccactgcactccagcctgggtgacatagctagactccctctcaaaaaagaaaaaaaaaggtgtgtgaaggaagtttcactgcactagggtttatggtagcaagtatttggaaacaatcttcgtgtccaaccatggcagtccaatcaatgaattatggtaggtccatatatgtgcctgtgacagaggcttcctgaagaatgaggtggatgtctatgtgtcaaaataggacaacctcaaagttatgttattaagtggaaaaagcaagatgtaaagaatgctctgttgcactggcatttccatggctgtttagtcacgtctctggaaggattctcaagccacaacaaagaaaggtggtcgctgaaacaactgaatgaaggggtggggaatggcatggtcaaatggtgtccctgtatgccttttgttatattggattttttaaaccacatgcacaattaactttcaaaacaaacaaaaacaaacgcttcactgaaatgaaacatcattcagtaccagatatttgcagcacatttgtagatgtaaacttgagaaatagcacattgaagaaaaacaagatggagtttcatccacagtcatggagttagaggactgaggagacactgcagttggggaggctcaagcgaaaggaagaggagaaaactctaaaccatgaatttaaagaggaaacacaaacaggagtgtccctttttccaaaagcatattgactgacataatgaaaaatttaacattcttctgcagaatagaatggatcaagcatttaaaagattaagtggagggcatgccaactcaaatttgccagaggagaaaaggaagagggcgtgaaacagatcacaaatgaatcaaaatcccttcaaataaaacacagacaataggagtcctccgttacccacgggggacacgtaccaagacctgtagtggttacctgaaaacacagatagtactgaaccttatatgtgctgtgcattttcttatacatagatgcctatgataaagcttaatttatcaattagtcacaggaaattaacaataatagctaataatacaatagaagaattataacactatgccagcatcactactcttgcactttggggccattgttaactgaaataagggttacttgagaacaaacactgcagtaccatgacagatgatctggtcactgagcagactactaagtgactaagggtcaggcagtctctacagcatgaaaatgccagacagagggaggattcacctcttgggcaggatggattgggagggagcaggactgctggagacttcatcatgctactcacaaccaagggcaatgtaaaactgatgcattgtttatttctggaattttctgcagaccatggttgaccgtagataactgaaactgcagaaagtataactgaggacaaacgagtagtactaatgaattctgtcatcttttgtagaatcgaagttatgcacttgtttaggaagtcatcatgtagaccaacctggccaacatggtaaaaccctgtctctactaaaagtacaaaaattagctgggcgtggtgacatgtacctgtaatcctagcactttgggaggcagaggtgggtggatcacttgagtttaggagtttgagagcaggctggccaacttggtgaaacctcatctctactaaaaatacaaaaaaattagccaggcatagtggtgggtgcctgtaatcccagctactcaggaggctgaggcaggagaattgcttgaacccgggagatggaggttgcagtgagctgagatggcgccactgcactccagcctgggcgacaaagcaagactccgtttcaaaaaaaaaaaaaaaaagcagtttaaaaaataagcactttgtattaatatattagaaatctacaggtctgttttgtactttttatactgttggatacttataataaaaacttttactagggtactgaataaacctagtcttattagaaaattaaaaaaataaaataaaaaaataaattgcttgacaagagataatgttggttatatgtcaaaaagaaaaagcctgatattttctataccttagctgagtcttcaatttaattttttaaatattaagatgagacaccaaaggaagaaaaagtagtctcctacctgaaggctccatctctcttttcttctcctaccttccccaccttttccttttgccaccaattcacaaagcagattccagtctccttattgagcctacaactgaaatgtttcttttgggaaaatatcttggcaaaagaaaggactggcagttaaactccagtcaacacaaagcagcatctattaataatcatctgatttcaaagtatgggcatcttctgttttagctatcttctctgactttaataatcacaatattttcaacaaacacacattctaatttttttggatgttccttgtttaaattgcaaatgcatgcaactaccttttggcaaagagaaacggactatgttcttcctagtgaacaaaggtcaccaaatcagactagaaggctgaaatttccagaaggctagggaagggaatcttccagcaaaatgaataaacagaagaaaaatatagaaaggttatggctcttgcttctaaagatcatgcttctcattctgtgaaaatatatgtcagagaaacctcattcagtgactaatgaaacttcttgctgcaaatatccctctctcccgctgtgaaatcacttaactcatttttcaagtgggagtaatctgctctgaagactcttacccttttgttaatgtgtctttctgctctagtgttggtctcaaaaaatgaaaataaatgcaccgcttttacagctgataggcatattttctatccctcgaaagttgaacagagcacctccaatctcaacacactttattttatgtttttcgagatttgtacatcagtgtgtttacactacaattaagcctccgttatctgttcagaaagatgtttttaaaaatagtagaatctgtccatgccccttgaccagcagtttacagagacaagccctatggcagaatgttcacattgtgcgtacttctcatgatgataattgagagatgaccaactcagtgtcacttctgaatttttcccacttgctcgtggtattaactaaatacaaatgcagtcaacagcactgcctcatatctttctcatgagcatgaggaatattggtaaaggaattttaaaacagatctacccttttttaaatcaataattggtctcacatactggagcattaaattcatgtaaggaagctgaactaaagagatacacgtttagaagtttgttgtaacagtttgaaatccttgaaggataaaaacatggtcaaagtaggtgattatcaggtatctctcatagaatacattctttttttcagttcaagagcatttagcttatttacttatttttattttttagagaccaggtcttgctctgtcgcctaggctggagtgcagtggaaccatcaatagctagctcactggagcctcaaacacctgggctcaagtgatcctattgcctcagtctcctgagtagcttggactacaggcacatatcaccatgcctggctaatttttcattttttttttagagatggggtctcactatgttacccagactggcctcaaattcccaggctcatgggatcctcctgccttggccttcccaaatgccaggattacaggcatgagccactgtgtccagccacttattattaattattattattattattaatctgtaacaatgatttttttcttattcattttaattggcaaaaacggtatatatttatatactggtatctggtgggtgtgaactggggatgctattcaataccttaaaatgcacaggacaaccccaacaaagcatagatttatgcagcaaatatcagtagtgctgaggctaccaaacctgactataaattaggtagatgtggctcaaaaactgaaagatgagcacggtcttctcctcactgcataaaatgatttgcttcaaccctcagtcttttccatgacattcaacagaaggactgtgttggacacaaggaggtcctccagcagatggttcagtgtaccatgcatattgctaacactggtttaaagtcagtcttgttccctgagcaggtgctccgagaaagaaccctctctttgaagacccatctctaggaaaacggctggtgcattgctcttgcaggaagctcatgctttcaacatgtctgtggacaggattggacggaattggatggaattggatgggatgtatgcacagctcataaatgggtcctcaataactacatgcctgattgaaaaagaatcatgttcagagacataggatgcaagttaaaaaaatcaatttaattgacacttcattttttccccaagaatattctagagagtggaaattttataactaaagctgcttccaactggaattaaaaagacaggcgtctctttttttctttctttctttctttctttctttctttctttctttctttctttctttctttctttctttctttctttcccttccttctctttctttctctttcttctctcttttctttcttctatctctctcttcctttcctttcctttatcagctctttaaaaataatctaaatcacacaaactagtggaaaataacgtgacaacagatcagacatactgaaggctcttgtctaatttacatgtctgagatgccataaggcagaattagtaggcaaaacagactttgcacaaaatcctatcaaacattatttttatctgataaaatactagttccccattgttgttaaagggaaaaatgagcataaggaaacagtgaggtctcacagtggctgagagtaattattaacttttttaaaatagggtagtgggtttctgaagttatagttgtaaaagtataaactgtacataaagtatacagtataataaatgttgacttatgtatacagttatgaagccatcaccacagtcaaggtgacagaaatatcaatcacacatagcagggcgtggtggcatgcacctgtagtcccagctactggggaggctgaggcaggagaactgcttgaacccaggaggtggaggttgtagtgagccgaggttgtgccactgcacttcaccctgggtgatagagtgagactctgtttaaaatatacatatatgtgtattttatacacatatacacacacacatatatatacatgtacatatatatatatcacaccccaaagtttacccatatccctttataatctatatctcttgctcctcctcctcatctcaggcaaacagttatctgcttacagacaggcattatgaattacagcttccaaaatattaaaagcgaagtaacagaattacggtctcttcattgcttggcctcttaggcttggcataatcattttaatattcatgcaggttgtagcatgcaccaacagttcattcatttttactgctcagaagcattccagcctatgaatacattcaggttcttggtcttggtatggacatatgctcctctttttcttgtgtaaatacctaggagttaaatggctgaaccacatggtacttgtaggtttaacaacaaaaaaattgccaaactcttctcaaaagtcctggtttcatatcacttccccaccagcagcttggggtggactctagctcctccaaatcctcaccaagccctggcatagcgagtcttgtggcttcagccattctcagatgtgtagtggtatttcactgtggtttcatttgtgcatttatccaatgactaatgatgctgagcacattttcattgggctattggtcatatgtatgttttcctaggtgaactgcctgttcaattttctgtccaattgttatggggtggtttctttttaattctccttttagaatatatatatgtgtgtatatatacacacatacatatatatgtgtatatatacacacatacatatatatgtgtatatatacacacatacatatatatgtgtatatatacacacatatacacacatctatacacacacaggggtaaattatatactatattgacaatatatatgatacagtatactatatatactatactgtatacaatttagtatactacatgtgctatatatataaaaaacacagtattttaaatatttattttatttaaataggcttttacattttcatagttcacattctgtaatttttagtaatagtgatactcagtatatcatatatatacatatgtgtagtatactgtatggtaaatatatgatatattttatatatagtatacaatactgtatcatatatactatatatgaatattgtatatatagtatataattgtaccagtacgtgtctatacatatatgtctaataccatatatactatatatttataggaaactgcatcatatatatgtatgtatgcatacatttatactggtacaataccttcatccgatatttaatttgcctatcttacctcccagtttgtgaattctctttacattcccttagcaatgtctttcatgtagcataagcatttttttaagttttgatgtagtccaatgtattaattggttcctttaaaaatcaagcttcttgttttaagtaagaaatatttgccaaaatctaaagtcacaaaatttttcttttttttttttttctcctggaagttttacaattttaagctttacatctaggtatttgactcacttttcagttgttttttgtacaaattgtgagttatagatcaaagctttttgtttactttttcttttcttttgtatatggatacttaatgtttccaacaccatttcttgaaaaaaaaatcattcctgcatagaattacctttgaatctccttggaaaattcattgtccatatatgtacagttctatgtggtgtctctagtctatgatattgatcaggttttacatctttatgtcaataatacgctgtttcaattaatatagctctatactaagtcttgagctcaggtagcaggagccctccaagtatgttctactgctacaaaaatgttttggttattgtagatcttttgtattttcattaaaattttaaatttatcttgttaatttatgtattttctaaaagtctactgttattttatttgggattgcaaagagtctgtagattaatttgtacaaaataaatatcttaacaatattgtatcttctcaggagggtgttgtgtttgtgaacacagtctgtctcccagttgcttaagccttcatcagtgtccctcagtgacagagtatagttttcagtgcatagactttgtcagatttactactctatagttgatatatgcatcaaccaaagtacgtttgtgacggattggaaataaataaataaaaatagcaaaagacctaattatccatgacagaccaatgaaaagtgtcatgctttgagatttccttgagaaatctaaacattctgaaacttttccatttctacaatatttattaacattctgattacatcttagtttgctcttcagtttttcaatggaaatttgataaagtttaattcccacttcaccaagatacaggcatacagagtatacatagtatacaggatttatgattgtgtacaagaaattggtgtgtttcatgtctaccaaattcaaattaattactagtaaagcctactagataatgagattttttaaaagtagacttgcattaagatctactcaactaaattttgaaaacattccagagtcaaatattaaaaataataaatataaaagcctaatttgcattaacagaaaatatatatttttgagtacaccaagaaattttaattttgtcttaaaatctaccattattctttcctaatgtgtctagattttaaaggtaaattcactgctctaagactgattgatagataaataatcacaagggtattatttactgaataattatagtatacaaagaagtttgctaggccaattacatacattgtgtcttatttatttctcccagtaactctccaaggtagctagcgttattgctatgttgtagattgattgcagacatactaatcaacagctggcactaaatccatcatcaatctttaagttgatgaccttacataacctcatgcatatataaacaggagcattttcattaaaaaaattaaatccctaaatttgaaacaaaacagtggctttagtaatttgtatttaaaacactcatgtttatttctaaaatggcttttaatcatgcattttcaaagatcaaacactctcaaaaacaccaaaatagccaaacatacatttcccaaggaacactcaaatattgattgaaaagtgtaaagaaacttgcgaataaacaagagtatgactcagtgcttcagagagaaatgttaatgaaaatatcttttcaaccacaatgctaccagtaacataaatcctaattaaacccaagttgcataggctgtggtgtcaggtgatgattaactgtctgaaatttctttgaagtttgagttgttaggaatgagattgctgatttaatttattttaatgcctgtgaaataaagtcacaattctttgaactctgaactgctcttaagagaatacagtgctaataaaatatttgcattatctttataaactcatgttccacctactcatttctgtaatatattagaataaatcagaagcctacatctagcagtaacagagtagattattcaaaccaaccttcttattgaaaatggattgtaatatgtgtgatttttttaagtctcttaaaaacattttagtgctaaaatcatatttaagattacagcttcaaaactgattatcacagcctgggcaacatggtgaaaccttgtctctacaaaaaattttttaaaaagtggccaggcgtagtggcacacacccgtggtcccagctactggggagggtgaggtgggaggaagtcttcagcccaggagttcgaggctgcagtgaaccctgttcgtgccactgcactccagcctggatgacacagtaagaccctgtctcaaaacacaatacaaacaaacaaaaaacaaagaaacaaacaaaaacacactgacgaccaaatgatgatccagctagatgcccagcacacaaagcagcctttgccctagtgcactgttccaatctggaagaaactgtgggagttcttgcagcatcaccatgtaatggggcaactctcagaccctagtcacgcctgaaggtcccaatctaatatacttgcctttaacattttcctaccttcatgggtttcaccctcaaggcaaacatgaaacaaaactaaattcagtcttgcaagtgcttgcagtctaccttcataacatctatgaacaattcagggaagagcatggccccatggatgaaagaacctagaatttcgctacccatgggttatctgctttggagaaagatgccactaatccatttgcaaatacaatggccaattcacaatgattaccaagcccatgaagaaagaaacaagaagtcaccaacaagagccagcagaaatcccaaaggaattaagatgccatgaaaatatatacatgataaccaattttttgaagaatgttcaaaaagcttgaaaacaaaaagttggaaaacatctgcagggaataagaaagtattaaaaatgaaaaaataaaaatcaaatcaaacttctagatcagagaaataaacaaaatgagaaaatgaatgggtccacctaagggcagattaaacaaagctgaagagaaaaatggacaaacttgagaagaggtgagaagaaacgatccagagagtatcgtggaaatctgaaaaaagctgggaaaccgggtgcagtggcccacacctgtaatcccaactattcaaaagactgagttagaaggattgcttgaggccaggaattagagaacagcctgggcaacaaagcaagacctagtctctaaaaaaattttaaagtataaaatagtagctaggcatggtggcatgtgactgtagtcccagctactcaggaggctgaggcaggagaatcacatgagcccaagagatcgaagctacagtgagctatgattgtgccactgggcacagagcacaacctctccagcctgggcaacacagggagctgtcatatacaaaaaatataaaatagagagttagaaataaggaaaacaatatgagaatatctaatatatgcataattataatacttagaccatgaagatattagtcaatgaaaccaaaaagcaaaaaagagaaagaaacaaaagggtgattgaaaaaaatagaaatacaaaatgcagactttaaaataactaggaagaatgcattccagaaaatataaaattgagaacttcgaaaatgtggaaactataagaagaaactaaaattaatccttgaaatgtaatgaaaatatatatcaaacataaagatttgatgcattggtttaaccatgcattagatacagtagaaaagagaattaatgaaatagattataggtcttgagaaaaagtaatccagaatgaagcttgaaagtaaaatttaatacaaaatacaaaaaaaaaaagactaaaaaaggagccagagggagaaaatctaaattatgtgcaaacagagtgaaaacaagagaaacagcaccaaaatttgaagaggtaatgactattttcagaatggaagaaaccacgattgcaaatttcaaggtcatcaaggaattccaatcagattaataaacccctaatggtatcacagtgaaacggcagaaactcaaagaaaaactatcttaaaggtatcagggggatatagacaaactatctgcagaaaatatattatttttaaaggagcaacacttaaactgacagctaaattctccataccaataatggaatccagagaataggagaatgatttctcagatggctgaaagaagtaattgcaaattaaaattcaatgagaatattgttcaagaagaggatgtcataaagacacatttagccatgcaaacagagtttccaacagcttgttagctctgaaaatatattttagatcaccgatagattcttttaagacaataatcacagataaaagtaggaggtacaaaaagtaatgaaacataaataaaatagtgtaatcatcagaaaatcaaaattaatattgaaataataagataagcaatcatatctgaaaaagattcctaaaaaacacaaaacattgaaaggtactaacagcaagtaggttaggtcataaacatggagctaaaatacactgactactgggtattttcagagaagtggaaaatgtattaattaaaattagtgattatattaaggatctgtgttgtaatttctagggttatttactaaaactagtacagtcttttaacatctagtgtagagggagaagtgggagtgaaggaaatggagtaatgttatttgtcttttatttctttattttctgagacaggatcttgttctgtcatccaggttgcagtgcagtggtgccatcataggtcactgcagccttgaactcatgggatcagactctcctgtcaactcttatctctggagtacctaggactacaggtgcacaccaccacacctggctaatttattttttttatttatttatttttttttatgtttcatagagatgaggtcttgctatgttcctcaggctggtcttgaactcctggaggattctaaagtgatcctcctgccttggtctcccaaagtgctaggattacaggtgtgagccactgtgcctggcctgaatgattttttaaaaagcaattcaagcaagatgtagaagtgggatattagtagcacaatttaggatagaagacttaaacacaaatatatcaaaaataaaagtaaatatcagtggatctgcggttgaaaatcaaagattatgagacccaaatagacgctatgtagaaaagactcaaaacctgagtcaacagaaaggcctgaagtaaacacatgggaactatacacaattggattactaacaaaacaaaggtaatgttaacgtcaaactaaacagacattaaggcatgaagcaccacagacttacagaggatcactttataatgagaagaaccttaatttgccacaatgcaataaaaattctagactgtatccactaaaattcataagcatataaaatgcaagaaactaaattttggaaaaatatacgaaaagattttaaaacatccataaacatcgtgggaaaatttaatagacctattttagttactgaaagaatatgtaaactaccacctggaaaactatatagagtatgtgaacaacatacttcaacagtttgagatattagacatatagcacattgcaccaaccatcgcaaaataaacacttttctcagggatgcaatgcatattggcaagaaataaacaaagtataaaaatataaattgcggattattataaaatcatgaagataaaaatgtgatgattggcacagaggtagacaaagagatcacttgaactttagtgacatggatcaaactgtttaaaataaattgtattgtgatattctaaggaaaaataaactagacctcttacagaatgcaataaatatattccctgtgtggtttcaatatgaaagataaaatattaagcttttttcagataaaataaaaggaaatcttcatatctcttggtaggaaaagatatcctaaacaaaaattccaaagcactaatctgaaagaaaatattgtaaagtctataaactaacattaagaactttagcttatttaaataaatcattaaaaacatggaaggaaaatcagaagatatttgcaacatatataatcagtgaagcactctaatcgaaatacagcaataagacacacaacccagtagaaaaacagatcaaaaacagacgcttcaccaaacaggacatatgaatggccaagagatatatggaaatgtctcaacctcagagtaaacacagtgaacacacaatgggtttccatgtacacacgctagatcagaaaaataaaatagaacttttatactgccacatgttgaagattgcacactcctggtgaaaacaggcatttctgtactggaaaacagttcatccttatataaactatacagttgaagatttgaaccagcaattccataatggtatatgtctcagaaaaccaatgcttgtgagaaaggagggtgcctgaaaaagaatgttaataacacgaatttataataacctcaaactcaaaataataaccatatctattaggaataaaatggacatagggactgtggtatgttcagactttagaacactatacaacaattaaaatgagtggaatggatgtatacacagcaacacatatgaaatttataaaacagtattatgcatgaaaaaaacacaccagaaagtaatagaaagttgcattcatttagagtctccaaacaagcaaaatttaattatgtgattcagggatgcctttatcattgggaaaatataaagaaaagcatggaaatgagtagtaaaagggaataatggttatcacggaggaggataaggagatagaatgggaaaagagcatgcactgctttgaagatggaaactatatttcttcacatgggtgttggttatagaaacacttgccttaagctttcacattgcatggagcattgataatataagataacagaacacacagaactttggtttctgtgtgttacacttcaaatggattattttttttaatcagtgtaaatctaagttcagcataaatgttgaccagttaacctcatgcatctattatattgtttcatatggccctattatttgtggtttctaatggttgtctttatattgtccatcttgaaaataccattagaaaccatgaacacatcaccagagagtgattcatgctaatgagaaaaacatgctgcagaatttctgttttccacttcctgttaatttaaaaggtattgaggctgggcaccgtggctcacgcctgttctcccagcactctgggaggctgagatgggaggactgcttcaggccaggagtttgagacccacctgggcaacatagtaagactctgtctcagtgaatttatttaaaaaaattagcttggtatggtggtgcctagttgtagtcctagctactcaggaggctgaggcaggaggatcacttgagcccaggagttggaggctgcggtgagccatggtcacaacgctgcactccagcctgcaatagagttacaccctgtctgcttttttaaaaaggaggggtactgcaaaagccttatccaatctcccagccccttctgcaacttctcaatggacacacttccgtacagtagcagcagctgatgaatagtcgtgaattcacttattcctagatgtgaaactccaataggaactgagccattgatccgtccatcacaggcccatcctcaggtctatagcattgtctgaggcttaacactacagttattctttctgattgcacattggcgtgtgcaataatttattaggaccctctaagtgtctacaccaattgctactgtactgcaatttacctatttatctagccacatgaaatattcagttagttgtatggaaaccacattataaaacctttaattattcaaagacattggcgggtgggaatgttctaattcagtagaaaccagattacctagaatttaacatgaagcaagtaccttcattggttattagggaaggcagaactggcaaaaaatgacatgggaggtacatgggaaagttagaaaacattccactaaacagactttaaaaggtgagactatatgatgggcattctaaaaatacatagaagacaacacctggctgcacaggaatgacatccttcatggcaagtccatttggaaaggcatatgcctggcatttagctcaatgcattttgattttcttttcaatgtgccttaaggtttagttgaggctgggcgcattggctcccgcctgtaatcccagcactttgggaggccaaggcgggcagaacacttgaagccaagagttcgagaccagcctggctaacatggtgaaactccgtccctactaaaaaaaatacaaaaatcagctgggcgtggtggcacgtgcctgtatttctggctacttgggaggttgaggcaggagaatcgcttgaacctgtgaggtggaggttatagtgagccgtgatcatgccactgcactccagcttgggcgacagagcgagactctgtctcaaaaaaataaaaaaaataaaaaaaataaaaaaaaaaataaaaaagagttagttgaaacaagctcacctttatttatagctgttccttgtctttgaattaaaattgtgttatacaatgtggtcactgaccttactcaacagaaccctggctgtatccaaatataaatgcctccttaaggattaagacttgcctcagcaagatattaaaaataaattactatgggctctgaaacgttttaaagtgaggagaaataaagaagtttccagcagtcttaccttattgtaattagtgtactgcctctgaagtgactaatttgaatataataaagctcattttgggtatatgatttctgatatccttgctaaattatatcagcctaattacgtaacagtcagcacccatatacctttatcatttcactagttttacttcttaaagtgaagttgctcagaacactgctaggttaattttgattttcatatgtaagaatacgcattgctaaacttttgctattgcaacttccatcttaatttcctaaagtccattgtgaagtcctttaatatatgagatatataagatatggtttttaataacactttaaaaattttcctattaggttacaacttgtatgtttttcatatctgtttagtttctcctctcaaaactggagtagctcctccttaccaggggcagtgagggatgctttccaagacccccattggatgcctcaagctgtggacagtaccaaactctatatatgcaatgttttttcctatacctgcatgcccatgataacgtttattttataaattaggcacagtaagagattaacaacaattaaaataaaatacaactgtaacaatatatactctaataaaacgttacgtgaatgtgatgtctctttctctctctcaaaatatcactgtactgtactaacctaaccatgggtaatggaaatcacagataacgggggttggttggggggattacatatctctgtctctattttcctctctctctctctctctctctctctctctctctctctgctatatctaaatccacccaaacaacaagcggcgaagacaaaataccagtgggcaataagaaggcttcaagaattttctgaatactaaaagcaactgaaaaacattataactgacataataatgttaaaaagaccaagaaagaaagagaacgtcaaggcactagatacagaagctcaagctggtcagaaggaaacagaaggattacaagagtaaatgagaacagaatcacgtgctgcagaaaaagtacgagcttgcagagattagcaaccaggttagctgcacagagacaccctgggcgggaggctgcaagatgccttttagagaaacccatggctctctgcaaaagcaaagacctgcatatcacgaatgctggtagtttatactaataatgaggtatgtatgaagaaagacaggcagaagaattatatataacaacaatacaagaatacacagcagccaaaatattcattttttcctttttcatgcattcactatttcacccatttattcctttattcaactaattttttttgtgtccctactacattccaaatactgatttagacagtggggataaagacaggctaccaagtgatcaagttggatgaaacagactaagggcaaatatacagtatgctaagtacgataggtggaggggaaggaggagagggttgagggaccctctaagtcagaaaagtacctgatactggatgcatgagaaataggcacacctctagccaggtaatacggccccacaggtactcagcttgcagagtgtatctagggctaaatttcagcctccattagtcccttagccttcagccttgcaccacgcaagctgtacaataataccagcacatgcgtgtgtgcatgcacaccttttattttgaattgcaagaaatgcaaccttatttggattgcagaatggtttccctatccctgaaacaacaagtctaagatggcttgcaacaaggacacacgcacaatagggcatttctgacatgagaagacatggcctagcatttgggggtgaaatatgtggccgccttctccctgtgagattcaaatgtttgaaggtggcattgagattctagggtagaaaaagtaagaaaaaatgaaaatatttcctttcctttttttttttcccccaaaggaacaatatccaatgagacattgttcttcttaggggattcctcctctcccttccccccacagcataatcaatgaaaacatagcagaaacctccctgtctaagcccagagaagtgagaggactgtggagaattttctttccacctctaattccatcctcatttctgaaaggggatgctgacttgcaaccccatggtgcctgcaggtgcagctgacaacgatgcttgcagtttccatgagccagtgtgttttctgctgagtgagatggaaataggacaggtgagggcctgacattctcttgcctagaaaatccacgaggaaataaggcccctttctcagcatgcagtgttcagaggaagacatgaagattacatccatcagtgctaataacagtaaacaagtgtgaatgatgccaacacttgatttaaacaccacataggcaggggacatctatcgtgggctggtaacaccaatgagttataattgaaatcagcagtaaagacaggataattgcatatccaatctgaagacagacttcttcctgtttgttttattttaccttcactttaatttcctcatagtgtcacaatctaattccatttaatgaagggggaaaagggaaggaaaagaaaaatttaatacatttctacgagtaggattatttgacaacagatgggctgcctcctgatagaaggagttttgtgtgtgaagaattctaatttaggccttttcctgccatgttagtttcatgctaaaagtttcaaagctaaaaaccaagtcatactgacagaataacactcctggagggtttactcttggtaaggcacccctcttaactccatttatacctataattttactatctttagagttggacctaatgaggaataaagacagaaacaaacaacaggtttagacacaaagagagattacataacttgtctaggatcacagacagatctagacgtgcccaaagtgggacttgtacaatgtcttactccatatgcattgctataacggaatacctgaagctgagcaatttataaagaaaagacggtccaggcatggtggctcacatctgtaatcccagcactttaggaggctgaagcaggaggaccgcttgaggtcaggagtttgagaccagcctgggaaactcagcaagactgtccctacaatttttttaattaactgggcatggaggcatgcacctgtagtcctagctactcgggaggttgaggtgggagggtggcttgagcctaggagtttgaggctgcagtgagctatgattgcaccactgtactccagtctaacagagcaagaccttgtctctaattagaaaaataaaaaagaaaagaaaagaggtttatttggctcacagttcttcggggtgtacaagaagcatggtaccagcatctgcttctggtgaggcctcagggagcttccacttatggtggaagaggaaggggagctgctgtgtgcgcagatcatatggtgagagaggaagcaagagagagaggagaggaaggtgccaggctctttttaacaacctgatctcctgagaaataatagagcaagaactcaggcatcacctggaagactgcaccaagtcattcatgagggatccggccaatgacccaaatgcctcccaccaagtcacacctccaacactggggatcagttttcaacgtgagatttggagaagacaaatatccaaactatatcataccctgtgagtatgtcttcaaagcctctgcttgtcttcaaagctgctttcagatagcaccttagggagcaccaataagtatccccatattctaaaccaaggtttttcaaccttaatactagtggcattatgaatgggataattccttgttctcgtgggctgtcctctgcattgcagtatattgagcaacatcttggacttatatccattagatgccagaagcatcaccaatctccagctgtaacaacccgaagtatgtacatgcatagtcaaatgtcccttggagaggaaaacttatacctcactgggggctaatggtttagctagaggaagcattttaaatatgagtaagaaaaaaacattaacttagagcagggtttattaatgtcagcatcaatgacatttggaatcagatcattgttatggatgagtgtcctacgaattgtaggatgttgaacagtaaccgtggtctccaccaactaagtgcattaacacccttcaaactcactctgacaactggaaatgtctccttacattgccaagcagggcacaactgcccatgactgagagccatggttctaaatcaagaagtgtgtctaccaaagcaaggcctagtaacagactgtggggctggccacaccatacttggcccatcagccttgttcaggccttatggggcacagcaaagacagtggtgaaggatgaagatgccggagggttggccctgtcagctacgatggtgatggagccaaatgtgaaccacatagaaagaagtgctctttggtcatctagaaagggactgtgccctggtctcacctctagagaacaggtgaggatcacagaagaggttcagctgaagtgatggagggaggaaagagattcaacccaagtcaaatgaactgcagtgggtggaacttgccacagaaaccctggaaatcatatatgcctccaaagtaaagttcaactgtgtacagctgctgctcccagaagacagtagcatcagactttaactctaccaccagccacgcaagaagttgccttttcctctcatggcccctctcctcttagtgaggaaagacgtcagcttcacactcctttctcactgaatggttgtcctgtctgtggctttcccaggaaaggaaagtgaaaaaaatttgtaatggaggagaaattgcaacagactgaactggatggttaagatccttgagtggccagaattcctatgctttatgcacgttagtcagccaagggtgaggataaagaaggctaccgattagattgagatgtaagaagcatttgctgcctatttgtgctttattgaatccagccagtatgtactttactagaacctcttagtgggtagacaggagatgggtaattacctaatgagacattttacaccaggcacttgctaagattgagggcttggattaaacaacttaggaggtctcttcttatgttatttttaactttcttttcaacataatggtctaaaggaatatgcatccctcaaaccaggggcaaaatggtgaaaattttggatatattctgtcttttgccatgaagaactacgctaccaacctacccactagagctagtagcatgcaaacaatttcatgtatctttcatttcttctctgagattcttagcagaaccacaaggaccataacgatatcgcttattgggaagagcctcttacttcctggtcaagccctatagaatgcagtgatccctaagggattggcagacaactgttacctgtttgcaggccacaactgtgatgcagaagttcggcagaaggatattcaatatggcagagggatattgaattcactatgttttgcaacccttgtggcctgcacatactcatacaactcatataacttgactaccttaatcctaaataagtgcttgaaggtgtatttacttacactgataagtagttagtaaatcaatgtcaaaacatataccttctttgatgttagtcttgcccaatattttggacattttaaaatacgtttgagaatacttttggcaatattttttattttgctttggttgctacaatctttgtaacagctcctctaatgaatgagtcaatacttttaataatccctctcaatgtagctatagttttgcaagaatttctccacctctcacttggttaactgaagcaaatgctctggttaagtatgcaaatcctatttaagagaaaggagtttcccatgaaggcactgtcctcttcttcccttggggagctttatacacaaaattgcctctgtgtgcgaagagcacaggaacagacagacagatgagtcagggagaagcgaagttgatggaagatgttggtatcaaaacagctagaacttgatttggagcattttggttatttctgacttattcctgacctatacagcaaagccagcaacgaagccatatgactaatgcattttgtaaacaagacactgagtcctgttacagatagctggagacatctgactggggccaggcaagatgttgaccaacatcaagacttgaccagattttaggaactgggagcacactgggctttacctaatggttcaatgtaggcttaagaaacagctgacacatgtactagtgctcaggcacaaagcacagatatgaattttagtagccatgacagacttctaaggagtccttctcaatgaggctctacttcaaagatgccatgtttgaggggccatcgagatggtgattcactgatataagggcaagggtcaggcagggtttagaatgaaaataaaagtaccctgttcttttaaccagcaagagaccctcagagttcactgacatctggatccagtgcccatcctcactctttcttttctgacattttgtatcccagtttatcactcaagagaaattcagtgagcacttactgtatacacgtacgtatccataagtgccattcatcagactgtgaataaatatgaaacctagagccctttgtcttacaattaaactttttttataagcccagaacacacatttctgtacaagatgacacatgaacagatacctaaaagtatcctcaaccaagtgaaaaataattagggcatcaaagccatccaaagatagctggatggtcacagtccctgaaaggattccctggaaagtcagatccagcttagtcattcaaagcagcgcctcccctgatgaaaagaagagatcacaatgcaatcagtcaagcttatctggggtccagagcctttgcagaatctcagcctgccagcctgtggctcaggtgtgcccatctagataagagtccgactttgatatgtgggatcacaactttcctctcatccttgcctttggggcgtttttctgtgctaccgagtttgattccactgatttttctccctgccggggtcacctagggactgcaagataacagaggcacagagcctccacttacacagagcaaaggaggctgtgggataatgaacagccagccccttgaagctctgtcagagggactcaaagactttcccatttaccggtgcagtttctgaggaatctgatgctgtgtgggcctgcccacagaaataacaatcctcacccttttcacctttttttttttttttgagacagagtcttgctctgtcacccaggctggagtacagtggcgtgatcttggctcactgcaacctctgcctcccgggttcaggagattctcctgcctcagcctcccaagtagctgggattacagggatgcgccaccatgcccagctaacttttgtacttttagtagagatggggtttcaccatgttggccaggccacttgtactccttccctcaagtgatccgccggcctcggcctcccaaagtgctgggattacaggcatgagccacttatgcccggtctatcctcatccttttttaaaaaactgaagtagaagtatggagaacatggctaattcttgcgtagataatcaataataccctcttaaataaaaatcatatttacaacaaaagcacgaaagaaaaaaattgtatgattagctaatgcggtcggaagttagtagttccatttgttgctcctatataaatcatgtggaacttaaaattcctctatttttagtttctgcttttttgggggtggggttggaggaggttagattaacaaatgcagacacactgtgatgattattcatatgtaatacaaatatgtatatatatctatatatataaattatatatagatacaaacatatatatgaagagttagtaatttttatgttttatacatacatttataaactcagaagagttacatatgttatatatattaatacctcatatgtattgatattctccaatgaatcaaagggattttaataaaggttgattggggaatgactttcaagacctataagcaaaataaaattttcaaaatatggttacaaattaaaaaaaaaacaataggtagtatatattacatgatctgtatttcatagttttaatatatatcacagatttacatttataatacaaaaatttataaattatacacatttaatatataaaattacatgtgtgtgtgtgtgtgtgtgtatatatatatacacatatatatatacacatatatatatatatatacacacgtatatatatatatatataatagcctttccatgtggcagggactcttactagcactgtttgtacagtaactcttttgatcctcaaaacaccataagactcatttattttaaaggtgagaaaaatgaggcccagagaggttaagtcaattaatcaacaacacacagctcacgaggctctaatacagcactggttttgccataggtagagaaacctgaaagaaaacattgtgtgatgtgccaatgtggtcagtagttagaactcccatctgttgctcatatacaagtcatgtggaaattgaaattcctctgcttttaatctctacttaggtataaacataaagtggaggagatgcacatccaagctgccttagtctaactttgcttaatacaacatctttaagccctttgtatttttctctgatatttccaggtatgctctctcttgtttaggaaactctctcaatttatgaaatgtaattgtgcatctttaggccgggcgcagtggctcacacctgtaatcccaacactttgggaggccgaggcgggtggatcacctgaagtcaggagttcaagaccagccaggccaacatggtgaaacctcgtctctactaaaaatacaaaaattagctgggtgtggtggcaggctcctgtaatcccagctactcgggaggctgaggcaggagaatcacttgaacctgggaggcagaggttgcagtgagccaagattgcaccattgcactccaacctaggcgacaagagggaaactccttctcaaaaaaaaaaaaaaaaaagatatataattgtgcatctttttatcatgtcccctatggttcctttaagaaaacaattttattcagacacctttttcagcacctagcaccatgtgtatgaaacacttggctgacactatcacaagatatgaaaatgattttgtgtcatgttaaattgttggtagaatgtgccaaagaatcattcccagaagctctgatgactcagacatacaaccaaggcatagtagattattttttccaacagctaaaatggcacagccccatggcagttgcattttaaacactggggaaaaaaaagaggaaaaaaagatcattctcttggcctgcttgctttgaaaatgtggcattctttagacaaattaaatacaaaatataagtagagaaattgatacggggtgcatgttttcaaaacttttgtccaaaacaggacttcaaacattttatagggcatgtctgcaatgtgcagttgaaatgatcacagtttcattttaataaaatgcaaatgcatggattggtgttaagtagattctactgaaaaatctgcacaatttgcccactcggtgctgtagaaagcactgcacctctctgctttgtactcacgcactgtcatctcccttgttgtagaggaagcttctgaacagccttttccagcaatgagcctgaaagcaaactaaaaccccagttgccaccaagacgacctaggcctgaatacccccactgatcttttgtggttaatcagtcacagttggttctgaaagagaagaaataaccatttttttctttctactgttgcccaatggccttaagttgcagcttgaacactcttgtgcatgcacaagctctcccagctggtttaaatgctgtaggattaattttcaacctaaataaatctaagtataattttctgtatctaataacccaaaaagctgtcaatcatcttgttttctaacctgtttctcttagaatctttaaacatattttgaaagctcagccatgctgtcactttaaaaataagtatgataactttggcttgctcacaacctttttaaaataagcagtatgcaatcatcagaaccaagaaaatatgagattaatttgttaaataaggtttatttgtgcatgcttctggctctcacaaactagaatcacttacctcttaaaaaaactaaggttgaatgcatgaaaatcaaactcaataattgaaagtaaacgatgagatatcttttgtcaatatttttcttttgcatgtcatctggttcttcaaaccccaaaagaacaaatgcacatgagtttatcccttggtgtttcaagggcatgtattagatttgcactattatcgctggctagctcttggggaatttcagaccctactcctgaatgtggcttgcacgttcaattaccattggaagaaaacaagaagtaggagcaatattgttctacggagtttggctgccacagaaaatgtcattactccgcaaaaattaacctaagccctttgttctaggaaaagatggccacaatgatcagaatcagagaacaaatatatcagtgtggacaaatctgaatcagccatacagaatgtaacaataaaaccaagagtcaaagacattaatatgggccatccctatccaagccaggcccatggacaaaagtcctaggctataaatggaattctcccatccttaagatgcctgcatctctccaatggagatggtatctgctgactggccacagaagatgcctcccagtatgtgagttacacaactcctcttttttccagctttcctgaattctaaagaacctgattaaaattaactcccactgaagattgtgttgaccacaggatgtcccttttctgcaacaaataaaatattggcgtttggtttcttagaaaaaagcctggagattaatgggctagactttcccatatagtctatgttgagactccagtattatctccaaccctctgcaggatttgaggcatgttacttagtttatttaattctcagttactcacaaaagagaaaagcagcccctgctggtcagcagctgacctggtaatgtaccctaagccctggcaatgctgggagttggtctgtgccttgcagctaggttgtgccatcgtcctgttgaacataaaaaaaaaaatcatggaacaacaacgccaggcaaaatgcctccagtctctttggtaaaacatagcaagagtcacctttattctagttcctaacaagttacccatatcaatctgagaccacctcagcctggacttcattgtccatatcactatcagcattttggtcaaggccattcaacaagtctctagaaagttccaaactttcccacatctccctgtcttctgagcccttcaaactgttccaatttctgcctgttacccagttccaaagtcacttccacatttttgggtatcttcacagcagcaccccactctcagtagcaatttccattatcatgctgctattaaagacatacccgagagtgggtaatgtataaaggaaaaaagtttgactcacagttcagcatggctggggagtcctcaggaaacttacaatcatggcggaaggggaagcaaatatgtccttcatcacatggtggtagcaaggagaagtgctgagcaaaaggaggaaaagccccttacacaatcctctgatctcatgagaactcactatcatgagaacatcatgagggtaaccaccacaggattcaattacttcccactggctccctcccatgacacatggggattatgggaactacagttcaagatgacatttgggtgaggacaaagccaaaccatatcaccatgccatctagtaaaatggtcaggcaagtttagacatacaaaagtgactatgtgaactgtataaaccaagtcaaatggagtacaactaaaagagagtctgtgtttagtgtagaatcagtggaaatatgtgaggttcaatcaacatgcttactaagaaacagcataatttaaattacttcttgtgatgcttagaaagagacacattctttagagcaaattgctgacttataaatcactatcatagacaattgttggaagaaaatttttcacctgcagaatgaagtgtgctcatgaaaggtacacctactggttttagatcggtggggtttgaaataaaagcatttaatttttcaatttcaaaacaatcatgttgtggaccatttcagaaagaactagaagaaactgagagcctgggagcttattcagagtcatttttttttttttttaaatatggaaaccactaaatgtacattcaccatcaaatcctgcccgagctcttgggaaggtaaataagctactgataaaactttgttgcaaaccagaactctataaagaaataaaggaaaaatccaagatagaatacattgattttattttctaatagtagaaacatttaaacattgttgttgttgtgttttaatctcatttgaaaacaaatgcaaatttgacaacatgagcacttgccactaaggggtgtagaatatatctaattggttacctaagacacttgaaagaactagtaggatctctctttaattcccatgttagggtagaagctcccctaaaatcaggaaacatgtgtaatgacttcctgtggggggtgcatggcaacatattcaagctaatgtagaagacacgtgaggtcgaggcatggaaaaatactgaggcactgtgtgcatgttgtttgtgcatgagactagaactccttgtccctgaaaacaggacagggagtagtatgtgtgataaggagtgctgaacacagcctcctaagaatgtggtttgagtgttttttacaaggtcatatgtgcctcatgacccaaccgcaaagagccacctggtggatgtcttttgttcatctgaactgtagtttaaacaagctctctcaataaatattcaggtggatggatcttggggcagcactctctcagaagagctgttccccgccccgttcagctggaattgtttgagtacttcattctcagcattcactgcagctataagctgtacttgcctgtttacatctgagctcaaaagacattcattaaattaataaaaggagattttaaataattaaacgtttttgaacttccacacaaacgtgcctcttgcatacctaaaataaatacaaaaccgatagggacagaaggcagggaaattctgggcagaagagagcgggttcccggtaagtgccccaccctcaagccaaaaagcaaccagggcccaaagtgagaatttacattcctgttttcccactcgactgctgccttttccaaaaccacccatggcctgccctgcaccacatcctgtgcccataaaaactccaggcatagcttggaaaggggagaagcagctggacatcggaaattatagttggacatcagagagaagtggcttgacttcagagggacagcttgatggcatagctttggagaagattctggccggggatgacgggactcctggggaagattatcttcctgctccatcccgttttcagttccccttcctgctgagagctactttcaaccagcaataaaaaatcccctgcatttaccatcttcaatttgttcgtgtgacctgattgctcctggacgtcagtctgttgcgggatcaggaggaccagagagagacctcggggtgtatacaggaggatatctttattattgagtgcactcagacccagcagactcaacgtccaacgactgggcccggaacaaagacagcacttgtctttcatacacacttaacaaaagggggtgggctagcttgaagtaagcttacagtggcgtgaaagcagggatacagaggcaggacaaactcaggaccgcatatgaccattgccaagcaatccagatgtctgttacctaggttttgctctaaagtgccttgcactggtttatttcataaccttcactatggtgcccaagcagctgtagttcaggcctaatcaggcttctcatgaccttcgttgtactttttagataaaacagaatacttgaagtcattagttacagagaacaggaatctataaactcattccataaaacaaacgaaaatttgttttccttctccctatgttgagggagtgctgggagagtctccagagcacattagataatattatcaagacttttcctgggtctgggctgtgcctgttgctgcctctgggaaaagtcagcctaatacaggaaaacttatttctctttctttttgattttatttttctttaatttcccacctcaggacaaaaacttgcgtgccatgagtgtgggtgcaaaaggctgtcacattgaccctccactgagctgttaacacttacggtctctgcggatggcaaagccaaacaggcagtgtaacacttcctctgggtcttcaggggttgcgggctaccctctactagatgctgccgtggggctggtatggagttcattcttgctggtgcccaaaattgttcgccctggctcctgtacctgctcacctgtgcttcccctcccacaaggggtagagcagcgagtgagcagggttcacccccgctggcctggaagcagccggctagttccagcaccagtgcactccagttcccacctgtgaaggggtcagggaaatatcctgtttcattaagaaactgttaaagaactagtagggtctctgtttatttcccatgttggggtggaagttccctaaaaacaagaaacatgtgtaacaagttgtctgtttacatctgacctcaaaagacacttattaaatgaatgaaaggagatttaaaatatttaaatgcttttgaactcccacacaaacgtgccccttgcatacctaaaataaatacaaaatcacatttattaattacgaattttgtgtttctttgtgatcccatgttctgtcattttacaactacatttaaaatataaaaaacaacataagggaaaaatgaaaacaaaacttttcctcatatactagatgcttctcaaatggatactatttcttttgatgatagcaagagtatctttactcacaaacatcaatatgttaagcacatcatctattcacagaaatagtacaagttatagagaggaaatgaaaacgaaatgtttcatttgataggaatggtgaagcaggaaatgagaagagtagaaaatgaacaaaggcatgcttttcttcttctatcactaaacattaagtgatgccaatttgttattttcttcttggaactgcatgggtagggttttagaagccggaaactgctggatcaaataaggttcttggcttatgtactcccaaccctgtttcccccattccctggggcttcaagatcattcacacaaaaggcatgcttttgaatattcagtaatattttctcctgctggtaatttgctctgcagactgtaacgtttcacgttcctaagaattgacagaatgttgctgtttagggataaatgcagcccactgagaagagggtcaagatgaaggatcaagatgcaattagatgtttcagaatttacatgagatattatcccatgtgcctatcaatattgcaatccagcaagaaaacaacacttggttagatgtttctgaaactgcactagtttacttatcctgatatcataagataagtgcttctttcaattgtattttaccttcagattatttgttaaaaactaaaacaaattcaaacaaaacaaaacaaactacaaaagtgagacaaggcagtgaatggggattctgtcccaatgcagatcccggggattctcttactggcatgatgaatggttaacagctatgctgcattgtggaagtaaaatggcattcctccaaaaaatggaccaacgaatacataccttgggcctttaaggtcatgtcaaccaatggttgaaaccacaagggatacatgccatctgggtgccaactgtcatcaatataacaaagacatctgagatggggatgtgtctctgagtggcatttagcttcctcccagagaagtgagccttgactgtctgcagcggaaccatcaacacacagccctgggttgtcttcactacccagttgttgggactcataaacccatacagcaaaatatggcactttgatgtgctgaactgaagaagaagcctcaacgtctctctcatcttctcccactccctcttgtctctcaaccctctgtgacccccaaagcacaggaggaagttgttttctgaagttgtttatctgcctaaagtctggacccatcaaagaagaaaacaatgacctctggtcccttccccgagattctagtaactggactcatatcgcaggaagaaagaatgaagtctgtcaacacacctggacagacttttgtgacaaaccactgtctgctctgcaagcccaacagactttgttctaagccactgtatgttcttcaagcccacttaattcccctaaaaatcatttactatccccctaagtatcatccaggagtcctcacctccctttcctctaggaagtagagtatataagcatatctactccattaagatattgggtaatcagtctcctaatccttcctgccaagctatccacattaaaggaaatttgcatgccttttcttcaattaatctgcctttttaagttgatttttcagtgaaccctcagaggggaaaggggaagtttctactaggggaagtgcctacacagccaacagttttgaccaaatcttataagataaatttttgcacagtgctcaagctgaagccaggaacaaagcacaggttctatgagttaataatgatgagaaaataactcaagtctaaggggtgaaaataggaaaacctgtcaccttaatacagtgtgtattttccacagtgggaaggaaaaagtgtgggcagatatctaatagttgcatatgcagctgaaaatataaagtaatctaaatactagatccaaacgccagattaacaattcttgcagtaaatatcatccactaatagtcccaaattttattataaaccaagtaaatgtaagtaatgttttggcatgtggtttaaagagtgaataatttgggcagatgttaagaatacacttaacattagaaaaactagaccaaagttagacatcaaacatcgttatcatcctaaaaacaattttatcttcccaaatgtgcttcatttcaaacgagctattttacccacctctcttcagcatgggacttatctgtggtcttgtaactagaaattatatggcactacaaaagattaccaactttatttttcccttctctgttaaaagtcatcatttttaagtaattataataaaaatgaaaatgaatgacattttgaaaaacgtcaaaaagcagcacatgttggcaaagatgctgagaaaagggtacagttatacactgttggtgggaaggtaaattaatacaacctctatggaaaatagtatggagatttcccaaatgacttaagatagaagtatcatttggcccagcaatcccacttgtgggtttctactcaaaggaaaagaaatggttctatcaaaaagacacctccactcatatgtttatcactacactattcacaacagcaaagtcatgaaatcaacttaagtgtccatcaacagatgactggatatataaatgtttatatataccatggtttatatatccatggaatacaactcagtagtagtcataaaaaagaatgaaattatgtcttttgcagcaacatgtatgaaactgggtggaggccattatcctaagtgaaataactcagaaagtccaacactgcatgtttttacttataagtgggagctaaacaacaggtgcacattaacatacagggtagaataatagacactggagactataaagtgtcaggaggtggaaggaggaggaaggggcatgaaggatgaaatactacctactggataaaggttccactattcgggtgatgagtacactaaaagccccgacatcaccactatgaatatacccatataacaaaactgaatttgtaacacccataaatttataaacatttttaaataaaaaataaaaagcaaataaaagcaggttttcttaaaacattgtattattttgttcttaaaataattttatttcttaaaacacgtattttgttagtaagtacatacatttgctaacaaaatagtggaagcaaatacaaaatatagcatgtagctgtcagcccagggccctgtaaatggcctgcttgcatcatgtaagttctgaccatatgacaaatggaatggatagaagctagatacatataaaattttctcctttctgcaagttcacagtttcaaagacatttcctaaagtctttccctggtcaaaagcatggaaatttaattatcaattcaagtttgctctgagatcaaatggagacactggggttgtcaatagtcaaattaaatcctaagctaaaatgcccctgaaagtaacagataaggaagaagagagccctgggacagtttttagtcttccatgtcaggatgctgtggggtacgatgacatgttttgtttgattgttgtttagtttgtttatatgctcctttcaggacctttctacacttttaaagagagcatcccagtgaaggatatgacaacttcagactttatttttcttctatttaagaggaaattcacgtaacataaagtgaaccattttaaagtgtactgttctgttcaatgtcatttagtatatttgcatttttgtgaatctatctctagaaatttttcatgttcgcaaactgaaactctgtaaccatgacacgctaattccctatagtcctcttccaagcaccagcaaccactaatctactttctgtctctatgaattgaatccaaatatccatcaaatgaaaaatagataaacataacagaatgcggtctatcatacaatggaatagtatccagccataaaccagcatgcggtactgattgatacatgctacaatgtggatgaaccttgtaaaccttgtaaacattttattaggagaaagaaatgagatatagagtgtatgatttcacttatatgaaatgtaagattatgtgaatacatagagatgggtttttaaaagttactttattttctaccactcaaaaattaccatgtccattccaatattgcaggatatgagatactgaacatgctctaacatggtgatgattacaaatagtcaattaaatcacagataccataatgttttattttactgtgatatagagaatatgaaattgatcatttaaactattttttggtgtataattgagtggccttaagaacagtcacattattgtccaactgtccccaccatctatcttcagaacattttgtacctttccaaactgaaactctatccattaggaaataattttccattctctccgcctctcagccgcacacaaacaccattcaactttttgcctctgtgaatttgacaactctacgtacctcatattggtaaaatcatacagcttttgtccttttgtgactagcatgtagcttatttctcttagaatgatgtcctcaaggtttatttatgttgtagcatgtatcagaatttcctttcttttaagggctgaataatattccatttcagcagtgtgtgtgtgtgtgtgtacacgcataaatatatacatatatatcacttgtttatccattcatccatcaatggatagttggctagttcaaaagttcagtttttagctattgtgaataacatggttaaggactgcgtatacaaatatctcctggaattcctgctttcaattcttttgagtatatacccagaggtagaattggagtatatacccggaggtagaattgttggatcacatatggtagttccatgtttacttttttgaggaacagccaaagagttttccacaatgactgtaccatcttacattcccaccagcaatgtgaaagagttccagtttctccacatctccattacaacttcttattttacgtttactttattaacagccatcctaatggatatgatttccatgatctgaaaacatgatttcttgtgtattattgagaatgtcaacaattgagattttcaatgtactgtcccaggctcctaagactcaacaatgaatgaaacaaacaacaattaatgcccttgaagagctgacatttcggtgggtgggtactgactggaagaaaagcaattgagttgcagtataattgtggccaagatggaacgagtcatagatttgactggaaattggatccacttctgccactgtcaagttttgtgaccctgaccacaagctttcatttcttcatttttcaaatgtggttggttgtccaggcccgtgggaacacgtatgaagacatacaccactttcacaacacagggggcccctgtttcagccagatccaagagaatctgctctctgttcacagaatgaacacatctaaatcataactctctatcctgcatttttcttctgttttgtctcttcttacattttcttttcaggttctatggcgatttgaatttgagactcaattccaaatgtatcccacgtccagttattccaatgtgatggagaatcacaaagtgaagcaagtgggatatactgctaaccatgaataagaggttagaatgtcttgttctgattaagagcagtcaattagggctaatttcctgtaggagtacagataaatatcttgcctataacttgcaggtgagtgactacaaaacttgcatttatctagcaaccttcagtaccattctgctgactgctgacatcaggaaatatccctttgctgcctagttagtgttgttgtcatgaatttgggggtgggagtgggggtgcttcctgcttgtagaccctcacctttagacctcctggatctcccctatgaacctgccatttaaaatgctcaatcagcctccaggactctaacaaagacccttccatctgttataattgatgaatgagtctgtagtttagtgatcctactgccttctgcattaagtatttgaattatactttttggacaatatgaatatctcaaagttctttttattttattattattattattattattattattattttagacgaagtcttgctctgtcgcccagggtggagtgcagtggtacaatctcagctcattacaacctccgcctcccaggctccagcgattcttgggtctcagcctcccaagtagctgggattacatgtttgtgagaccatgcccagctaatttttgtattcatagtagagacggggtattgccatgttggccaggctggtctcaaactcctggtcaagtgatccacctcccatagcctcccaacgtgctgggataacaggcgtgagtcactgtgcccagcctcaaatatctttttctacatcaatttagggattactcattttgaatcacaataatctctatttaccaaacaacaaaaggaagctttcaaatttgaacttcaaataaatgagctcaggataaattacaggcaaacactactaacttcctatcattggtatattcaaaagttaaatgaaaattccactgcaaattaaagaatagtaaatgggactcattaataatatcctagttgtactcttccatccatatcttaaagtgtttaataatctattaatctatacttgcaccagaactattatttcacaatataaagtatctcagagtcaagagactttcctaaatatgataataaaaaagaaagaaatgttggcactatgaaaacctgctgttagtcttacccacaagatcctttatatttaaaccaataagcttgccaacctgtggcaaatgagagcattcatgctggccaaaagtaaagcaagcgtatttccattcaaatgaatgaatctctaccaatacccaacatctcaaattcagaaatatatatatatatatatatatgtatacacacatacatatctacttctacagcaggaatttctggcatgatcctagtaaaatttttaaaagtctaaagaacttctttataatggccatttttattttcaccggccaaacactctgctggagatgcaataagatgataccatctgaaagaaaaatatctctccaccgatcagtgaattaagatctcatgaggtttaggtatcgtttttctccatctaggtcctataatccatggcctaaaattggctttcaccagaatataggtcctaccaccgccaggggtcaaggcagcatctgtgaatcagacaccattaacaccatcttctggagaacacctgacttgtttgaacgttatgtaatcgttactcacctgtctttaaaaccaggaaaggatgttacacgatctcttcatggtaccgtggggtgaggaaaaagtaaagataaaaaataacaccatctcacaaatcttgggttctggtaaatcagatatgttctaaagagaaggctatgaaacagttgagtttgaaaaaaaaaatgaggcattacaaggccattgatttcattaaaagtccatgagtcgttttaaaacttgagatatatttgaataagacccttttttaaaacctgcattaatctttgattttaatttttaggaacctccattttcacatggcacatgcccaaattgcaattccaaggcagagcattaatgagcatttgtaatcagatttaatcacagagggaaaagacagaaagaatatccaaggtaaaaggttttgctttatatttatagcctgtaatttaagaaggaagtgtgaaatatagctttgcgtattgctggagcaaaagcacaagttttgtggccaacggggaaaaacgcttttactccttgtcaaactgatggagaagttttaaaggctcaggaaataaactttcagatactgcatgactacattatttggaagcaaagaggatgcaagaaggagatgaagaatcccagattgtccttagatcttcttgccagagtgtggcctagtaaggagaaagccaggtggcatcctgaatacattggttgtacacacatgtgtagtgtaaatatctgaaacacctatattcatacatatatattgcaataatgatgtgttgggtggagtgggttgcgtaatatcctccaaaaatacatgtccacctggaaactcagaatgtgaccctatttgaaaatagggtctttgcagatataattagttaaggatctgcagataaaattatcctgaattgagggtataaccctaaatccaatgactggtatctttataagaaaaggagacgacacatacaatagagggaagacagccttgggaagatagagacaaacaccgaggccaccagagctgaaaaggcaaggaaggatctttttctggaaccacccagggaaaggcagccctgccaacacgtttattttgaacatctggtttcccaaactatgagaaagagtaaatttctctcttttaaagccatcacatttgtggtcatttgttatggccgctctagaaaactaatacatggagattacaggatcatttagaaaatgtgccagccaattgcaaaattcagcagaactcttagaaaaccatggtttatggtcttttcataatgagacatttaaaatacccatggaaagacctaaagaaaaaaaaattctaccgtagagctctactgttttgcttttataattctcaaaatctgttaaaaatataaagatatgtagatttttctaaactacaggtttcaattcaagatcaaatgcatgccacaaatataaaatatctccattccagctaacctatgtgtaatgaattatgatacaggtatacatagatatttcggggaacatggaatctccagtgtttgtgaaaaagaaacagctgctgagtgtaaacagtggaaataaacacggtttacatgaaactgggcattcactgattttgagaatcagttcactcaaactaaaaaaaaaaaaaaatgagtaaatagattcactccttttttaattagcttgcattttgcaatttggagtcaaaaaccctgcaacggctaatcattcagaaactgcttattgtccggtagacactagggagagagaggtagtatgagctatgaccacagccgtcaaggacctcagaaactggtgtcaggaagcacacctataatcccagcattttgggaggctgaggccggtggatcacttgagcctaggggttcacgaccagcctgggcaacatggtgaaaccccctctgtaaacaaatataaaacttagctgggcgtggtggtgcatgtctgtagtcccagcttctcaggagggtgagataggaggatcaattgacccaagaggctgggacttcagtgagctatgattatgacactgcactccaacctatctgagagagcaaaacctcatctctaaaataaaataagaataaatcaattttaaaaagtgaacatcctggccaggcacggtgactcacgcctgtaatcccagcactttaagaggccaaggagagcggatcacgaggtcaggagatcaacaccatcctggccaacatggtgaaaacccgtctctagtaaaatacaaaaaaattagccaggcatggtggtgcgggcctgtagtcccagctactcgggaggctgaggcaagggaatcacttgaacccgggagggggaggttgcagtgagctgagatcgcgccattgcactccagcctggcaacagagcaagactccatctcagagagagaaaaaaaaaaaaaagtgaggatcttaagatgagaacttaacccggttcatctggatgaatctaggtaatcataatgttttttgtttgtttgttttttaaaatggaaggttagaaacagagaatgagatctaagatatgtagccagtcttcaaaagaagacaaacagacaaaccaaggaaatggattctctctttgaatgtgaacacatttgggacttttagcacccagaactgtgagataataaatctgcattgcttttaattccctagagttaacattagagttataacaagttgtgataccttgttttagcagcaataggaaagaaacaaatatagataccaagtaaggaatgtttttcgtgaaggagagagtcatcgagaactctaaatgttctggaaaatcaaaatcaaaattcaaaattttccagaaaatcgaaccctgagagtgcagagtggaaggcattaatggaactgataagtagtttcatggagtagaagagctaaattctgatcgaaatgccttttatttcttgggtggattatgcaacaaccttctaacctaatgcccctttacatagacagccatttcctttctcactaagaacaatacactagtcctttaaaggcatataaaatgtggctcatgctgacatctctgaaatcaggtgctactatccccttcaccactactttccagctgcactgatattctcagggactctgtggccacagggcctttgcactggatctttccttagcccaagatgctgttcctccaggtaactgtatggatcactccctcacatcagttttgccttatctgtgaaactttccataaccaccttagtcaaaattttggcacaaaatttctaatttagcacccttctctactaaatatttctccatagcacttgtgatatcatattctactgtgtattttacgatacttgtctgtcgttgttttttcccctactggatagaaatgctgtaggattggggattttttctctgttttgtttgctactccattttcaatggaagttgttataccatgtgtcaaacagcaggttgtcaatatctgtttcttgaatgaaagaagaatgaatgaatgaaaaccactactacatcttccttggcaaagctagttttgtatatatagaaaaaacattttaacttcacttaaactagaaactctatctcactctctctctctctgtctccctctctttctcttattattactagtatttttttaaatccagggctcattacaaaaccttgtaaggaacggagggatgccttgtccattttctattgacagttataaagagttatatgcctcatagtcaatgaataaatttgcactgcactttggtcaatgatgccttcccccaatagactgatcaagtcctgccttactcagcatttacattcctgagtcagcaattgacagaatcaaatccccagtcatggtgaactgattgaaacgaacccttcttcacagacacattgatggcactctatcctaataccctttatctgtcccggcatccttatattgtctccatacaatgatgagacagccacaagggacgggatagcagtggactgtcacgataaccatgggacttgtgagatatagtaagtggacaagcctgcttaaacatatatgagtcaatattcagagtcattggtcaatgaggctgaagattatgttttcagaaacatgagtaataagaatgtgccatcaagaaagtggaggtggaagacacagaatgggagtgtttgtgaatcccacatgtggtaaggaacatgtatccacattatactacttaaaagtacccctcctaaacctcagtaatgaaaagataatccaattaaaataggcaaaggatctgaatagatatttttccaaaggatttacacacatgtccaataagcacatgaataggtgttcaacatcattagtcatcaggaaaaatgcattctcattctctgccaccttgcatccaatccatcagcaaatcctgttgcatctgtaagacacgcagaacaacctcttcttttttattttctttgcattctcactggtactgccctggtttaagctggtatcatttcttgagtagattacctcttgcctactttttggggatgtaggagagaagagatacgggacttctttttggaatgatgtaaatattcaaaaataaacccccaaacatgatatcactttacacccattaggatggctataattaaaaagacagatgagaacaagtgtgagtgaggatgtggagaagttaaaacttttgtgcattgatggtgaaaatgtaaaatggtacacctattttggaaaataatttgaaagattctcaaatatttaaacacagagttcatgatatgacctatcgattcggctcctatatccccaatcaagaaaaatgaaatatatgtccatacaaaaacttgcacatgaacgttcatggcacaattattgagaacagccagaaactggaaatgatcccaatgtctagcaacagatggatggataaacaaagtgtggtatatccataaaatgaaatattaccgaaccataaaaaataaaagagtagagatgcatgctacaacatggatgagcctcaaaaacattaagggaatgaagtcagacacacaaaaaagcatgtattatatgatttaatttacatgaaatgcccccaaaaggcaaatctatatagacaggtagatagttagtggaagcctatctcctggggacctgggagagaagaggtatgggatttctctttggaatgacgtcaatgttcaaaaattagatggtgttgctggtgtcacaatgttgtgcatatactaaaggccattgaattgcacacttcaaacgtgcacgctggatgtaagttgtttcaaataaaggaaggagacaatgaaaaataggagttggagataagctcaacgggtcacttacatggtaaggatcacaagaagattaagaaacatgaagatgtatcaaaagccattaaaagtatcagaagtgccagagaaaatgcttatgacatttctgtggccctcaagagaatagttctgatgaaatatgattgaaaagaagaaagctactcatttctttcaagatgagaaatgctaagcatgttttaaacaaagaggaatgaagaaggatgaatgctattcctaagtaatcttgtaagttcatgcttagaaggaaaaattaaacagcaatgaaggaaaaagatacctagaggttcgcaatatattgaacacaggcattttggtggggtagcctccatgtgttcaaaagcacaggatggatttataataatgtgtttattctacccacctgtttaagactatagccaaattattacacagacattcccggacttacaatggtttgatttatgatttttgatcttaagatgatacaaaaatgatattcagtcagtagaaatcatattttgaattttgatatattcccaagctagcaatatgcagtaccatagtctctttggatgccaggcagcggtctgtagctcccagtcagccacacaatcacaagggcaaacaactgctactctgcagtgtacatgaaacattcaacactttatttataaaataggatttgtgttagatgatgtcacccaactgtaggctaatgtaagtgttataagtatgttcaatgtcagccaagctaagctatgatgtttggtaggttagatgtattgatgcattttcaactaatgacatcttacatttacaacgggtttattgggatataatcccactgtgaatcaaggaacatattttatatatgtatacatacacattagcatgtatacatatatagacacatatatatacacacatatagatctgtgtgtgcatcacaagggcaaacaactgatacatgtatatgtatacacacatatgtatgtatgtacacatatatgtatgtatacacacatagattatacacacccatatgcacccacacccacatatatacacatatatgcgctatatatgtgtatatatatgtttaccaccaagtatctaagaccaactgggacatctaaacagatactggaatattttagtaaagaggcagacactactttaaaccttaccaaatatttcttaaaacaaacaggaaatagtttatcattccaaaatgttctcccaacaccagtgcaaagcttagttttcttgtgtacaaatcgtagtgtttctctgtgagatcatgttatgcctgtctacactgaaatgatgtttttttgttgttctttttaatgtttaaagatgggttctcactatgttgcccaggctgctcttgaactcctaagctccaaagatcgtcagcctcgcgagtagctgagactacaggcatgcaacactgcacccagtgctgaaatgcttatcattatgtgtttatcatacctgcctgtttatgatttacaatgatgtgttgattttacccatctgtttatgactacagccctataactggacacagccttctctctataacatctgagcctctaataaatgccactatacttaacacagtgaaaatcagtgcatacaatctcaaataattaaccgaatcaacacagactttctagtgacttatcttcataaaggccctagctcattgaagcaatgttgcgttgagcattctaaaatattcctgactttttacactgaaaattaaacacttcattcaaaaaagcgattattattatttttagtccaaggataaagtatcttaagaatatggctggacgtgccaatcaatatgttacaattttatttgaaacatatatttatatcgctaaatgcagggtgtacctgccataatttggttataatttagtccctaggaaatttactttgcacctgtatgtttcatcccctagggttcatttccataaagctaatgacttattaacgttggaatggacaaaaataagacaattatactagaacacaacacatctgtctttgtatcactgctgtcatgcatgtacatatgtgcatattcatgcttcttgtagaattgcctgtgctattacaggcgggtaggcaaatgtcaggggaaaaaaagctgcaggccagaatatgtgtagtagtcttacatttttttaaactttatgggtacatagtaagtgtatacatttgtggggtacttgagatgttttggtacaggcatgcactgcataataatcacgtagtctttaaacatcccgctcagattgccttttagagatttttccattatcctactcgaaaggactaatttccttgaatatatgtagatactgacagaattatcaccagaaccctaattccaatgtacttgaatttggctctcaatttcaatgcttctccctggaactttccatcatcccttgggatactcatcatactcttattttcatttaaagcacaacttatgtccttctgtccccaaggagaaagagggcacgtcaacctcatcaactaaaaatcatcaacctttcacatactggatgagaagcaaaatgaagaaaacaggctgaagagagaaagggatggtgtcttttagaattaataatcttaagagactgttttgaatgtaaaactttcaaagacagaacatttttaaggcatattctctgtgactactaactcatgcttaaatgacattatataatcaattaactgggaattatatattgatggaatagattcttctgtgatttctgtttgaatattttgatttctaaatatggttatgcatgtaaaaataaaatttcagcttctttaaagaaatcctgaatcgtttataaatagatcaaggagagtctccatagcatgacagatgccagatgataattttgtgtatttgggattggaaaaaagaagtctttgaagagaaatctgcactcccatgttcattgcagcactaatcacaacagctgaaatatggaatcaacctgaatgtccatcattagatgaatgaataaagaaaatggggtttatacacacaagggactattattctacctcaaaaaaaaggaaagaagttgtgtcatttgggactacatggatgaaccagaggacattatgttaagtgatacaagccagacacagaaagacaaatatcacatgttcttacttatatgtggaatctaaaaaaaagtcaagcttacagaagcagagagtagaatgttctcttacagaacttgaagctggaggtggagaggaaacgggagatgttggccaaaggttacaaagtttcagttggcaggaaaaagttcaaaagatctgttcaatatggcaaacaaagttgaatcacaaggaattgaatatttgaacatctctaagaaagtagattttaagtgtttgcaccagaaaaataagcatttgaagtaatgcacttgtgaattagctcgatttagccatttctcaatggatacatatttcaaaacatcactttgtacatgatcaatatattcaatttttatttgatgattaaatgaatacattagggaaaaaagcacaaaataaaaaaaattcttttctaccttgtctccactccctcccttgattttcttttgagtcttttttaaaaatttgagacaggatttcactctgttgctgagactggagtgcaatcacagcacactgcagcctcgaactcctaggctcaagcaatcctcctgcctcagcttttcaagtagctgagacaccaggcatacatcaccacatctggctaattttttctttttccttccttcttttctctctctctctctctctctctctctctctctctctctctctctccctccctccctccctccctccctccctccctctctctctctctccccctctccctctctctttctttctttctttctgagacagggtctcactaggttgtccaggctgatctggaactcctggcctcaaggaatcctcccaccttggcctcccacagtgctgggattacaggtgagagccactgcacctagccttcccctgattttccttgcccaataaataccgttccatctgatgtctcgcttgttgttgagtcagctgaggacgagggagcctctttgctctgctgttcccatcaactattacatcaatggcaccttcctggtgagagagtccttatcccactgcagtcgtccccatctctgctccatttgcctctcaggtcctaatgacaaagcactcatccttaatttcccctgaccttcttcacatcctgaataaatccaatgaatgcagtgggcattttgagccactaggaggcagaagaggaaagtccaagcaaacgatcattctgagagcaaaaaacatgatcctggttttgtttgccccaccaaagacctgtccacacctatcaatctgcagccacaacaaccatgggattacagtgtttccaagtgtgtattcaatgcatggaaacctcattataaagaagatgatgatgaaaaacaagacattgtgttgtgtttttttgtttgtttttttttttgttttgcaaagtgtcttggtttttctttatctgataatttctggattagaggttgccctatcttctgcaatgtgttcactctattgctgtgttatctactgcatggacccctgccaactccccaggctggctttaccgataacatctgccacccagcccacaaagaatcttattctaaaggctcccattcttccttccaccttttgctacttcctgggtttgagtgctcacacaccattcatcttgtctcaggatttcactttctcacccttctctcatgcttcttttacgtctctacttttgtttatgtatttctcactaagtacaatgcttaactttcctttctcctcatttaactttttgcagtgttttgttttagtaacgcctgggtcctgttttagacagagagaggcaattcttccagtcaaagtaggccatttacagaaatcaaatcgggggaatctgagacattttggttagaggaagagaagagagggattctaatgaaaccaggagactggcatcaaggtgtgttgattctcgaaaaaggaaatgatgctttcttttttaatatatacgcttatgaacttttgacttgatacataagatgtgttccatttatcatttcaaataaaatccttcataaagcattaaagaaaagaaatattgttagaaaaaaagaaataaaatagcaaatgtaccaaaaatagagcaactcctctaacttccaaaggggagaagaacatacaggtcatttataagatagcttgacatttttcagcaggtgtgcttcagggaaattatagtgacccattgaactcccactaatgtcagatgcatgtcacataaatgcacacccatggaattgaggctgtaactcttgggaagaacgtattggtcctctcttctaatgatttccaggcttcttttgttgagtggaatattacatggctcacacatatcacaaaagcataaaggtgagaccactctggccgatgttgcaagaatgcttcagagctcagcccaccctccctcaatttcagaggaaaaccctacaagggacaccagaacagggaaagtgaccacattattaggctgagcacgtgcatatgggttaagtcacccaaattatgactacaaatgctgtttctgctatgcatgttggttgcttttatatcaaaccatttctgtcttatattcaattatgactccaaagcgtctaataggtttattcaatgaatggtcttaaagagaaagacaacttcagaagaccatgacgcaatctaccctcagatgaaaattttcaggatagctataatatgtgaaagattgtaagaaatgcaccgaaatgatcatttgactcaatttatgcacacgacacagcaagccagcaatgacatgggaactgggggtaggacaccaaatttcctgatgaaacactagttctactgcaccgaagagctttgatgtgacaaatgccattgttgtggttaatgccaccatcaccgtgaaccaaagcaaaccagtatcgattgaatggaaatgaatcagccttcaaggacccactttgaggaacttaaaaatacactgtaagcatcttatcacaattgtgtatcttgatcagcagtaagaacttttttgcataatgataaaagctacatctgatgctaaagtgatactcaatttcttcactcattccatggtttactaattcatacttgacattaattaagaaggctgtggatgagttctgagtggtaagtcagagctctggcttcagttacacccgggtttcagtccctgctctgactgctagaaggtgtgatgccatgagtaaatcccattacctcaaagcattcatctcctcataggtaggacataaggttaactcttccaagggagtttacgaagattaaatgaagtaatatctgccagccacatagaggcacacaatgagttgatgttacatagttgggactcttttgaagcaacaattaatttcagcatacatgaagcatgaagtcataggatcaccaaaaaggtgatagtaccatgtgagctaaacggaaatacatatttaaatggaggtagatgaaatccactgcaggtacagacagacttgcacttggagacaactggaaaggggaaggaataaataagttccaggtatttccatcaaaaagcatgagcaagatgcattctcttttacatcgaaggtctttggactatcatgaacaacaacaacaaaaaaaaaacagattggggagaactcaagttatactaaagtaaggaactaagatggagaaaagagtatttattgattcagtaatggccttacagggattcagatttatcagattatcctctgcagtttctgtctggaggtgattgttctgaaagtttattacctggattaatgtctaatcttcttaggggtaaatgatacgtatggatgttgtgaggtgaatgggtgatagggcataggtactcaagtgggtaggtgagaccaggcaaatgccctggcacgtacagctcagcaaggattttgctggcttctggcttctgagcagataggaacaccacacaccctggcaatgactaatctgagaggcattggtgaacttgaggttttccaaattcttgaatatatatgtcagagacgtttgaaccagagcacctccatcttgaataagggctgggtaacgtaaggctgggacctactgggctgcattcccaagaagttaggcattcttagccacaggatgagacaggaggtcagcacaagatacaggccacaaagaccttgctgataaaaggatgcagtaaaaaaaaacagccgaaacccaccaaaaccaagatggcaactagagtgatgtctggtcatcctcactactcattatacgctaattatacactaattacaatgcattagcatgctaaaagacccttccacaagcaccatgacagcttacaaatgccatgacaatgtcaggaagttaccctatatggtctaaaaaggggaggaacccttagttccaataattgccacccctttcccggaaatctcatgaataaccaaccccttgcttagcatataatcaagaaataatcataaaaatagccaactagcagccctcgggctgctctgcttatggagcagtcattctttattcctttactttcctaataaacttactttcactttacggatttgcctccaattccttcttgcacgagaatcaagaaccctctcttagggtctggattaggatccctttctggtaacatatacaccttcctagtgacaagggtgtatagcagaacacataggaaatctgtttatagaagtgcagcttctttaaaaacaaactgaacaccaattcaatcagaagacacttcatgtagatataaataattactttatagctataatgatacatctcaatttgcctgggacaatcccagtttattcatagcacatgagcaactctcaaacatgtcctggattggatcataaattatatggccaatggctagcaagattgtgtagcacagttctgattattttttaaaaaatagcaaacatgatgatcttctgatttatttaatgtctacaagtgtcttgtaatgttattttaaattaacatggttcagtctggatgccaatatttgatagatattagttagccattacaggttgggtcagctacaattcttactgtggataaacagtagtattaatacaatgcataatggtattaataacactagaaattgtagtgtgactgggtataatggttgctgctgagagcctatgaaacttcatctacatgagtccattaaatcttttttaaaaggttattttttggccaggcacagtagctcatgctgataatcccagcactttgggaggccaaggcaggtggatctcctgaggtcaggagtttgagaccagcctggccaaaatggcaaaaccccgtctctactaaaaatacaaaaattagcggggcgtggtggcaggcgcctgtaatcccagctactgcggaggctgaggcaggagaagcgcttggacccgggaggcagaggttgcagtgagccgagatcatgccactgccctccagcctgggcaataaaagcgagactccatctcaaaaaaaaaaaaaaagaaaagaaaaaagttatttttttattgacaagcagattatatattaatgaggtaaagtgtggtattttgaaccatggaacttttatactgtacaacaaccttgcaagggagagaccactgccttctacatctaaggaaagagtctgaggaaacgctagctgactttctcaaggcagaggtagaggaaagttgttagctcctgtctgtctctggctgcgatctacattctttccaatgccagcattccgcttccattatgggcatgtttcatctttttaatcctctcttttgggtaacagagaatagcatttgttactccattaaaaaaaaaaaatcttaaaacaatatttttccattcctcaggtaggaagataacatttatgcatttatgacttttactggaagaaaaagaactcaaagaatatttcaactttttgcctaaaattgtatctacttgtatgaaatgcactcactgaaatgatcattgcagtgcctgctgtgtattttatttgatcatctttttaaatatctggatgccaaaggtttaaaaacattttttcaagaccgataataggagtttcctgcaagcaaaaagtaaatgccgcctagctgttttcaagaggacaatagtaaatgcaagatccatgataaaaaccaacgcagtcacattttaaagtctctatcgtcctgtaaaatcggcaaacttggcacatttcattccatcaaatgaaagggggtctgtagtgtgcttggctgttccacactagctcattggaggaatgtaaatagaccggcatagagatgctaaatcgcttcttttatttcttccccaccaattttacagctctctgttatcttatgacttttaaaaactctccataacaaaaagtagacttaacaatttttcaattagtttttttttcctctaaaaaaagtgtgtatactttccaggctaatttgcaagatgtgcaattgattcacgaagggacaaaactgataaaaaaaaaatcatagtgtagagttgcttgatacaactgagctttagggggaaaaggagatcaatttattttgaaactctatcttatcagacacatcaattcatcacgcatgcaacagaatattgtgtggttccagcaaagcaagaattttcttgatgcccactgcttccctcagaaaagcatgcccaagctttcttccgtgtggccgtgctacaggcagtgcacacactgctccctttgaagagggcctgtgcaatgccctcacacatactttcctccttccacctctttgtcagaatgaaccttttgtaaaacatcaagaagcacaatttcctgtttccaacactagtagccaaagcaactatccagcgcctctgaaaactattcagtgaagcgtgcaattactgctatgcaaaagttcagagacattattccgccaagatgtggctcacagaaaactacaaaaaatataggaaataaagccaacgacataataagttttttgacactaaaaggttttttggtggtgtttattttctttaatgcagaaaccaacctggaattttgagttctttatcaatgtttcaaaagatacaactttagcaacacctgtgactgatttgcatttcaaagtaagaaatgcatttctcttagggtttcttacaacacctcttagggtttctcagcaattcaccaccttttagggcttcttacaggttaatgttttcacataggaaaaaaaaaaacccactcaaaatgaaatgaagtcatctgattgaaaagaaaatattcttggccatatttgaagaaaacattttcagtcatatttcttgtttgacagacctcctttagtccatcttattttgctttttattttaattaatttattactagtattattattatttttttttttttgagaaaagtctcactcggtcacccaggctggagtgcaatggcgctatctctgctcattgcaacctcgacctactgggttccagagattctcccgcctcagcctcctgagtagctgggattacaggcgcctgccatcaggcccagttaatttttgtatttttagtagagacagggtttcaccactttggtcaggctgttttctaattcctgacctcaagtgatctgcctgcctgggcctcccaaagtgctgggattataggcgagagccaccacacctggccttcattttgttttgtatttcatattgtatcataatcacactggaaccaatatacacatctctctcatggctaacttgttaaaaactttatcttctataccattttaatgcatttttgcctggaaaacaaatgtttttacataggtcttaggaatattattcacaaactaaccaacaccaggaaaggccatctcagaaggtactgaaatctgactctgaagatgtataattttccaacctacaattagaagaagatgaatgatggccgggcgtagtggctcacacctgtaatcccagcactttggaaggccgaggcaggcggatcacgaggtcaggagttcgagaccagcctggtcaatatggtgaaaccctgtctctattaaaaacacaaaaattagctgagtgtggtggcatgcgcctgtagtcccagctacttgggaggctgaggcagaagaatcacttgaacccgggaggcagaggttgtagtgagccaagatcgcaccactgcactccagcctgggcgacagagtgagattccatctcaaagaaaaaaaaaaaaaagaaagaaagaaaagaaatgaaacatcaaaacaaggaggaactaaacttgaatttccatgtatttagcctttaatcgtagatcatcaatggacaaaagtcaactaacagctaagtttccctgcatgcaaatgcaatggaaccaaaacaacagatcttccaaaggctcaacataatcagttagagaattggataaaatcttttcctccacacaatatactgattcatacaatgacacaatcagaaaagaaagctaagatctatggccattcccaactataatatcaccaaatatgtgttcattgtacaggtctatgtagacaaacatacattcattgaactccaagggagaaacatgctataaataaaatttcatttcatctttaagatcttaaagtctgcattggtttgagaagggattcatgaccatgttgcacaaaggtagtaaaaggaataaacatatccaatcacataaagtaaataccgtgaagtggaattaaccaggaactggaataacaggattcaaatccacgagccccgtcaaaacgagaagtggacttttcatgtttcctcttgctcagtcattcacatgatgaaatcacttacctagtattcccagacggtagttaatggtgatcacgatgacgtttccgtagcttgccaaaatgctgccgtcaatcatgttgccggtgccctccatgtaagatcccccatggatatagaccatgacgggcttcttactgttctgatcatgaatatctggaaaaaaaagccaagtaaggaaacacaataaagaatcacactgactcaccaatgctaaattaagaaaaaaggagattcactgatttccctattttgacttgaattaagcacatttatttttatggatgatatgacccttgataagagtgtctaaggaaaatgatcaatgctattacgttttctatttatggaaatggtattttaagaagcatacagacatttagcgtactctgctcatctaagcttctatatatatctaaagcactaaaagaaatggttttaggtaaagtacacatttcctaaattttgctcaaaccctaaaatgtgatttaaattgaataaacacatgggacccttgatgaaatatattttatcttctaattaagtataaaatcaacttcaaaattataattaattttaatatagttgcatcttaattcgcaggtgagtgtacagattcatcttcaatttaacaataaaaacataaaagtagtagtgaagctataaactatcaataagggacagataatgacaagaaagcaaaatcaacagttaaaaattattaactgaacagaaatagggaaaaaaaagaaaagatgtccaagcaaatgtctttgttccagtgattacagtaacatactaacatacttaggtgacaaaaataaaagagatgtaataaaaaatggcaaaagaatccaaactatttaaatgctttatattttcacagggaatataaactcccattgtgacttgcaaccaatgattcctcttggtaatttactttattatttaaattaacaatgatgtaaaaacaatgatctgtgatgatagaaagttggagaccatctgtagggcctgctttgtgaaaaagacctgttttataacattaatcagccattagggctgcatttaatctttggaagactgacctcacgtataaatatttctggatacagatatgtgtgtgtgtgtgtgtgtgtgtgtgtgtacaatttaaatatctttgtaactaaaagaaaactcaagtatttatgcatatttattttcaatttcttcatcaataaagtttttttttcctcataatccacagggacacttttgaaataccacaaaggaattctgaggatatgaattaccatcgtttggatggtggctccaatttgaatgaattatgatcacaattttactgggtgcatacagaagacacgacatacccattggtcacagtaaagcacacaaaagagtgtcaagttacccaagtatttatttgcagatatttaatccacggcagaaaagtgtcttttgttttctcatataaaattcaaatatgaagtaaaaatcttctattaatcatttattcatcatacactacgggaaatgtcttctgctatatgaataagaaatggcttttctcatgatccactgcttctttctggttcctaatttgctgtttttggcctcatttcttttaccattaccagcggttgcctagtaaattgtggaaaaaagagtaagtagagattttgaagggctgctttaaagtgctcccttggaaaatatgtgagattaacatctcttacctttcataaaatatagaacaagactctcttgaacttgtggaagtaataaccagctgttatattaatgcaaagtcaaaaaatcataacttaacaatatgaaatgaaaattagatggcattttaatggtaataaagattcactgggaacactgtgaaaacagattctaattatcgagaggaaatgtattaaaaagagaaggccaaacaggatacaaattagagcagtataagatatgagacaaaagtttatttcatttttatgtatttgctcaatactgataaaatgtcaggcattcagaagcccttatcaaagaaggggctacctgaagcaggtgtagattttgatctcctatggccatcagaatggagatctctcagagagctacttgagacagtgacagctctatgagctcagtaaaagtaacaatactcaaaatgttaagggaagactgggcacagcaagggtgttggcaagatttcttttcttggagaacagttgatttatgaagataagcaaggaggggagcaactacaagaattggtcaaaagaccctgtcatggacgttgggcttgaccagcaaggataattcaggactcacttttgggctttaaattgcctttcagacagagacccaaaggtccagccaggaccttaatggagttccatgcattttgctacccagatgggaaaaatgtgcttttagctaatcctatagagccttaccaatgaagaagggcttgcttgagtactttttttgttgcttctcctctttaaaaaaaaaaaaaatcatttcttgtgcagaaagggcagaaaaacagcatgcgagttgtctgcatgagtacctcagacctaccatcttttaaaaaaaaatcctttcacttctggtagacaatgtgttgagcaatttggtagccttaagaagaaacttcacagcaacaaaacattttaaggagaaaaacgttttcaaaaaagccgtggtgtgaaaagaaagatgaacatagctagctttttgtcctttttcagttctgagatactcttatcttccccacccccccttaaatgctgtaaaaggcagtcctgaatgcatcagggctcgttaacaacagcatctcattaaaacactttttggtgtacttcactgtgagcagattatcagaaatctatgttggaatcaatatgtttgtgaagaaaaaaaaaactgatatttcagcccccccccccccaaaaaaaattcttctaaggtgctgtacagttttgtagttcataaaaataattaagaagaccaaagctccaaagtagtatattaacttacaaaataacatttggaagggagaaaatagactatacatgcatgttttaaaattccattttctcttcttgcgaccaagccaaaaaaaaaaaaaaaagggcttctctgtaaacagtagttcattactcttttcatgtttagaaacaatgtttatacttctcacagtgatttgtttcctgtacatggtaactgggattaaaaaatgacagtggtttctatacaagaagaaaataattaaggaagcacaccaaagtgtactagttttaaataaggggagaaaaaacagattgaaatgaaaaaaaaaaagagagatagatagatataaaatcatgcactggggttgagctttgaaaaaacaaaaaataccttcgtcttcaccacggtcattactcgttatatcatctgcgtttttctttgtgttggctcctggggtcatattgagaaggaaaataaagggaaaaaagagaattcaaaaacaacaggttttcaaaaaattcagaaaagagagagatgctacccagaaaaagaaaaaaagaaaagaatgtaacacaaaaagttgaaatttgttacatttggatttcaaaaaaatgagatagggaaatgcaaaatgcatataaacataaagatgtcaagaagaacaaattcaaaatgttacttgcaaaaaatattagatatcctgtgaatatgcagttgggggttaaaatgatgctactgcaaaaaaaaaaatgctaacgtgagttgttttaaaaaaagaaaaaattaaattattagaaaagacatttcccacattctttaaagaaatgcttatggcgtattcaatggtcctctgatgttaacatgttgtaatttaaataaatttttgaaatgttactgacacattatggttagaaattttcataaggcaagcaaaaacacagtaaacatggaaggactttattcaaaatattatataattgacattaatttcatgcattaaaaacttataaacatgcaatctcaaaaagtcagaattgtgactaatttaaatcactaagatttacctctactctgtgtttagagaagcactacccactattcactcttgttttcttctattaaaatctactacatgcaataaatatttaagtcaggacaaaacattatagaccatgtcctatgtgtttaaaatagttattaaatatcatttgaaagttatgccctctgtgtgtaaaatagctattaaatatcgtttgaagatcatgtcctctgtgtttaaaatagttactaaatatcatttgaaagttattggtacgtgaatttgttgaagaaaataaaaatcgaagtcatctaccttgatcacctcaataagatctgcataggaattttaatataggcaaaatgcaggaagaggcccttaaggatagcaaaaaactagcttatgctcttagtgcacagagcaccattttggtttttatagtttccacatttaaaaggtgtgaacatttaattttgcttgaattaattaattggctccattgcttccttctcatagacagatgcagcccatatgtgcatatcccactatcaataactttaactgcgtcaatcaatcaagacagtctttgccttcctatagggttctaggataagcggattaaggcaaagggaaaatactgtcatctccaacacttgtgaatggaaaacactcctctgttctacataactcagaagagcttaaacatattttgaaaccaagacttgataatgctgtttccatatatcaaacaaaagtcaagtaatgtccatttcatgggggcttaataccttttaaaaccagacctgggtggtgcgtgggtgtgatagccttgctgatccactttctgtctttataagatttgccttctctaggcatttcatataaatgaactcatataatatgcggtattttgtgtctggtttcttttacttagcatatgttttcaatgtcctttcatactgtagcatgcatcaatacttcattcctttttatggctaaattattttccattgtatgggtataccacatcttttaaatccatttatttgttgagtgacatttggtttatttctacttgttgattattattaataaagctgctatgaacatttgtgtactattttttgcatggatatatgttttcatctctattgcatagatacctaggggtgaaattgctgtttcataaggcaaatttatgcttaatgttttaataaactgacagactattttccaaatcagctgcaatacctggcattctcaccaacggtggtataaagggtctctatttctctaatacctagccaacacttgctaatatccttttttgttataaccatactaatggatgtgaaatggtgtctcatcataggttttttttttttttttttcaaagtcttgctctgttgcccaggctagagtgcagtggtacgatctcggctcacgacaacctccacctcctgggtttaagcaattctcgtgcctcagcctctcaagtggctgggactacaggcatgcaccactattcctgtttaatttttgtatttttagtagacatgggtcttgccctgttggccaggttggtcttgaactcctgcctcaagcgatccactcatcttggcctcctaaagtgctgggattacaagcatgagccactgcacctggcctcattgtagttttcatttgcatttagctaatgtttagtaactaatgatattaaatatcttctcatgtacactgtctttgcagaaatgtctattaatttatttttgcccattaaaaaataatttctttccttcttattattgaatagtaagtggtttgtttacatattttctaaataaaagtcttttattgggaatatggttggcaaatctcctctcccagtttatggcttgtcttttggttttctcaacaaatagcactttatgttctcaatagtgccttttgaagtgtaaaagtttttaattttgatgagtttcacttgatcaattcttttaaggattgtacttttgaggtcatatttatgaaatctttcccaatccatggccctgaagaccttctcctgtgttgctgaagtttcctaaaagtttaagagctttaattcttatattgccacctgtcgttcgagttaatttttgggtacaataagaggtaagagttgaaattgatctttttacatatgaatatccaattgtctcagcaccatttattgaaaagactatccttgcctcctttaattgttttggcaccattgttaaaaatctattgactacaaattgaaggatttatttctaaacccttataattgacgcttgaacaacacagttctgaactgtgcagatccacttatatgtggattttcttctgcctctgccacccctgagactgcaagaccaacctctcctctccctcgtcctcctcagcctattcaacctgaagatgaggatgaagatctttaagaagatccacttctatttaatgagtggtaaatatatgttctcttccttatgattttcttaatggtattttcttttctctaacttagtttattgtgagaatacagtgcattgtatatataacatacaaaagatgtgataattagctgtttatgttattggtaaggcttccagtcaacagtagactattggttgttaagtgttgggggggtaaaaagttttaagtgaattttcgactgtgcaggggttctaaccttcacgttgttcaagggccaactgtaattaattatatttcattggtctaaatttatacccatgtgagttgcctgctatcttgattactatatctttatagtaccttttaaaatagagaaatggaagccctccaactttcttccccttttccaaggtctttttgattgctctagatcctttgcctttccatgaaactttccaaatcagcttgttagttgcaataaaaactcctgctgagatttcgatagaaattacttgccaaatcccaattttaaattaatcttgtatatcagagcctgacccagaaacataattagatgctgtctttcctgttctacgtatatttaatttgtttatcctttcattcttttttaataaactgctgctctatttgtccatgtaaatataactaattaaatgcctttaaaacaaaccaagttctcttgagtatctagtttagacacaaccatggactatgtaaatgcaggttttagaagattcaggaaaaacaatttgtctacagtttattcaagaataaacccagcttgtggctggcgcacacacacacacacacacacacacacacacacagcccaaataaaacctaggtaggctgtgagtttcctttatcttctctatgtctacccttcctcaaaattccagaataatattccttttcatacaacaattagcatctccgtaaaacctctgtgcagaactggctttaaatattaaagagaagatttaaatactccaagcaaaagtacaacaattctattattaaaatttaaatatcattttataaataaaatctcaatgtccctaatcctgaagaatattccagcttttttttagcctgttcctctgatgtccccatttagtgctttatctatgttattttcaaaagttagtctatttaaaatagcactttatgttatgaatgtaagagaaaaactttgtaaagaatttggaaaatgatatgggcgcggtggctcatgcctgtaatcccaacactttgggacgtcgaggtgggcggaggtcaggagttctggaacagactgaccaacatggtgaaacctcttctgtatgaaaattacaaaaaattagccagacatggtggtgcatgcctgtagtcccagctattcgggagactgaggtggcaggatcacttgagcctgggaggtggaggttgcagtgagctgagatcgccctgctgcactccagcctgggtgaaacagccagaccttatcacaaaaaaaaataaaaataaaaataaaaaaattaaaaaaaattggaaaacgaagactattgtcaaagtgaaaattaacatcaaaggaaaacctcacagtcacatatactgctgttaacattacaagtcagaaaaacaatttaaatctgtatttttaatatatattaattattgccacttatgtatctaaatcatcatagaaagtcaatagatacaaatgtgatcttatctaagcaagaatataaggaaataatagaaccaaaaagaaccttcagcattattgttctgcatgagatatcatattgaactgtattagtagttcatagtttactgcatattcgttttcttttaagtgggcaaggttaattttcaacttagtcttgttaagtagagaaagagactttttaagctaagtacattatttccacacagggaaagttgcatacggcggggggtgggggaggggcacggaaagaaatgttttcctggctatcacagatgtggatgtgattgattattttgtcacttggccatagagtaatatgggcttaatcttctaatccaatgcaatatccccagctctcggcagcaaggaagtgactggtatgtcctcacagactgcccatgacacatgggttcattcactcagaagccaattccttctacaaatatgtgttgacccttttaacatgcagtcccgactaagacaggtaatgccatgcagtcctggctaaaagaggtaatgacacacccacactgaagaaggagatgaacatcagagacagacatgcacacagatcattccaacggggcaggaaaatgcatgcatgaatttaggatcctctgctgttcctggtaggagagtctggggatagaggggtggctggtgaggaagtgggttagggcttctaaatatgcacagaagatctggggccaggaatacatttatgggagcaaagaaaacaggctgctctgagcagaagcatgggttggaggctgagggcacagaaaggacatgaatagccccagaaagatgagaagaacaggtacacaacctggacaactcctctttcctccatacacctggagaacagactctagctggggaaaatattccatgcatacacttgaaatatatttgagcctccacttgaataacactaccacaatgaatttgaaagatgaccttcagatgattttcggattggatcatttaccgatgggcttcacccaatgtatatgcaccttgaaaaattggttagcaacagaaaagttcagtttctgcatttgaaagaactgccatagctgacctatggcttcttttttctttttctgaaatcagaacacctgaacaggaccaaacttcactcttaatggaaatatgtataagataggaggcttattttatggagccttcagcaaaggggctttccagaaagcagcattcaaaaagatatttcttgtattataaaccctggcagaaaaggttggtaacaaagtgtcatgcctactgaaggtcatccttttgtgatgtgggaagaagcttttggtgaccaggaaggcttagaaaggagaacatctgggggctgagtacctgaaaattagtttctttaaaatcatcagcagagtcatactttgaaaaattttgaaaagacatctgccagtttgaagaccccagttccagggcacataactactagatagacaattgttgaattacagggtgtagtccactgacaggcaaaaggttcccagttctacaatcctccccatgaatttactattcctcatacatagagagtctgtactttcaccccttgaatcttgagtggctttaagattgcattttttcaaaagaaaaaatataatgatgtgctgtttccaagactgggactcaaatcccctgtacctattcttactctcttgaaattctgccactgtcctgtgaaaaatcagactagcaggttgcacaacaaaagatctcatagagaagaacccattggccctaacctaggcaaaattacctccagcaacccccaattacctaagagaactcactccaaatcaacaatgcatacacatgaatgagcccagccaagaccaaaataaatttccagctaacaagatgcagaggctcataagcagtaataggcgcttattgtcttaaggcattgacttttagagtcctttgttatgcagcagtagctaactgatacatagggtaatactaattttatcttcagtagatactggcatatttctttccaaacaagttgtattatgctatacacccactagcaggtaagaaaatttcctggcccttaccctgttgccaacacttgacattatcagacaatacatttgccactttgatgagtataaaatattaacagtttatatttcaatttgcatgttccttaaaactagtacagatgcatttctatattcccattctaaattcccatcttgaatagcaatccaatttttgactggctgaatgtctgttattgatttgtaggaaatctttatattcatggatgctggcctctttttgagcatgtaaaagcaaacatttaacagtgcatagcagtgctgcgtatggttctaagggctttatgcatgttgaatatgcattttgtttgtttgttttttagagacaaagtcttgctctgtcacacaggctggagtgcagtcacacaactgtagcttaccgcagcctccaactcaagggctccagtgattcttcgacctcagcctcccgagtagctgggactacaggtgtgcaccaccacacctggttaattttgttctatttcttgtagagataaagtctcactatgttgtgcaggctagtcttgaactcttggcctcaagcaagtctcccacctcagcctcccaaagtgctgtattacaggtgtgagccactgtgtccagctccgaatatgcaatcttcataaataccttatgagatgtgtaactaatatcattttatagctgaggaaaattaggtatacagatattaaataatttgcccaagtttacacagttgagcattggtgatatctagtctgttgtctttaaccattttattgatttttaattatctaaactaatgctttaaaatgcataagtattataatttatcactattttctctataatttctgctttttttaaaaaaaaaggattacttaatccagaaacataaagacattttatttgcttacatattctcctaacagttttaaggttttatttcacatctgggtcataactcacctggaatttatttatctggatgctagagcatagagattattttaattatttccttagagaacagttccattttcagctacataggtattacagctctttacttacatgccaagttttatatctgctagattctgtttctgcctaccttgttctgttctatttttctatatacctagcctgtcttattttatctggtttacagataaatgatagacagatataattgcttaattgagatataattaatataccatacacatcaccgtgtcaaagtatgcaatccaatggtttttaatatattcatggatctgtgcaataattgacaatatctaatggcagaacattttcatgatcccccccaaaaaaatatggtaccatttagtggtcactctcagcccctggaaactacccattcatctgtgtctttctggatttgcttatttggacattccggatgtggggggtgacacactgtccttattcttagctttcattataagaggacttgaacacacctacatgcaaccctgacaagcttccatgaagagtctatactagcctgttagaggatgatattccacatggagcactgtcaagcaccctgttaagatagtgcttggccaatgagcacccaacagacctggaagctgactctagactgaagagcctcccagctgagcacagcccagatgtccagccaagaatcataacctaaatagaggttgtttgagatgcttagctaaataaaggtggtttgagatgctcggctttgagatggttccttatgtagcaaaagctaactgatacactaccaggaacatggcttaactcatttcatcatcaggtttcctttagaacttttgggcattctctgctgtttctcccatctgcaaagcccatatgctcctggaagattcatttttactgatcagcttaaattccatttcctcagaaaggcattccctgttcatcccaaccttccattcgtaaatgaacttgggttcctcaattattcactgtagttggcatttttcttcacaagatgaattgtaatgtgtaatatgatatcttgttaaataaggtctccctgttagattgttagcaacaagaaaaaggtgttacctgtgatttttcaacaccatattccttaatttgcaatgactaccaaaatattcagcacatataatataagttacatggtaaatatcttttggatgaatcatatatttttggctgcaagcccacctctattataagagtcacagtcataacagctatgacaaccagtgatgaatacagcctttacgtaacaagtgtaactaattctcctcttcaagcagggaaatgcaatattgtatcttcttatttaactttgagagtagaaattaaattataattcatgacgtggcaataacatgattttggttagcatattgtatataagaattctgccatttgtcatttcaaaaaacaggatgaaatgcttttgtgatgccagtaaaagcaaggtctaattctaattttctactagctcaaaaatgcttcattgtaataatggaagtaggattttctgtatttttcttgtttttctcttagtagctttggaagacagactgagagaaaaaggtgaatagtaattttcctttgctgttttgctggatttagcaataattgatttcacacttttacaggtaggaatcaaaataaatctaaagattttatgggtctctgacatattcctgtgcttactattagagtcctagagcattgtctaactttccataagcactttttgttgcaaattttactattgaaatgtttctgtcctcagaaatgaaatacaaatcctattatatttacatgagcctttcccattttttttttagaattttcagctgatagacaatattatctcgaagaatctatgagcttgagattaaaccacagtgtgtttaaaaataggtactaaataatgtattttgctaggtatttttaaatgtatgtttattaagaaaagtcatgttgagaacataattgactttcatttgtcctaagatgcttgttgaaatgttgtattaaaaacctaacatacccatagaggttttatatatatatatatatatatatatatatatatatatatatatatacacacacacgtacacatatctatacatataactcttgaaatgttgtactagaaacctaataatgcctggcgcagtggctcacgcctgtaatcctggcactttgggaggccagggcaggcagatcacctgaggccaggagttcaagacaagtctggccaacatggtgaaatcccatctttactaaaaatacaaaaaatagccagacatggtgtcacatgcctgtaatcacagctacttgggagactgaggcacaagaatcactagaatccaggaggcggaggctgcagtgagccaagatcacgccactgcactctagcctgcacgacagagtgagattccatctcaaaaaacaacaacaaaaccatcaaacaaacaaaacctaataacttctatgcacgcgcatacacacacacacacacacacacacaaacacacgtatatatattaacctctacaggtatatatatacctgtcagaagttattaggtttttaacacaatatttcaagaggtaacttagggcaaataaaagtcaattttattttcaatgtgacttttttaaataaatagtcataaaaaatacctaacaaaacaaaatatgtgtgtatatatacatacacacatacgtgtatttgtatgtatttactatatatgtaatatacattttcttatatatgtacacatattatacatacatatattttttccttgttatgagattgtggaaaagtttgcgttctgttgcatcatacttttctccgtagtcaggacacagcagctgattaataggtggaatttctgtcacaggactttttggtggtgtgggacaaggattctgaagggctggcacctttggtgaattctccttttgctgtctatgtagcaaaaggagacatctaaaagcagcccaactattgttcctagtcaaatcattcacaactcgcccttagcgtttcttgtgtgtgtacctgacatggtaaatggttctagtcattccagaaaaacaaaattagtctagatttatacaaaatcatcccgctcttcaatttctgagtatgctgtaatagaggctataaaggcaattgatttcaattaagagccctaaaatatatattttaagaagcataaggtcactcaagtatttggaagatagagtaattattactgcccacgaaggcttttgctactcttttgaacttagccaattcaccataatgaagaggttctttattctgttcagttaaacactaaaggaggctgggcgcagtggctcatgcctgtaattccagcactctgagaggccaaggcaagaggactgcttgaacgctgaagtttgagaccagtctaggaacataatgagaacctgtttctattaaaaataaataaataaataaataaataaataacaaaatcacacaggtgtgtgcctgtagtcccagctgctcaggaggctgaggtgggaggactgcttgagtccagggattgcaggctgcagtgagctataattgtggcactgcactccagtttaggtgagtgagaccttgtcaacataagcataacttaagcatatgtcactcatctctctttcagtgtgactgtgttcactcattttgtgtagtgagctgtattattggttcaaaatagttcctatcctttcctggagaggtattattcttttcccaccttctaatatcagtctacctaagtaacaagcaagtccacccacaaccgacatgaacttcagaaaaaggaaataagcctttgttgttacaaactgctaaaattgtggaggtttttttatggaagatttttagggttgcagaactatactgtgtgatactgtaatggtggatttatgttattacggatttgtctgaacccacagaatgtacaccaccaccaagactgtagcctactgtaaaggacggactttgggtgatgaagatgtcagtgtaagttcatggattgtaacaaacacacccctctggtgggtgatgtggaaaatagggaagaccgtccatgtatgggggcaggggatatatgagaactctctgtacgttcccctctattttgttgtgaacctaaaactgcgctaataaagtcttaaaaaagacacacaatgtagaataaaagacaaccacagtcctctcaggaacactctaaaggaacacttagggaatcatttgtgatttttcatggagtaaaataagatgcagtttctttattacagagacataagaacagtctgagataaaaaggatgcgttggcaaagcatactccaataaaatataaagtgtattgaaagaattaaaatccagaccactcataaggaaaaatacagaaacagatgtaccttagatctgagtaaagggacgcaaccagtgatatacaaaagacactgcaaaaagtgattgtttcaggagatactatgtgaacactgcatctactgaaaatcaatatatttgcaaatcttggtcttgaggtaaagataatttacaagagaataaccataagaaggtgagactgtcaatagaaaaatctatatgatcaaattctgggcattcactcaggtgtaaacacctttagcacccccaagcacagaaaatcctaaaagttcttcatccaaaacgcagttcaaaggccaagaacactaaaatgtaaaagttacttgtaaagaatcttaacacgttctgattattcctccaatgatcattataataaatagcgtaaaatattaaattaaaaaaaaactatgcagtgacctaataaggaattaggttgactctacaaatacagtaagatggttcaatgggaagaagtagggtgttttgctttgtctcattcacagttgaaggaaagaagtcaggtgatagctgagggaaagatcaaaggagaaaaaagctatttgaaagatggcaaatagtatctggtactattaatgtatttaatttaaaaagtagagtacatggaatatttattttggcaggaaatcctttttaatcttatcaacaaataggaaaagaaatgttgcactaagtgaattttcactaaaagtataaacagggcaatgatgttcatcatcaccatcatatttcaagatacttctacagactcgaagcctatatgtttttattaaaaagtattgagaactgaaaatatcagaaagaaggagacaaaataaagtcactcctgcatatgactatccaacaagagaaagagaatctagagaatcagctaaataatttagaatgagtcacttattatttagaattgtataaaattaacacaaaatgatttgtcatatatatgcacataaatatatttgaaaaaattctttgcacattcatgataaatgttctagcaataactctaagaagtgtacagcacatgttacataaaatatataaaataacaagaaacataaaagaacgcttacatatttaaaaacattcattgatccaggtataaatcaagagtgtaatagtatcgatacctcttcaaaataatttattactttagaattcccaataagatctttggtaacagaacaaaatcattatatattgatgatttgaataaaacatgaatgttaagttgaataaaacaaataaacaactacagataattatagctggaacaaaggaagctttttcccatcattacattatttatcccactagtgataatttgaatacaataaagtcattctttttaaaaagtaccattagctaaaaatttgaaaaaagagggagttataacaatctcaacttaaaacaaaataaatatgaattaataatgtatgcttaaaacaatgagcatgtttgttgaaatgtatataatgctgaggttgatattgtgaaccaatgtatatttattaataaagaaggcatttattaatgaagatgatggcatttttgctgcatatatatatgcgcatagacgattatatggtcagcttttacaatggtattctttaaatgtggtcatgagtatgtacaaaaacacaaatacacatatatgcacatacacttttatcacattaatgttatatatatactatatatacacataaacacatatatacacacactgttacaatcatttgtatatattataaacacatatatatatacacatgtctgtatacatacatatatagtatacacagaacctaattgtgtataaaatgtatatataatgtatccataatatacattatatactaatgcttacattatatataaatatataattatacatacattatttatttcaataaataatagaatcatttaggatatatacacatatatgtatacttttgtgtacacatatatacatatacatttttaataaagaatgacattactcaggaaatatatacataaatcagaaaagaaagatcactgaaggtagtcaaaaaagtaagtgacatcgtgacagtgaaccagtagtggtcttagcaagtgtgggaaagagagggaaccaactggtaaagaaaacatgaaggctgaggcaggcggatcacttgagccccggagttcgagaccagcctgggcaacatggtaaaacccagtatctactaacaacacaaaaattagctggtcgtggggtgtgcacctgcagtcccagctacttgggggcgctgaggtgggaggatcacctaagcccgggaccaaggctgcagcgagctacgatcatgctactgcactccaatctgggtgacagagcaaggccttgtctcaaaaacaaaacaaaatttttaaaaagagatggatgatggagtaggaagatggaaatatctgaaaggaatcagacgcgattgaaaaatacctttgtcactttagcagccttgcagaggctgttatttccagaataattcacaaaaagagctagacatggagacatatcctggcagtttattgtaaaattagtgaaataaagaaaaacaaacaaaatgtccaggattgagggagaaaaacaaaaggtgtctctacaatagaggacacctttggaggtatgtgtgcagattatctgcccactccatctaaaatgaggtaggtggtccctgtgtctaaggtggtgaggacgtgcaccactccaccccacatgggccctccatactcctggctgggatctgagtgcaggtgacttggatgtaggcctcttgggtggctcattttctcaaagaagccaaacatgctcaaagcagcatgcaagtgaaggctgagctgagaaagcctgggcccctggaaggaaaaacagcctggtcatgggttctgttcttggttcgtggtcccatgaaattcccgctgtgccctgtcctgtgcttccaccagctgccattgctctcaagccctctgtgctctgttggtttgtttgcgatccactctgtgaaatgtctttatgaccacgctacaaacacgcacaatttcactcaccttagaactctctgacacgagacgcagttgataatggaacaagatctaccatgttttggtacaaaacctttcccaatctctcctttgaaaaggtatttttagagattagcatgctaagaaagtccatctaacttaggcatagagtaaaaatcacaggataattcactctaagaaatcaagctcagggcaactccaacaagctcaagaatgaagtcaggattcaagttaagaatggggaaggtatggcctggaagcactgatgattcaagactgaagaatcatcatttcaaagatgttattaaagaatatgagttttctaataatcgccattctgacttgcgtgagatggtttctcaatgtggacatgcaagtgtatgttcattgcagcgctattcacaatcgcaaagacatggaatcaacccaaatgcccatcaatgattgactggataaagcaaatgtggtacatatacaccatggaatactatgcagccataaaacagaacaagatcatgtcctttgcagagacatggatggaggtggaagccattatcctcagcaaactaatgcaggaacagagaaccaaacaccacatgttctcacgtataagtgggagctgaacaattggaacacatggacacagggagggaaacaacacacactagggtctgtcagggagggcggggggaagggagagcattagcataaatagctaatggatgcggggcttaatacctaggtgatggattggtaggggcagcaaacccccatggcacacgtttacctatgcaacacacctgcatgtcctgcacatggatcccagaacttaaaataaaataaaataaaataaaattttaaaaaagaataagggtatgccaaatgaacattatttttgcatatagatatttgtaaaatattaagaaaccatgtacaaaagttgtgagtgataattcaaaaattcagatgataacaggaggatgtaaagtgaaaggctggcagaatctgccaccccagaaatgctatgttggtgtatggtcatttaagctccaggccaggaaaggggaggggaggggaggggaggggaggggaggggaggggaggggaggaaaaaaacagcaggtacaagaaagctgctctgatcctgttttcctttctgaaagcaagagatgaaactcctgtatggactgtgccctccctataccagaaggaaaaagcattcttgtcattgagaaggggaggctgaaataagagaattgtgtactaaaagaccatgttaaaataaaccacatatttctttagcctccacataggttagctacttttccatcatcgtctgtctttgttcaaccttctctaaaagcactgaagtgtcgccacttctttgagtcttcgtttccatctgagggttttctcatgtcacagaaaccttaaattacatgggtttgtatgtttttctcctgctgatctgtcctttgtccatttaattctcaggaccatcagaaaaaactcttaagagggtgaaagtaaaattatgccttctctacaaaaggaaaaataaaatggggggggggggcggtcacaaaataccttaaagagctactcaaatgaagaaaataatgccaagtaaattttttaaatcttaaaaatggctctggatagaatgcagggtatgttatcatcattgtgattacttccagtgctgtaatgaggagtgactgtgctctccacaccgttcaccatagaaactgttgccttcctcagagatgctcagaaaatactcatgtgcatgaatacaattaatgcaatggaatgaatcctttcagcgccaggtaaatcctgatgttggaaccaggatccctggtttgggaaaggtggcagagaatctatctttctcccacttcagagccacagaatgcttttggtaggaaggtaagcttcctcccactgtaaaatgatagcactgaggatagtgaacaagaagacccagtgttgccctcagggagccttatgcaacaattaattcaataatcactaaatcactgaattcctgctgtgaaaatgttattaatgagcatgtagacatatacatgtgtgattacagatagctatagagatggattgatacatagggattaagaggtctatctatccatctctaccatctatcatctacctgtctatctatccatctctgtcctctacctacctacctgtctgtctatttacctatctacctgtctattcatctctatctaaatttatatctacttatttacctacctatctatccatctctatcatctatccatctctaacatctttatatctaccatatatctacctgtctacccatctctatctatcatctatccatgtatccatatctgtctatgcatctatgtatctatctgcctttctatcatttatctatccatctctatctacctatatctatcatctctatccatgtatctatccatcgatctatcatctatccacctattcatatctatctatttatctatctattcttacacatatatcatctatctacctttctatctatccatctccatcatctattcacccatgtctgtctgtctgtccatctatctatctatctatctatctatctatctaactatctatatctatcaacctacctatctgcttacctatttatctcctggtgaccccatcttctctaatgattgagtactgaatattactcctagcccaagatgatctgaattaggagttaaggagttagaaaggaagttgtaaggaaatattccagaaaaggtgaaggagagtccccacaagatgagaccagaggattgggcagtgtcaggtcatgggcaaagcttgacggggtgtactgtgttgaataatgtcccaaaaattcacatccaccagaatctcagaatgtgttcctatgtggaaatatataacaccccacatccttatctatgaggatatgtttcaaggcctgaaactgcagctagtatcaaattgtatagatactatgttgtctcctatgtattaatgtctatgataaagtttaatttataaattatacacagcaagagattaactcttaatatctcaagagttaactgactaagcctagagattaaatgatcacagggaactgaaaccctggaaagcaaaaccatggataaaaaggtactactgcagggtctttgcagatgtgatcacgtaatttctttggagataaaatcatcacagatttgcagtggtccctagacccaatgactagtatccttttaagaagaggagaggatccagaaacatatggagagaagaaggccttgtaaagatgaagacagacattgaagtgacgcttccaagaaaagccaaaagttaaccggcagccccccagaaagtaggagagagacaaggaacaaattctccctcggaggctccagaagaaaccaaccatgccaacaccttgattttggtcttctggcctccagaaccgggagagaatatatttctgttgttgtaagtcacccagtttacaccatttaccacccagtgttaatatattatagaaaccctaggaagtttatacattagagcatttatgactcagaaggacctaataagccatgccctcccgtaatcccaggaagttgaatttgagccggacctatgaggttgatagaagtcatcccttgagtgtattacattacctaggaaataggatgggatgccattgccttgattaggttatgttatctaagattattttattagccgactggaagtaagagattctcctgctggacttgaagatacgtgtcgccgtattgggagacagtccctgagatggcttcatggcaagaagctgcctgggggacctctaggagctgacatcgacccctgctgacatccaccaagaaagaggggacctcaatcctacaaccaaaataaaccagattctgccaatacctgagtgaccttggaaaaggaccatgagcctcccgagagtcatgctgcccagccgacaccttgatagcatctctgtgtggcactgaggaggaaatccagctcagacatgcccagacgcctgaccacagaaattgtgacataataaatgtgtgtgattttaagccactgagtttgcagtaattcaatatgcagcaaaagaaaactaatacacacaggcagccaatgcaatcttactcatctattctctttctgaccgcacatcaccagttatgtaaggaatctgtttagccagccccacaaattccctgaaatttcaggtaatgtgaattctgttagggacccaagaaaggcaggacttgaaggcgtgccagccagcaccagcaagccatctggagttcagcagtctgcacgggcatttgggctgcctgtcagctgtcctgtggtgtgggggcagtacgcagagagcatccccgtctgttcaaaacacaccaaattggccacctccatctctacaggccaacctgtgtatgtgtgcctttcccaactgtttttgttatatttagaattgaagcccctattgggattaaagaatattatgtatcccatgataccgcaactgcttctaaatgtataacacagaatgggcacagcagcacattatttctgcacatatcagtagattccatagaagcttctgacatcacaaattataacagagttcagaaataaaagcagtacctggattggttctgaggcttccctggtgttttgaaaacgtttctctggtgtgaaaaagaatgtttcctcgcttcttttaatttgcctccttccacttttaattcactctcctttctctacatcagctccaagtgcctcctccaaccctactgaggcaccacacttgctcagatggacacccaccatattacatgtgaaattataatggctggaaagcccatgactgaggctgatgagacaaagaaatccccccatgagactgaagctgcgctgtctgccaagtctgactttgcccttttggtctgtgaaaacggaaatctggactaagatgggatgcttcagtgaagatgcaacaattatctgcatcctcaaatggcgtgtacacagagtaataacccgggaaggagcaagcatttccatttacagcatgaattcaaagggaacacaaatcactcatttagcagcttgtgagcagtttaggaagatcatgtttctccacttgttcatgcagcagactggaactccacgagcatgctggctcagggcatcacagagctgcagcaagcacctccagccacacacaagtggaagatggccaatgggtttctcagcgctcagatggtatacaatcatcacataaatgagggggaagagagagcttttttataggaggtcaaatccctgcatttacgggcatatgactatgcatttccatccagagagatggcaacctttctgatttacagcataaatcattactaggaagatcatttagaaaacaccacccaattttccagcagcattttataaacatcatccaaattgactctggctcctccaaaaggaatctttcagtgcctggcaccatgctttactgagaaagctttcaaaatttttgagctaactaagccattcaaagcagaaatactctatttcagtaggatgctttcatggctattaaacagcaacatcgggaaataatcattgcagtcaccatgcattatcacatatgttatacatttcacttgaaattctggtaggtcctttcttttatcattactctgcaacagagccagctttgtcatcaaatagagtttccaaagagagaaatgatctacaatcacgaaagcacagcagccactaaaaatcaatagctttaatgcactgttagcatgagttaagaagcaatggctatccccaagtgaaatcattacagctgccacttagtcaagaaggtgtttaatacgtgcaactttttttttatttatttttgtccccagattagaaattgacatattcattgcaggaataacattagctacattttaagtttcatcatctttacctagagaacaaaaatgtgtgttccagttgaccctattctgccaacaatactatcagaattcctatttaggatgaagataatggtataaatgtaaaaacagcagccaaatggctcggcactatcacacctataaacccagcacttcggaagaactaggtgggaggatcgtatgaggccaggagttcaagaccagactgggcagcagagcgagaccctgtttctacaaaaataaaaatagaaaaattagctaggtgtagtggtgcatgcctgtcaaccaagctacttgggaagctgaggtgggaggatcacttgacctcaggatttcaaggttgcagtgagctatgatcataccactccaatctgaaagacagagcaagaccctgtctctaaaaaaataataataaataaataaaatcaacagtcaaaggggaattaatttttttttgagatggagttttttgcttgttttgcccaaggtggagtgcaatggtgtaaacttggctcactgcaacctccatctcccgggttcaagcaattctcctgcctcagcctcccgagtagctgggattacaggtgcacgccaccacacccagctaatttttgtatttttagtagagacagcgtttcaccatgttggtcaggctagtctcgaactcctgacctcatgatccgccctcctcggcctcccaaagtgctgggattacaggcgtaagccactgtgctcagcaggaattaaatttttaatgtggctctctagagtgattccatgccagaaaaaaaccctgggattctgttcctctacagactactgtacttctcccaatggatcaacagagcaatcttctgttttccaattgccagcaaccgtagttcaggttgtcacctacttagctgtctcaggtaaacacatctcaaaaagatggaaggctgtggcaggcagacaaaacccttcaactgcctgaagctcttaaagatcaagcattggggctgggcgaggtggctcacacttctaatcctggcacattggaaggcctagccgggaggatcatttgaggccaggagtggatgatcatcctagtcaacatagcaatactccatctctacaaagtaaaaattaaaaaattagttggccatggtggcatctgtagtcctatttactcaggaagctgaggcaggaggatcacttgagtccaggagttggaggctgtggtgagctttgattgcacctgggcaaaagagcaagacactgagaactactatagggtgctggttgtgggggggcttacaaaactacctattggatgttatgctcactacctgggtgacaggatccttcctgcaaaccccagcatcaggcaatatttccatttaataaatctgtacatgtatcaaataaaagttgaaattttaaaaataataataaaataatgaaataaataacattctgcaaattatgcaagagaagtgtcatatttttatatttaacacattaaatataaaaataattatctgaaaaatggattattctgatatcagttaaattattcaagttgtagaggatttgataaatgatttaattaaattgtgtagaattacacggtggttgtatctaaatacctttgaaactgatgctgccaaagatttgttgaattctttaattcattgtctgccatgatttgatagtccaagatgttggcaatttcttacctttcatattggtttcctgaacttcatttaaaaacagaaaaggaaaagaaagatgtcaacactactatatcatgcatgaatgatacattaatactgttggtgctcacagcctattactattttatccattcaaaatgaagagtcttaaggccattaataaagagctgtaattttaactggacaatttcatgctgtaaaaagatgggtaagtgggaccatatgagtctcagcctaagagatttaagataaaacaaaaacaggccaggggtggtggctcacacctgtaatcccagcattttgggaggccaaggtgtgtggatcacttgaggtcaggagtttgagaccagcctggccaacatggcaaaaccccatctctattaaaaatacaaaacttagccgggtgtggtggtgcatgcctgtagtcccagctactcggaaggctgaggcaggagaactgtttgaacctgggaggcggaggttgtagggagcggggatcgcgccactgcactccagccagggtgatagagggagattccatctcaaaaaaaaaaaaagataaaacatagatcaacatcgtgtaagtgcccttttgttttgttttgctttgtttgggctgaaggaagaaaagagaccctttctatcagaattgtctagaaacatgcgttaattggacagttaaatggatatgtgtaacatgcaccattgctttgagaccaaacaattagaaagagatgacaggggactggccaacactgcattagcgtcttttagtcagatagtgtgagttgacaggctgaataaaaatacagcaaattgggaccagtccactgtgaaggtgaatcctagttatgaatctaacatgtgttgacttgaatgcacagtttcagaacatttcctaagtcaccaggaaagaaggaagaaaagcatcaattgacaaaaatcaatggaaagcgatggatggcctctgcatccaagcaaacgtcagcaggaactggatcagtgtacagatcgacacattccctagctcctgggaagtgactttggcgatgctacgaaaatttttaattattcagatttaatgaagtgaagcagcataggaaaatgagaggcaacaaattattacacttagcatgaaagaggtacgttgtcaatggtgccaatttgaaacctcaatgtggcttaaatgaatatatcatattgtcacaagatcacattttgtgatcatcaatcattccaaaaaggagtttcataatgttgattgagtgacgtgcatttgtagttgttgatttgcatagactaagcagtagtgttttggcagctttgagaatagggttcctacaaaccttaacgtgagaaaagagattcagtgatttgtctagaggaagcttgattctgccaattcaagttcaaagactgcaaagtgcattggtgtcatagaatcagaaataattctcaagcacaccaaggcagagatgaccacacggacagctggatgaaaaactgggtagagataaaaatctgtaagaggcttgaatcatttagattactaagaattagataaattagatgaattaagaataagatgagtaaaaattagtgaatatcatattaatcgttcatcaagcagattaaatcacaaaatgcctttcatagtggaagaacattaaaatgcacatgtatatatgtaagggtcacaggttttattaatatgctgtggtcattgttacagacaattaggctaatttagcttgataaatctccatttaggttcaaagttcttgtttgaataagatctacttaatatcttctgccagttcattacatgatgtaatctaagggaagatgatctagaaatagaccataaaaaagaagcccttgctcccaaattagtgaaataatgaaagtcaacaacaatgaaaatacaatcaggtgagcccaaagcaatttacctacacactcaccatcagagactatataaagtttatacctaaaaatattctcaatgtaataggtctgatcaactcatcatcacaagataagacttcatacatggggtaatgaacatatccggtactgaaatatcataaaaatacgtcataaacacattgcaatttttcagaagggtatataatcttagcaattttgggcagaatttcagatatcttagtcatatgaagagaaaaaaaggcctttcagtaagccattactttaaaatttgtgtatacatgcacacacacacacacatgttcatacacacatatatatataaacacatgtaataattgaagcattgatagcttagaaatagtataaattgcagttctcacccctatggcaaatttttaacagtaaccatttgctgcagacaagtttgacgttgtcaatgtgtttaagatactaaatctgtgattaaataatggacatatttcccaaaatttactacaaattgatcatttaaaattccatgaaaattaattatctcatcaaaaaacaaaagcaacagaatatggagcaaaataattattttgtttaaatcttctattgagatccttacttgcatagtttgctggcttataaaaatggcacattcattgttagaaatttttattttagcatatgataagaaaagggaacattatgtctttttagggataagagttaacaacttacttaacaacttacaatgttatatttaaaaataaaggattgatactgggcacatttcagttggtaacttggtacattagagttttccctggaattaaaatcattaaacataatttaaactgacaagataaaatatgatcgttgtacttttattcagatattttgtctatgtagatagcctgaagctctatgcaattatacaacctgtttaaaaataataaaaacacttaagtgacaatatacaacagaacatgatatggatttaatatgatggatgtgtttactttcagtaaaataatgaatcattcatgatttagtagaaatataatctcaaagtacctcacctttcgtctactgaaagatgaatcacaaaaatattttatagtgaagaaaacacaaggaattcataggagatgactattgatcaaagtgaattagattttggaattagctaaaaaaaaatatgcatttggtatacttattgaaccctagcagagttaagatgtgagctagaatgactactgagtacttgggaaaattccagaaaggtactgaacatgatttgattttctttgcagctgtacttcttgtagagtagaatggaaattcatgatccaagtgtgtctacatgtcagtctctacatttataaggcagagcaattctctggtaagagaagcgaagccaaacagccattcctgggaatactatccaactcaacactgattagagggtaacagcacatgagaaaacacaccacccctgacagcgtcagcccacgctgatgatgttgtcttccatttttcattattgttaaaacccataatcagcaccttacaacatctgtgttgccttgttctctaattgtctaccccacacacggtggcagttaattatacattatcttatcctctaattgctgtctgccttgggtttctcagcaagacgttggctcctcctgaactgcttcgaaacctgtgcccctgtggtagcgactgccttacctgcctagtgcaaagtacttccaaaaaatactttctgcttgataataattaatcagtgtcacaatacctaatggattgtgaagaggtcatcttcagctgagacaccaaaataagatcttgaccccaaaatgaggacaacttatgccagccacttatttactgagaaaaatacattttagctatttcctgtttcaacactgtatgatttcactgtcatgtcttgtttactttttcatcaaactaagtaatttttcagcatggcatgaaacctgttttctgagccaaaaaatttcaacaaaaagtctaatattttaacagtcacctacataattatatagctgccttcattttactactcttggataaaaattaaatacctaataaatttcttccatttttgtggattacatagctgtggtaatatttttgctacagataatacaaaactgtatctttaccttttttcctattcactgctttcatttcacaaattcatggttcacattctagggcaaacatacaaaattgtactaacacacacacagagttatgtgggaaaaaggtaactgatttactctttttgaggcctgagatcatagacatacaagccctctgaatcttgtagaaagtgacaaatggttttgtttcattcgtttgttatttccataatgaggatggtggtaccgaatcttcttttcttagagttgtggagtcatagcagatccacgatcctttagacaccctcaattctaatccagccttaattcttgattcttccttggcaaaactccaaccctggtgaaatccacctccccacccagcatgcatccgcctcacctttactgatcagcacagatgaaagaagatatttaatcatgctgacttatctcacattaaattcatgaacacaaacctccagtaggttaatcgagatgcctgtatatcatactaaatttctctgatgaattcccttaaaggctctgctaaatagcaccttcttcttcctcttctaatccccaatccctcgtgctccatcttcactgttagaatatgacctggcttcttactacactgaagaaattctatctcaagaaaacatgcacaaaccaccactaacccatttacccatgtgacaataatggccccatcttttgtgcctcctcttttcataagagaataatgataggaacccaatataaggctgactctcacccatcaaactccatcaactcttgacaacccaacaatagaacaccttgctcttgctatatcctcagaattgtcttcctcttgtatgttgtattattgtgtaaaaaactgtccacacctctcaaggggacaaatacacacttgcaagactttccctgtccctaactcgaaagaatttcactgactcacttccatgacttcagttatagctaattgacttgctttggcagatgaaacatgaacagaaattagtggggctacttccaagcgaaaaccttaagagctataatgtggttctgcccattttccccctttgctaaaataacaaaaataattagtaataataagaataaatgagtcttctccatcagcccgggtcccagaattaagaatacacagaaaacagccacagtcaacccttagcgaactttgaacatgagcgagaaatcaactttagtggctgtggatgtcgctgccattttagggatatttgttaatgtagcacactatacactgtactgattgataacaccacgcctctagatcaaccctacagcacacagaaatgtggttagattttccatcttaaaagcaataaaacaattttctcatcttaaaaaaaaaagtgtgtctatattgttccttttctgaaaatatccttgaaaatatttattgatattgattccaattttattgctcttattctctctgaaacctgccccaattggggcttttacccccaacactccaccaaaattattacttttctactaaaggtcaaaaatgacatttgcattgctatgttctcaattttcctcattcttttttcccctctgtctacctctattcaatctcaactgccacaatcagacagacaaaaggacgaggacactttttccttgcatctgtagtggaaaccatagcagcagatgtgcattttatgacctatttgaattacacccagttgactacctctctgtcattgaaatgcctttttccccccttcacttccacattaccagactttcttttacaccctggacaattatgttcatttcctttccaggttcctcgtattattaccaatctcaaattgttggcaagctccagccttggtcctttctcttctctgtccacagaactctcttgataattttattccgcctcatagctttagataccatcgacactatctaggctgacattttttctcttcagcacagatttctgccttgaacttcagactctgacatccatctccttatgggatatcttccgtttgatgtctcatagacatttcaaactcaaacatttaaactttgatgataacttaagaatgtctctactagcccatcctccaatgtcacctgtgaccacctctaccttttccagtgtttaggccaaaaactctggacttccttcgatctcccacactccacatccatataactagcaaatcttacttcaaatgtataaaaaactccaaccacttctcacctcccagctgtaggttcttatcttgactcttacatcagccttctaactggtctcccacattccacctttgcccctacagacaagcctcagctaagcaaagtgctcctttaaaacacaccttgacacatgaattatctgttgaaatccttccatttgttctccctggttctcagaattacaaagttctcgatagcaccaccctactctgatacctgccattctgatggcatactctgatactctagaaatgtggatcttactgcttgatatggtttggctgtgtccccacccaaatctcatcttaaattgtagctctcataatcgtgggagggacctgatgggaggtaactgaatcatgggggtgtgtctttcccatgctgttctggtgatagtgagtaagtatcacaaaacctgatggttttgtaaagggactgcacacgctctctcttgcctgctgccatccatgtaagacatgactttgctcctccttgccctctgctatgattgtaaggcctccccaaccatgtggaactgtgagtccactaaaactctttcctttataaattcccaagtcttgagcatatctttattggcagcttgagaacagactaatacactgctctgccctaaacagaacagggatgttcctaccccagagccttggcactggctgttccctctgcctggaacatccttctcatatatcatcatggctttttcccttagctatttcaattctctactcccacatccccttttcattgaggttgtcattgaccaccctacttaaaatactgcaacttccctagcaattctaattccacttatcctcttctagttttcttcacagcactcatcaccttataaaataatacaaaactttggccacgtatggtggctcatgtctgtgatcctagtaatttagggggccaaggagggagggttgcttgaacctaggagttccagaccagcttgggcaacatagcaagacccaatctctacaaaaagaaaaacatacagaaaataaatagctgggcatggtggcaacacctgtagtcctaggtacttgggaggctgatgtgagagtactgcttgagcccgggagttggagagtacggtgagctatgattaaacactgcacccagcctgaatgacagggcaagaccctgtctttaaataaaacctaatttatttaactcttaagtttgttttccatccacctatagaatatcagtggcacaagggaggaaattttatttattttgtacatggatgcatccctgaagcttagaacaatacctggcatgtgacaggcactcaaataataactgaaagaattaatagtgaaagtcaaatattacaagataccatgctatgaatgttgttttagaattatataagactatgctgatacataagccattacagttgaatgcttaaaaatcttagagaataaatgatttgaagagtcaaattttggggttggttgagagataatcacttaaggacaaattaagaaaatgcagagaaagtgcttcacaaaatacaaaaatactaggaagtccttgtccttccaaggttagtgatacctaactcacatggtttcttccagtcctacaggtggctttgtctagtttttctgattgggctctttgtttttgccagaggtaaactgctatttcatttccttttatttcctccttatttctgtcctatttttagataccataattgaatcaacattcctggtgcacagacatctaacaatttgataaacggcatgtattctctggtctgctaaaggctgtctcttaatgtctttcccttctgccccattctgtgcctatatccccttaactccaccttcctagagggttagaagtcccagagtcctaaaaggttcttgcaaagttgggttcaaggctacctaggttttctcattatcgactctacatgacagcaaatcaataatgaagccacacagcggggaaggctgtgtggatgtggataaagccaatgcctgtctttcacagatggacacatgactttatcgcctcaaaaacatgtcaaactctgccggtcctcatagttctcagaaaatatttcaagatgtcttttttcctccccgcccgctgggagaatttccattgtgaaaaacacatttacaatcatctcactttaaaaccatgtagagaagggcaggtgagctaaagagagaaaccctgatggagagggagaatctttagctgaggaatctttagctgaagcacgtgtgcacatgcatttgtggacacatctatggaagcaggggacaagcatgtcatcaatagcaaatgaggcaagtgcagcgggaatggccaggaaaaaaagggagagaatcaggagatcgaggcaaagtaaaaactattaagagacaagtcgctaccattcgacccagcattctcattactggatatctatccaaaggaatataaatcattctaccaaacagacacatgcacctgcatgttcagcacagcactattcacaacagcaaagacatggaatccacctagatggccatcaacggtgaactggataaagaaaatgtggtgtaatatacatcatggaatactatatagccataaaaagaacaaaatcatgttctttgaagcaacaagagtgcagctggaggccattatcttaagagaactaatgcagaaacagaaaagcaagtactgcatattctcacttacaagtgggatctaaacattgaggacgcacgggcccaaaaaggggaacaataaacacaagggtctacttcaaagtggtgggtgggaaaaggctgagggtcaaaaaactacctatcaggtactatgctcactacctgcgtgacaaaatcatctgtacaccaaaccccagcgacacccaatttacccatgtaacaaacctgcacatgtaccctctgaacctaaaataaaaattgaaaaagaaaaaatagatataaaattcccacaaacaaacagaaagagagtactggttaagtattggctaagtgtcactctctggcccttaaaaaaaaaaagaaaagaaaagagagaagagtggataggaaaagataaagatgcaaagatgttaacattgcttgacatttaaaactggtatctctccataatagaactttaggaaatatagcaaaaaggaagagaaaggaaactatgaaaccgaactgcatatcatgactgcttttatcataatttatccgccaaatgtttaaggggagaaggtggaaaattttgcggttaaataattacatagttaaaattcctcctgggctatcagtgtgatagaagtgcaatgtctactgaactctttcaagcagaatccaatatataatctctggaaattttgttttatggaaacaaaaacagaatcagcactttccaaagatcatctcccaaccaaaacacataataggaaacatgtactctattatttggtgcctaaattttccttctgcctatcttgatatactatgttattttttaagactgttttttaaaatagctaaattgcatattttaaaatgttaaatcaaaagccccgagaaatgcatgtcaaatatgtttaacatttaattcaattatatttcatctagggaataaagtggatggtttaaacatagttataacattattagaaataataatcaaatataatactcattttaaaaggcattatctgcatcaggtttaatagtttgtgtcctgtcacactgtaagaggtattggtaagtatttatggtttaacatgaggttacatggtatatgaggctcccccttgacatgcaggattgttctgctcagagggcaaaacctttcccatgttttcctcttccttggtgatgacagctgcttatgaacatcctctgcttttatcctattaggcggtcagtgttttatccgtgatttctcatttgcaattcttctcaatcttccatgttagcatgttacctcatcttgtcctatgctagcccatcttctagccatacagtttaatttcagtctcagagtctacttgttattgcctctgccttcttctttggatgctctcttctgactcttggattttctttttcacctggctccaccgttttaacattccctttcacagtttcgatactgattaagaaaataaacactaaatgtgcaaatgggctggtcacagtggctcacacctgtaatcccagccctttgggaggatgaggcaggcggatcatgaggtcaggagttcgagaccagtctgcccaacatagtgaaatcctgtctctactaaaaatacaaaaaattagccgggtttggtggtgggcacctgtaatcccagctacttgggaggctgaggcaggagaatcgcgtgaacgcagcaggcagaggttgcagtgagccaagatcgcgtcattgcactccagcctgggtgacagagtgagactctgtctcaaaaaacaaacaaacaaacaaaaacaataaatatgcaaaagggctggtcacagtggctcacgcctgtaatcccagcactttgggaggccaaggcaggaggatcacttgagcccaggagttccagaccagcctgggcaatacattgagaccctgtctctacaaaaaaataacaaaattagttggacatagtagcacatgcctgtagtcccagctacttgggaggctgaggtgagagggtcacttaagcccaggagttcaaggttgcagtaaactaggattgtaccactgcacatcagcctgggcaacagagtgagatacagtcccccccccaaaacaaaattaaataaaacatataaaaatatgcaaatgcatacaatttaaagcataatctctaactaatgcctatcattgccattcccagttttaatacataaactggtatgactttctggtgaatgatgccttcttatgtgttcactgcctgtaagggatcttgtactccttacattcttcagagatgccctttctccttcccatcttcttttcttccagtggttttcctcttgctttggtttttctcttttcctctacctttccttttctccactaccattttcatagaatgctgtaatcctggcactttaatcccaacagatcacacacacacacacacagacttataataaaggttttgtcttcatgcattcctcactccaatatcgtagttgggctgagctcattggagttcaattccactgcaatgttccatgttctgcacctatgcaatccagtaacatacccggtcatggcatgtttccaaggagaagtccaggttccaggtaccccctgctctctcctttcccatcagcattagatagtgcatctggggcaatctatattccatataattatttttaacacttaccccagtttcttattaccattctgcttgcaaacacttaaaacagatggatgtaaatggcatgccagctcatgctagaattactcatgttaaataaacgctgcaatgatgaccttcctcagtggttttactggattctgttcttgcccaaatgctaaggagaaaagaagctgtctctcaactccatttaggaggacagaaacataaaacagaaattgtcctttttcaaatccccaaataatggatggctcaccctcaaggcattatagcattctgccttctctataatccacgtgttgggatctgagacccagactcctttgtgtctaccgtatagttttaggtgagcacataaaatgctatctctaattaaatctcacaatattagtgaggaagcatttgccagtatggattctaaagcccaaactgaggtctttaaaaaggatgaaagagaattgattttaccagacaagaagaccaaagaaaattgtttacagcttagtgattcaacagtgtctataagggctcaagtcttctctcctgtcagaacaccaccctggtcagcagttgggtttccatcttgttcataggtttgccagctcctgacctgagataagcagtggggtcctgacaaaagcacctgcacccacatgcaggcagggggcaagagagggagagggtgcaagatgtgttggtcccttctacagagaaaagctttctcagaatgtctatgagtgtctcctgggctctgcttatgcctgacgttccctccactccaggaaggcatgggaggaggagatagggaaagcgtttggggctggcatgagagtttcttctatatgtcaaatctcagagattaatgcaacagaaaataaaactaaaaattaaacgatgaatcaacaattgtaaaaattcacctgaaaatatacaatgatctaatagctcattcagaaatgaaatctataaagggttttgggtcagcagatctaggtgtgtccagtcctaggaactcatttgctctgaatggaaaattccattctgctgattaaatttcattgagctaagatccactcatttttctaattaatcacatccctcacctaaaagcaacgacgtatttgaacactccattgcaaaagaagaaaatcaaattacatagttctctatcaccaagtaacaaagaataccttatgaggtgctagagaagatgtctgaagaattaaacttgtagttctggtgctaagaaatgaagtaacaaggcatataaaatgtaaaattgaataaaaattaaataaaagtggggccgggtacggtggctcacgcctgtaatcccagcactttgggagactgaggcgggtggatcaagaggtcaggagattgagaccatcctggctaacacagtgaaaccccgtctttactaaaaatacaaaagttagcctggcgtggtggcaggtgcctgtagtcccagctactcagctggctgaggcaggagaattgcttgaacctcgggggtggagcttgcagtgagccgagatcgcgccactgcactctagccagggtgacagagcaagactccgtctcaaaaaaaaaaaaaaattaaataaaagtagacatccataccagaaactaatttaagaaaaggactaactacagccaaaagcaagtgcacaatcaattgctgttacaaaggaaggtataaaagcattaatgtgtatccatcttttttcttttctcattttcaaatctcagagattaatgcaacagaaacaaaattgaaaatttaaacaatgaaccaacaatttcaaaaattcactttaaaatatgtaatgatctaatagcttatccagacacataaggtaagatctaatagctcatccagaaacataaagtgcttgaatcattttagaaatgactacatcggtcctactggtgttattataacaaggcctaccttttggtaagtctaaacactttactgtggaaatttcaaaaatttgtattcatgctgaaatacaaaatggagcaaagctttcttgaggcatcatgtaaaaaatgcctcagaagtgtgcctgtgtgagataattgagcagaattctagtttggctgttcaaaacagcagccccctaaccctagttccacccaaaccatgcatcttaagcgtctcaaataaatattgaatatgattagccattttcatagaatgttgtaatcctggcactttaataccaacagatcacacacatacacccaagtctttatgtattccctcacttcaacatcgtagctgggtcaagctcattggagtttaattccattgcaatgtttcatgttctcctcccttggaatccaggaaccagtaacatactagttactgaattttccactgaaggaaaatgatgatacacaattcataaatctactacaacaaaaagtcatagcaaccctcaattcaagctacattctttaaggcttttttttttaatgtagctgacaccatagtatgtactaaaataagacatttttccacttcttgaaatgtttccacgttagcaggtgagatcaacggcaaaaacatcaccaccatcaacaaacaaaaatgcatataacacttcaaaaaagcaggtacaaattttagaagcacatagtagccattaaaactgctaaaaagctagagtttttcaagttccacaatttcctgaacattaataaaatatattttcacagcattgttctttccattcaatagaaacttttcagccaggtgcagtggatcatgcctgtaatcccaacactttgggaggtctaggtggaaagactgctcaaggccaaaagtttgagactagcctgagcaacatagtgagaccccatctctacaaaaattaaaaaataaacataaactagctggccgtgatggcatgtgcctgtagtcctagtgtcctagtttgttttcacacttctataaataaatacccgagactgggtaatttaagaaggaaagaggtttaattgacctccgcatggcatggggggcctcaggaaacttacaagcatggcagaaggtggcgggatggaagcaaggacctttttcacatggtgggaagagagagaagaatgtgcgaaggaggaacctgccagacacttttaaaaccatcagatctcgtgagaactcactcactatcattagaacagaataagggagaccacccccatgatccaatcatctcccgccagattcctccctcaacatctggggattacaattcaagatgatattcaagtggggataaaaagccaaaccaaaacacctagctactaaggaagctgaggtgagcggactgcttgagcccaggaggttgaggctgcagtgagctatgatggtaccactgcactgcagcctgggcaagacagtgacttaaaaaaaaatgtacttttcataaacttgggcagagaagctctctttgtcagataatattgagacttacccatatgaaacagtgtgtattgcggctcatatgaaatctttgcataagacagtaaaaaaccatccaataataaatcatgtttccatgacaattaagaaagtagtaattgtagctgaagacagcacccatggtcttgtggattattttcatgttctaaatcattagcggtggggcggggggagagtaatacgcccattttaggttaactttattttaaaataaagcttccataacaaaaagaaaaggtgcatctaaaataatatctaaatcagtgaagaaaagattgtccaatatgagaagtgctcttaccaagagaaaataatgaactgagagtcagccaagttacatctctctgtagtttccttcggcttcagaagccctaatcagatggatcccctcatggtcccggagaaatccagctggctctacaccttcttatgtatcaagggctcatcacttaaatgcattttgtttctaacatggctggagaaacctccaaatgtcaactgaaaacctgccctcactttgtatgagcaagatttaaattttaacggggtcaccagggccttgtgcccaacaacattaaatgaagatgcttggagagtgctttgtgaacgacagcctggctgctggggagcataaaagcagcacatgggagtctttcctgtagcccaaggatttgacttgccaatgtgatccttccaccgtaaattcagtgccatggagtgctacgactacaggtgtcagccaccatgcccagcctgtcagagtgtgcactctgacagtgccaaaaacactccataggaaccatccacagcaagctcgggttcttttttattttccttttttttcccatgagctaggctgtggtccaagcagggcatgtattttctgtcattttcatggactgcaacagaaagctggaaatagatttctctggtgtgtgggagagatcttactgtctgattatctagaggccagggatatgtatcttcagcatgccttttttcttttatttacctccgtgaaacaaactgaactacttaagactgcagatcctggccttctgcatatgagatttggaattttgactaatagccctgcaactaaccaatgcagagaacgcccctgttttcttagctgccatcgtgaggtttacgttttacctggaattatctgaaaatgccccctcaaagtgtacgtgatagaacagtgggccaaaatatacaagactgagatgcttaggggacagttattagatcatatataagatactgcactgtaaatgaggaaagagtaaaatgaggacagagtgaaaaaagcatgtttgcacaacagtgtgaatattgttaatatccctaaactgtacatgcaaaaattatagatcttacatacattttgccactattttaaaaaatatgttgctagcacctactcagcatctgtcataacccttcacactcccttgccgctgtgccatacggagtccacctctgggatgacacctgtgtctgtctgctctcccattcagtgccgccatagcccttgtgaatgctgccttgatgaacattaatgcctcatccctcactgaacatatgcccaaagcacctaactagaatctccaattccttctctccacctttgcaaatgttactcatctctccaaacacaagggctgaccagaccagcagcccgaattaagtccaagctctttactgccatattcattgtacactgaatcactcccaaatctagtcacagattcactttccagcctatcataaaacatattctgcattagtaaacaaggacttcatgttcttctgaaattatgcctcaatcctgttctgacaccttgcttaaaatattacttcagctataacatccaatggctctgcttccaaaattccatttggaactagttaaagtggcatgtctttcatgatcccttcttaaatgctgcaacctacttattcctcctgggaatccctatggtacaagcctgaaatcagtcaccccctgccttctccaggacttaatgatatccatattttatttcccttacactagaaactgactttttacattttttctacagcagcacatacggccatgttttgaacaaatttggaactcaataagtgtttgttgatgggatgaattaatgaatcctatagaatgacaacactagcactatattcaaatatttaaaattagaattaaacttaagatttatgcagactttagcattgttcccattggtgacattttgcatagagggccaaagccatccttggcaaataagtgtcatgatatacataaaaaataacagggaggggagtgaagaaaatgtactatgcaagcacaatatttcatgtgatgaaggaggaagattagtagggcacaatgtctatccttaaggtgtacctgatataacagaggaccaaaatatacaagactgagatgcccaggacacatttattagatcatatataagatactgcattggaaaccaggaaagagcaaaatgagggcacagagtgaaaaaaagcatgtttgcacaacaatgtgaatgtacttaatactcttgaactgcacatgtgaaaatggtacattttatgtcatgttcatttggccacaatttaaagaattttttttaatgtgggatgagaaaagataatgaaggaataatgcaaagctgaaggctgtgccagatgtaagaagtgattatgaaggataaaagaaaagggctttccaagcagggaagaggcatcagagagaaaaccaattgttgagccagtattctgtcacagggacatttgtctttgttctttaatgcccagtaagggtcttctcaggttccattaaacatgcagaatcacaagacccccccaaagttaccatggtgccaaccgactcaaaacaatacagacaagaagctcagctcatcaggaaggctgcagcaggcatatgggaaccatctgctccacaaaggacagctgagatgcaaagatccctacaaggtccatatccacgggaattgggtattccttggcattgaagtcccagccttcacagcagccaatattccctgtaaatactccatgagcagagtttccatggttcctagagtgaacagagcagctgcaaagtgactccaaaacttgccctccgggaagcctgaggtggggtggtattaccactaggttctttcaggtctttatggtttctcctggtcatgatgctatttacaaataggggatcgtttgtattgtaagcaatgtggccaagaatattgttgccatgttcttcatccaactgccaggaaaacagagctagacagtcaagcagaggtcagattatcttgcagcaggttgaaggttttgttcacatttaacccagaggtactttgcatatctgagtttgtgccattgtcgtagcaatggcaggcagtagaaacaactatcaaaattatacagatgaggaacttgagagtcatagagaggaaggtaatggcctttaagtatgcagaagaaagcaatgaaatcatgagacaagagtgaaagtctgatactttgcatatctgagttcgtgccatcatcagcaatagcagacaattgaaagaaccatcaaaattatacagatgagtaaattgagagtcagagagagaaaggtacttgcctttcagtatgccgaagaaagaaatgaaatcatgagacaagagtgaaggtctgctatgcacaaagcttgtattatttatattgattcatggagaaagaaccaacggcaaaggtacagaggaaagatgactagggaaaaaaggatgataaagggatggatgtggtaacagcaaagagaactctagaagccaaacaagcatttctggaaagcctgctgcatgccaggcattgtacttgcccacagtagcccacattcctataggcaagatggtcacagaaacgactaatgacaagaaggtaagagccttaggaagatcatcaggaaggtgcactggagttaacacagctacactggacaaggtgcaaagagcactttgcagagaaggtaacatgcattctgaatcttgaagatacttcaagatacttcaagaagttacaagatacttcaggatgctgatcttctcttcatcaactggttccccagttgatgaagatgcaacctgatgctataaagaacagggaaccagtaaggcataaaagcaaaaaagaaacataactacatttgcattttccaaagagaactctagattagtcactgaagaagaaaggtgcacctaaggagacagagtgctatagtttggatgtttgtcctctccaagtatcaagctgacatttgattcccaatgttggagatgaagcctagtgggaggtgtttgagtcatggaggtggatccctcatgagcagcttggtgccagccttgcagtaatgactgaattcttgctctgttcattcccccaagagctgactgtttaaaagagcctagcacctccttccccccattctcttgcttcttctcttgccacgtgatctttgcatacaccagctcttcttcaccttccaccatgagtggaagcttcctgacaccctcaccagaagcagatcctgatgccgtgattcatgtacagcctgcagaatcatagccaaataaatctctttcctctatatgtcacccagtctcagagattccttaattgcaaaactaaatggactaagacagagggtgatcatacaaaatgaagacagtgtgaatttgcactgaggcaaggaagagaatatggggaggagaggtaagagctggtcactcaagccagaaacacaaaattttcccacactttatttgtccactctaaatcacgcccccctcttcccacatcataaaaattggcctccaagacttgccagtcctatatgctaaatctctgtatagctctaattacaatatgatatttagtatctgcactagagaaagaaacaaacgctccatatttgaatgtcttcagacaggtgagacaggcactagttacactttattaaatactgcagtaggaattaacgtatgttatccgagaacacccaaaatgtaaatactcagcaacaaaagcatcttaataaacagctccatacactggtcctatgttagtcctatcaaaatcagccacaacagcaacaactatacatccatctaggggctcccagtagatgacaagagcttgaggaatgatcatttagaaatagacagcttttgtatgactctggcaatttttctggttgttctcattgtttgtttcagagttccatgaaaggacatattttacatattttacatgctggaatggtccaattagcttcattccttagcagctaagtaagagcaacagcttagctgatcaacaatgggataaatgctctgagaccagagttgtggacttcccttcactaacttataaatgaatgcagggtgaagcattatcacctaatgcagcctaccatgtgactggaagaatgtatcagatgaatacatctggcatgctcaaccgcactcattatttcatcactaaaataaaataccaattaattagaccaattccttgggtctttactattacataaacacaggcaaatgatgagatatgaagttcacttggataactctctttgcttttcatgcagttgcttctcatggtgtttagtgtgttcatttcaaatggctgccagctaaagttgaaggaccatgtttagcatcatctgtgctcagaccataaatgaacaaagtcctccataatgttttcatagttccaatatgttctttcattagaattctacacttaacatatttttacctttttcctttcattcctacatgcattttaaatataaaaagtgatataccacctgctatccctgacatttgcacaagtgtgtatttgaaaatgtttatgttcaaattttggtaactaatgcacagagagaaatttatactatgtgattaaaatatattttatatgatatttttccacaattcacttcagcatcaatgttattacattccaaaattttattttgtgtgtgtgtgtgtgtgtgtgtgtctgtgtgtgtgtgtggtgtgtgtgtgtgtgtgacagggtctcactctacaagccaggacagagtgcaccgaggccttgaactctcaggttcaagcaattctccttgcctcagcctccctcatagctgggaccataggcacacaccaggatgcctagctaatttctgtaatttttgtagagacggggtttcactatgttgcccaggctggtctcgaactcctggggtcaagcaatcctcctgcctcagcttcccaaagtgctatgactacaggtgtcagccaccatgcccagcctaaaatttcatagttttatacaccaaaattatctcacttttccttaaaattttgtcggattaacctcattttttcaaatcattaaataagagttactttctgtatttttaatctgccttcctcctatttcagcaacatttagctaatcatccaattgttcactaactcaaccaaaaagggaaaactaatatagaagtttggcttatgaccaaaaccaggattcatagaaaggtatgtctcttttgccagatacagggattgttctttgattggcaaatgacaagagattgttccttctacttcatccccagccttagaacctgcaaatgggattttcagcaacaaaccccttctaacctcaccattcacaaagaaagcttggtttcttgtagtgttacctgaactcctaccactaagtttattaaattttgcgagaccctttcacataattaaaaggctgatgtttgagtcagaacttgtgtctgggatgcttaaattcctcaccctcataaagacatgccctggccactccatctcaaagatcctcataacccacattagatgttatcgttgcttcatttccctcaaagctatgatcaccatcagcaattctgtccttcatgcatttgatcactgctttatcttctgtccccataactaaagtaacagcaggacaatttgtgcatcctgtttgctatcgtatcttcagagtcaacaacaatgggtcatgaatagttaattcatggatgaaagatgaatgaatggatcaatgagtgaagactcatttaacctattcctatgcatatgtgttgctactgctatgggtagtgggggggtcttctagacacctggccttcttccacttacttctgacttctcctgatgtctagcaactcgctaccgagtaggtcaatcactgccaggttggttgcactgggggaagaaggtacagggtggtttccatgactattaacagcaactctaataatgtgcttgcggcaattattgaccccaagatgcagcatatcatgtgctgatcctagccactgatgtgaggttcaccatttttaaaattacaattaaactacaatactgataacttttaaattctattaaaaccattcctgagtgtggccctattactcactaaggaatggttgcagggtagttgatcaaggtaattagatggcaagtgatatggtctggctctgtgtctccacccaaatctcatcttgaattgtaatccaaattgtaatccccacgtgttgggggagggacctcatggggggtgattagatcatgaggacagttcccccacgatgttctcatgatagcgagtgagttctcatgagatctgatggttttatatggggttcttcctccttgctcagcacttctctccttcctgctgccctgtgaagaaggtgctttccttccctttcaccttttgccatgattgtaaatttcctgaggccttcccagctatgcggaactgtgagtcaattaaacctcttcctttataaattacccagtctcaggtattttttatagcagtgtaagaatagactaatatagcagggaaggcaggcaacgggaattgggttggttcctctcttataccacggaaggtggcaagttgttaagactgtgtgcagcatagcccatgagacttgcattaaagactaccagccctattactaatctggctgttattcaatcatcctaatctcagtttccacatctctgtaacagagttaataaacagtgtaatctcatgaccctactgtgaaaattaaagtagataagtcttgcctatgtttcttgctcaaatgccatcttgcagagatgcatgtcctaaactcctcatttaatctagcccttcaatcactactgatcccaatccagcttgaattatcctaagaccaccttccctattttatatgcttgagcctgtctttactttttcccacatgggtacatgagcaccatgatattgggatggtgttagtgctcatgacagctgcatctccagtgttgggcacagagtaggcactaaataaacacttgtttcatgtgtgaacccatatcccaaagcacataattgtatcttacacatagtaagcactcaataaatgtgaactattgtttatgtgcttataataccaaggaaataattggcatcatcctgtgggtcagcttcattacccaagagaataagtatttatatttactgaggagatcctaacttctaggactccttactgcaatcctctgaggtctctgttctaaattttccagacagctgtattaattcaccccagatcacacaggtaagatttcaaacaagatcccctgactcaaatggactccatcttctctgtgaaaatgctctctgtttcctgccatcatctctactcaaagttgggtgaagacataaagcagctatattccctctctttggagagcttacaacttaggaggcaacataatgtgaatgcatgaatgcttatggtctagaaaccagaaaaaaaaaaaaaaccagaacaacaagcccaagaggagaaaaatgccagatgctgaaagaggaaaaaaggaatacatgatgatcttattgtctaagtagaagtcatatgaaaatgactgtatttgaaagctttgggtctaagaaaatggcaaccccataaggttcagtctcgtatatactaggaagaaactctccttaagttccaagtgaacagtcctgacattccgaatccaaagcagagatttttcatcttttcttctaggtcacagacttctttgaggagacactcctctccaagaaaaatccattctcgcctactcataaaggtgacatagagtttgggggtcccctgggagtccatgactgtcagttgaatgacatctagtgccaaagatgcaaaatcaccctcagttgaagaatccaagtaacagctcaagagaactgggttttaactcttactatcactacctaataagagcacctgtccctttcacaccataattagcttcttcctaaaaagggttgtggttctgctgaaagacaccccataaactgtttccccataacccacaaaatcttcaagggcaaagtggaaacattatcaatacgggagagactgagaaacactgtttcccaagagaaggtattagtgtattaaagacctaaatgtgacaaatgaagtatccacatcttcagaggtttacgactatgtgaaaatttataatttgtttatttatttttttaatagagacagcgtctcactatgtcacccagggtggaatgtgatcatggctcattgtatcctcaaactcctgggctcaggcaatccttctgcttcagccttctaagtagctgagactactagcacactaattaaaaaaaaaaaattatagaggctgagcgcagtgattcgcacctgtaatcccagcactttgggaggccaaggcaggcagatcacctgaggtcaggagttcaagaccaacctgaccaacatggcaaaaccctgtctctaccaaaaaacaaaaattatccaggcatggtggtgcacacctgtggtccaagctactccagaggctgaggtgggaggattgcttgagcctaggaggttgaggctgcagggagctgtggacatgccactgcaatccagcctgggtgacagactgagaccctttctcaaaaaaaattgtagagacggggtctcattatgttgcctgggctggtcatgatctcctggtctcaagcgattttcctgccctagcctcccaaagtgctgggattacaggcatgagccactatgcccagtggaaatgcggaatttaaatgaaaacagcacatctctcttttttgatataaatgcatgctgaaggttctggcctcactcctggtaaaggcaaagcatcaggatgagaaagcatgtctgagaagggccttttcccagtaaactggcctgcttgacaaaggggctccatctataaaggggaggggaatatgaggctggtgatatttgtttggaaagggctgcaggcaagaaaaagaactgcctgtgtcaagggagttgcagtcagactctaagatacctagcctgcagggcatgacaccctctcactatagtaacttccttccatcttgatttccacttcttagaactcatgctctagaaactagaaaccaaactcataacagtaagcccaagaggaataaaattgcaaggttataaaagaaacacaaaggagaaatcgatcttattttccagtctggaggcggtgctgccaatgtacagttgcgatcaataaagaagtgttattatcaaagtttgaaaagaaacaccatgggaaccctacatttcttcaactttattatgatgcataaacacttagaccattcatgtctcgttctctgttaaattctcaacacttaaaacacatgcaataaacaaacattttaataatacattgaataatcttctaatataaaataatcccctattttttacctaaattgtctcaaggttaccctatggttttaatattctgtattttggcaaactatcatttcattcatgcatttatcaatccagaaatcatttgttgattattatttgaaaaagacaaatgaggtaggcattaaaataacaaggataacgtcagacacaggggcacaggcatgcaatcccagcactatagaaggctgacgcaggtggattgcttgagcccaggaattcaaaaacagcctgggcaatatagtgggactgtgtctccacaaaaaaaaaaatacaaaaattagctgggcatggtggtatgcacctgtagtcccagatactcgggaggctgaggtgggaggattgcttgagcccaggaggtcgaggttgcagtgagctgtgatcatgccactgcaatccagcctgggtgacagactgagactctgtctcaaaacataaaaaataaaaataagccaaaacaagatgtatctaatagatagatagcatacatatgcatatatatgtatacataaaaatattatatgaaggaaaataaataaaatctttttcactgggccttaacaaatgaatgactgggatcttcccagatggagagtggggaggaagtcatcgagatacaacttatcggaaggcagctcccgggcaggtagaagggtgggtgtgctgagggaactgtgagctgtttgttccaaggggcaagggcacgaggtgtacaagaaaaagtaaaagaagctaacactggaaagggacacatgggcagattaaggagtcttctgtgctgtcccaagggtcttaggttttcccaggtggtaaaaaaagagattttgccatgatgcgtttttttctttttttttttttttttttttgagacggagtctcgctgtcgcccaggctggagtgcggtggcgcaatctcggctcactgcaggctccgccccctggggttcacgccattctcctgcctcagcctcccgagtagctgggactacaggtgcccgccacctcgcccggctaattttttgtatttttagtagagacggggtttcaccgtgttagccaggatggtcttgatctcctgacctcatgatccgcctgcctcagcctcccaaagtgctgggattacaggcgtgagccaccgcgcccggcccatgatgcgtttttaacggcttgcaggagtgggttcactctcttgagctctttgcccctgtgccatttgatgatgtgcaaaatggtcttgccagatgatggtgccttgatcctggacttcccagcctctagaactatgagaaatacatttctattttttataacccagtttcaggtgttttgttgtagcagcataaaatgaactaagaaagattggaatgcatcacttagccactgaaagccatcagatgtgagaatcaggaagatgactccaatagtagcttgaaggtaggaggcagaagagtaatggactgcataacaatctaaactgagataaggaagctgtcacagtgggccacaggaagacagcacatagctaggaatgttctgcagggcagaaatgagaagtagacatccatttacataagtgctgagaaaagagaagtaaaatccaacagagtttgtatcttggacacactggtatatggggcacctttaactaacaggagggtgcagagaggaataggttttagaggaagagcatctcttaatatttgaatgtgttgtgtttggagtgtctatgtgacactcaactagagatttctaataggggctaaaattacaaacactgtaactgaagctagtggcctgagctggaaataaagacttgagaatcatccacatagaggcagatagttgaagataagaagatgcaatgaattacctagacatacaatatacagaatgaagtcaagaacaaatcctaggaaaagtcaacatttaagaataataagagaagaaaatacagaagagcttctcacaattgtagaataaaaccagaacatagtgataaaatgaaaaggaataagaattctgcaagtgataaagtgcccatcaaattgatataggatcatcactaaaaagacaccactgggttttggcaatgtagaaatcactggtcatactttaatgagatttgttagcataaaattgaaaggatagagaaccagttttggagaactggaggacaaagaactataaattcctattacagtaatggtcactattaatggaaggagaaaaatatgtcataactcaagagaagacaggattgaggctgactggccattggacacaggaggagtacttgggttgatggtgggggttaactcctagatcccacttgggaggtggaaaactgtcccagattctggaagacaggagagttatacgaacaaatgaatctgttagtataaaaatgagatataatgaaaacaaaaaaggtcaaaaaaccttaaattgatgccctttgaccccgatgaggagagagtgtaaatgggttgtcctatggtgtgaatgtgttccccgaattcatgcgttgacatgaatattattaaaccctagtaagacagtgttgcaggagaggggacaatggcaggtgtttaggtaacaaaggctctgccctcatgaacagatgagtgtaattataaaaagggcttgcaggagtgggttcactctcttaagctctttgcccttctgccatttgatgatgttcaagaaggtcttgccagatcatggtgccttgatcttggacttgccagcctctggaactaggagaaataaatttatatgttttacaacccagtttcaggtattctgttatagcagcacaaaatggactaagacagattacaagccaacagtaagatctcaagtgtttctggaaaccacacactaatgagaccaaaccatgcagtaattcacttaatgctagcagtgctatgggacacaagaaattgatatctggatgcacccttagctgagaaacaacagggtgagcccaccacaagcagaggaggaaattgagggtcttagtgagagaattaaagtcagatccagcgatctatgtcagacgtttggtggctggaaggatactcagtactaggaggtttgccaggattcatggaagagtgatcaaagtgggaaggaagaagtgatagccagaagaagaggaggtttaggttagggtcattacttcagagttttcagtattcagagtagaatacggactttagtaatcattttctgggtgataaatcgtagctccacaccattgtccttcagtaagtcagaaacaggcaaaaggcaaccgaatgaggactgtgaggtggtcgtgtaatggagctgaagtcttcaataaagaaggtcaaggaatttatattcttcagatttttttgagtccttccagtcaacactggcttcatggatataacattaattcttcaacatccgcattaagagatggattcaacctaatattttacttacataccaaaaatgcctttgccttgaattctcatgttataggtaagctttctgatgtattagtttttgggattatcctaggaagaactcccactgtattccatgtctggacagagcttatgtttatacaggcttaagtaatgctttcctatgtgttttcaatactgcttctgagaattcccctggtgtggtggactccatgcccacacggcacctggcatggagcacagcctgaatatgccattgttggtgacagaaatcaagtcaatgtcttcagaaagccatctatactgattctgttccctttctgccagggaatgactgactgatagctcagcgccatttttcttcaaggggttaacgataggcaaagctcagggctgaggagaagcccatgtattttgtctattttgttgagatgtcatgaaaattaagggagaaaatccatgtgaacactaaaaaatactattattactgttattataagtgttgctatttggatgtaggttatgattgcatgaagcccagacagaatttcttaaacttactggataccaaatgaattatgccaagtgagcagatgagtgtcagctgcatagctttggaaaagaaaaattaatgtaaaaattaaagtttggtttgggtgaggctaggtaaagatggtttgaggaagaaagaaaatgttttcatgtgtcatggctgcttttaagtatataaaatttaattttcaaaagccaagaagatgtgaatgatgtagggtatttcttattcctctgtggggcttctctcaagcccaatgaagcaatgaataataggaaatgtaacaaaaaagcaaaatgattgcaagccatatattattcccttgagtagatttccctgtaacactgaaccacagcagaactttttggaacttctgagattccttgcctacatctcaaaattggcctaacgggtataatcctttcaacaatccatcaatctttctccccagtattacgggtttggttatatttgtttaaatatacagctttcttccacacaatgaagtgtttaaaacaaatttttttaaggacggggtcttgttctgtcccccaggctggagtgtagtggtgtgatcatagctcactgcagcctcaaactcatgggctcatgcaaccctcccacctcagtcttctgagtagctgagaccacaggcctgagtcaccacgcctggctagattttttaaactttttgtagagaagggatctcattatgttgcccagcctggtcttgaactcctggcctcaagtgatcctcactcctcggtctcccaaagcgctgcagtcacaggtgtgactcaccacacccggctcatgcaacaaagctttgattaaattggtttgggcagatactgtctcatcagctgagtccaaattctaacctgtgctagttttctctatcacatgaaatcatctttttctcatggctttttatacacacctagaagatctgcataaatgaaatgtcaatgtacttttaaaagttactcaaactcactacaaagaattttttaaaatcttaaatataggtgcagttatggtttttcattttctctgccaatcaaagcctctctctaagggcaccgtaccatagtcaccttctaagaggcaaacattgttaataatttgtttattttttgactttttttaatacagcaacatacacacatttgtatacaaatctacacataagcattcacccacatgcacacatatgtacacatatgtgtatggatactattgtgcattcatatctatgtatatatacaagtatctatacgtgcatacataggtttaaggagtttatgtgaatattactctgtgtcctcacattttgctctgcctcttcaatttcaagggaaagatagttttaatattctaagtgcttaaaataattcactcatcttcctgatgagaaaaatttcagttgcaatgatcacctatgtacatatatctttgtgtatatatctgtaagatagattcctggaagcaaaaatgcttccagaggagtaaagtgggtctctttctaaattttgttgtataatacccaatgtcttctaaaactctacttcaattcttcctccaactagcaaactgtgagagtgctcatttttccatgcccaaagataactgaactgagttttgccattcagctaggtaaaaggataataaaataaaataaagtaaaattaactaaaataaagttgatttcactttctttacatatgaatgagactggacattgttattgatgagttctaagcctttctttctttttgagcttctgatagttctgatggactcatttacaagtttttctctatttttctctatttttttgatgtcatttaatttctcacttttattctgaatgtgccattctcatctacacacgattttctacctaacatgtggcacttcccaacctagagtgcaccgtggggcacgcattttgcacaagccaaattttgcaaatccacaaaagggaaaaggcggaaaatggtaccctttggaaattggccaaaaatgtcaacgaaagcagtttcattttctacgtggcatttgtcatgctccatgcatggaacattttaaattgcatatgtgaccttttaaacaatagcaggaaatgccaagagaaaatgcgaagctcttcattgtctttcttaagcccctgcagaagccatttttcatggtccacggctagagcccatgatcaggctgtcaaagcacctgaaacaaaccatcaacatctgcgcagttttctatcctgggaaacatcagacacaggcatggcactgctctggagagcttgttcttctccgcatttattcagtaacagcagtttgtaacactacctgagttgttccatgatataaagagattcaagtcttaatatggtattatggtgttatgtagtagaaaccaagcaaatctctatcaccattttaagaacaggattattatacattattaggttactaaaggggggtttgtgtaagtcttttatcaatgacccttagggattaaaactagaaagagaaaataataaacttcagctttcttcatccaagtaccatatctactactgtctgtgtagctttttaaccaaagtaacaatagatgtgttgttgacatttggatgttattaatgataacataaagaagaatatatgatgccgagttcatatgaatatacattcctttctctgtttatttgataagtatgtgtccctgtacataaactgtaagttccctgaggttaaagacttggcatccttgtcttgaccatttttttccttgcataaagcagatgaatgataaatgcctgttaaataaatgaatgaaataaaaaacctctatgctataaagacaaaatttcaatatattaaattaatacctgggaaaatcattggcaaattactaaaaacaattcaaaaattttgcaagaatttaattatagtcattaaatgtattatccatagtagtaagaaaattataaacatatcgttaaactaaatttctaaatttctataaacagcaaatacagtgtaatttattatgcaattaaattacaatgagtggtataggcactgctcaataaatgtaggtagctgaaaatgagtaaatgttaacgcctattaaactaaccaaaactacaggtatggaagctctgtattttgatatttatctccccaacatttgatatcgccctttagtagtttgtacatggctatactttctgaagaagaagaagaacagcacattaatgtctctgcaagtcttagctatcatcataaactaattccatccagcacctggaattttcccaagaacacagcaggtgttcaataaataacagttaaattaagagacagaggaattgtgggatattcctactgaaacttgaggtgcatgtaattaacttaatctttttcttgcttacattatctgctgcagagagacaatgaagagagaagtcggtaaagttagtgtggagaagggatacccccttatgaccccaccccaaaggggtatgtgttggggcggataaggagataggtttaaaagagaggtcattctatcattctcatagtcagagggctacaaaggaggtgatgccatgtcaaataacaccttctagaaatagaccagcatagaaaagttggatatgcttgctgtatgcatgaaaggaaggaaagcaaggggccagacaaatgtcttagatatggcctgggacaagctgagcaccagcttcccttagccaccagcaactatgtgaaatgaaaaagatattaccatctagtgcctcaattccctcctctgcaaaatgagaaaaattcatgagactgtggttatcagtattaggaatcatgtgctcccaagtgtgtggaccaaggtcaggagagctctgagaacaatcccaacaagagtcaatcacgtaaacacatgtcctattctccaagccctgagctaaggtaacacctcctgcagagatgaagctgggaagtacgctactaatgtctttttagtttttatttttgtaagtacttcataataatctcagggttgagctaaattttgagtgtttaaccttactctattgttccagtattaatatatgaataaatatatattgtatattctctattaatatatttagataaaaactaaactattttcatcttaagaatgtcaagaagctactagtggcacagtgtcagtattgcatacctgagatggacaagcagcagataatcagaatgctatacctttaccttaatattcacttttgctctcgttttaattttctttgatctgaatctcattttgagacacataaaagtagaccatagaatcagaacaagatgcatactcattcccataaaataccaagttttatgctgctatatgaaggaatataaaaataacaacataatttcaatttttcatcaacagtaagattttaagactcaatcaaagaacatccctagaaatcttgtaaaaacactagtgtcttacaatcttaataaccctgaactgagcaaaaaacatatatatataaagcaggatttttattgatatgaagtgtatttttgagtggtggttcacaaccaggggtggtttcgcctcagaggcaatatttgacaatgtctggagatatttttggttttcataacttgtggtagtggtgccactgtcatctactgggcagagcccaggcatgctgctaaactaaacctcctacaatgcataggacacctcctacaacaaagacggggtgatcagctccacatgtcatgagtgccaaagttgacaaatactgttttgtaggaaaaagagagaggaagaaaaagaaaaggaagcaaaggaaaagaaagagaggggaaggagggatgtagaaaggaaggaaggaaaaaatggaaggaaggaagggagggagggagggagggagcaacagtggtagagagggaggaatagttggagagaagatggagaaaatgaacagagggagagagtaagagagaaaggaaaacaggctggcatgactgatggtctgatatgtgctataacaagttatttattcctaagagtatccttaaaaactagcaattttattctccattttactgtgaggacgtgaataccttgcgaggtcaatgacttgctccagactttgtgggttccaaggtcctgcttccctggaagcatctttttaaaataagatcaaataagaaagtgcagtgacttgattcatctgcactgctacaagatcccttcttatgtctcctgtcttacatcctgtgttccagaaaatggaaccctcatgaaaggaatgcagttttcacataaggaggcaatgcctactttctaaaagcgtcctttccttagagtattaaaggagattctgctacagtctgctcctagaacttagatatctttcaaaaccaatactggatgagtttcattcacataaaaaaaaagccattaccattttaattatatttttcttctcagcctcctattctagattagtattcattattacaacagacaactatattcctgccaagtgtgtaatactacaaaatctctttttataaaagctattttctcacagatctgtattacagagtaagagacagccaattctcttaagaaaaacaaaagagaaaaaattagctcataggataagaacatgtacgaactgggtctcaccattgagtaagatgttcctcagtacttcttcctcctctccttctttacttccttccttcctttcttcctttgttcttttttcactccttccctctctcccttcctccctttctttttttactccttccttctctctcttccttcctttcttcctttctttcttccccccttcctccctccctccctccctcattccttcctgtttttccattggtgaaaccttctcaaaggaaaagcttccactcctatcatcagcaggtaacacatcactctgggagaccttccctgaacaaaacaattacctcctgataagatgcacttgctagtgaacttctgggcacaaggaagtaagagaaatatccaaaattaagctttcccacataaagctcctccaacagtgtaagcaaaagaatatttgggtgtcctgagcaaagggaaaactggacctaagggaagtctgcccttatgtaacacacccatagtagcactgacctcagacaaagggagcaggtagctggaagggcagccagatgtgtaagacaaggggctggggccagaaacccaagcttggcttccagtaaggtggagaatttggacccttgaaagggctcaagtcttacactctagcttctatcagaaggaaagcgaacctacctgcctggggaaagaatgccagcataggccagaaaattcccacagattaagatcaaacaaacatgagttcacagtcaaagatcactaagcccatgaacactgaggtattataggtgctgcacacaaaacttgtggtattaaaatagctatttaaaaaataaagtttgaaacaggaaacaataaacaaaaaacaggaaattactggaaaggacaaggaagatttgaaaaatgaccacatagaaatgaaataaataaaaactgtatttgttgaaataaatagaaattaatggattagctaaagagattagacacagaagaaaagacaataaaaaaagatatgtctgggaaaatcttacaaaaaacagaagacagaaactaataatataaaagtcaatttaggagacatgggtgcaaaaatgagaatctcatatatcaaatcaaaatttgagaaaacaggaagaatggagaagtgtcagtatttgaaaggtgatccctaagatcttcaaataatgattaaatatatgaatccaaaggcacagaaaccatagaaagaatggataaagcaaaaaaaaaatcaatattgacatgaaactgatgaatgccaaaaataaacaggagatcttaaattttagcccttgccaaagacaacctgtgcataaagtttaactcaaaaccaactgacatctgtatagccagaagacagtgaaatgtgaaataatggtccacctggatttgcataataagcaaaattatctttcaggaatgagcagggaacaaaggtattcaatcaaacaaaaactgaaagagtttataacaaatattcatgatacataataatagcctgtaactagggagacaggtgattggtattttctagaatggagctaaggtcttgcttaattttagactttaatgacttaaatgtgagttttacaactgcaagcttttcttgaaaagtagaaatcaagtaaatggcaaattaagaagaaaatacagaaaaagaacaaactcatttattaaaaggaatgcataaaaaaggaaatccgaaagattaaaatacgttgaattatatcaaatatcttcaaactcataaatagcataagttatgcaattactagactgaaactgtcacattgaaaaaaagaaattatagatatctgtcatatgaaatgatacaaccataatatctgaaattactaaaggtgaaaatataaaaaatatattctcagcaatagccaacccaaaagtaaaaaagaaacaagcatatttctactaatattggatatctattgtaaaacagaaagcattttaagagatagcaagaatattacatagtaaaatatttcattcttcaaggagataacttgttatatattttatgccacatacgttctttaaaaaaccccaaatcagtagtattataggaagaatttataaattcattcattaatggaagatacaaagaaacctattttcaattttaatagatcaaaaaataggaaaaacagatgccataaacagttaaccgatgatttgatagacaattacataattttgtatctcatcattagaaaatacacacaaaacacttaaaaattaactgtttattagaacgtcacacaaatctcacttaacacttaatagacaaatactgaaatactgtgttttagaatttacaggaggcaggaaaattagcagtagagaaaatttaaagccataaatactgacatcagtaacaaacacaagggcaaaaagtaatgagtgaatcatcccacttaagaaattagtggagaaaaacagaagaaactaaacagaaagtagaaggaagaaggtataaaaaggaaagaagaaaagctaaagatgcaatagcaagatttggcaaggttaaaaagctggtcccagctgggaccagcttctctattcatatgcacttctggcttctggactctctattctgtcccactgttaatgtttttccctgtgccagtgttataggaacccaccgatgcttcaaccacacctagaattagagtatccaagtcccagttggcctgggactgagatattccccaggtgaggagattctggtgctagagctggcaatgacctgcacaaagatgacagatcaccctacttcacatttctgttatggggtggggggatactagacagggtatgcattgcatctcaaatatttctacaaatgaatgtagttaggatcttggaggaaatttctaaagaagatctcagaggatctgctgcaggttatcgaatagcctaagccatttatcaggttggccagaggacttgagccacagaaatacagaaaagtcatcggttgtctgtttctgtattgaagcatgaagggaagtagagacatgaagtatgaaattgccaagtcagggtaaatacatctagggtgcaatttggggtgaatcatgtgtaaatgtttatggtgttaatgaaaaacgttgcagcaattttttttttaaaaagagtaattttatcaaatttgcacattggaaatcctgctatgaaaagagttccatgtgtacgagccttagttgttgaattctatttttaaatggctaaggctttaagtacgtgcgtgcgtgtgtgtgtgtgtgtgtgtgtgtgtgtgtgtgtgtgtgtgtgtgtgtaattatggcaatgttgctaagtgcataaatatgcgctctgaattccagctttgggtagactctactcagattgcatgctatttaatgattgcattgactctgaagcatatatgcaattctatactattgctgatacatgcttttataaaatagcagtgctgctggaaaacaatagttgcaaaacaacaatgcctcaagctgtgcataaatcagggcttgtaaaactcataagctgcacttcaactcttaagcaactgttaccttaaagaagaactagcctttccacaatatctattgattaatatgaaatactaaaagaggttttgtttcataaactgttgcttcttggcttctaaaaagatacagttttaccttttatgattttattacataattgtaaagaaataattgttgaaagaaattcacgttcctgtaattctgattctaccccatatatgttaaggaacaataaggtaacacaatagattaggctaggattaccatactggtgctcaatgaagacaatgctgccccctcaggagccacttggcaatgcctgcaggtagttttggttgtcacaattaaggatgggcgttaggtgttaaagacttggagtgggtagacgccaggagtgctgctaaacatcttacaacgcacaggaagcgccccaaaagttttaatagtgctaatgtggacaaaccctgaatttgggaaagaaaaaggtggaaaaatcaaaatggtccctggccaggatgcatgcatcacctgtttatagccgctacatctgaatatggaggctgcaatgaccaatggtttggagtatcagggcatctggaaatattctacagcatgaagctaactaattgtttgttgtgccaacagaaaacagttaccataacacagagctgtctgtaggtacaaaatccagaactgcgttacaatatctgccttatgaagaagttatgtttcagagccaaattccacaggacactgcatcctgaaagttcatcctagtggtgacttggagagctagggggatgcctaaccactcatctgtcaaaaaacagctctgtcattcttcctcccactctttcttgagattgaatggtgtattaacactggcttttcatgttctattgagcctcatttcctgcatttaggaaccagccttccctacagattagaggccaagctagagctgaaaaatagaaacaacaagcttgttatctgaaatcacagccatcaaaaatgcactctataatgcccccgataaaatgttaacccttaatgtgatagcctcaagattaacctttagaatatgcacctttaaaaaaaaataatggtacaacatctcccagcacaataattgaattcgcaatgcagctgagttgtggaagtgaattcacaagtgtccctagactcctcaaaggccacttgaagaagagcggactgttgtatgtcattatgtgagaaatttaaggccaaagaggttaactcgctgagagactttggctgtttgatgttaaagccccattgtcagagactctcatctggaggccaacattaaggatgctatagaggaaaaagcacacacatacgaacatgagtatcttcttagcatgaaaatctaaaagacaacatcatttgcgccagaggccttgagccacagggaacctaaccacgaaatgcagaaaaatcatgggttgtttgtttctgtattagattgtgaagggaggttggactcgaagtacgaagttgccaaggacattgatggtgctgttgaaaattttcatatcgtgtgtgtgtgtgtgtgtgtgtgtgtgtgttttctatcttcatctttcatctattgtggtaacatcttaacatctccaactgtcattattgatgagtctttctttgcatttattgctaattgtataattaacagctctcttattaggtgtacacaaattaacattattagttctcttaggtgaattcttccttgtatcattatgaaatgtctctcttttattttggaaataatccttatcttgaaggtatctttgcctgatattaatagagccatctcagctttcttggcttttttttttttttccttatttgttttcatgatacatactttgaaatattcacacagtgtacatattttaaagatatgaatctgactacagacttactaaagacagtcattgacaacattgttttcattggatacttttttgaaaatgtttatagcagaggccaaagaacataagtaggagaacaaatacaatctaatgagagagacttgggggtgttgctgtggttgcaggagggcaggactctgaatacccccttaccctaaactccacctagttagtccctctatgtgaacccagacacaaatgtgctgaacccgaaatctgggacacctggtttagtaagatggagagtagagaaacactaaaattcaaaagaaatagatcgaatgtattcataacacttgctaagaatatacaccatgacccttatgtatcctaaaacaatgcctttatcacaaatggactctcacctataagaaaaggtccatgtcactcattagttcagggacactccctcattcgatggcttagcaactgcattcaactcagaccaatccaaactcaggcttaaaaaaataacacgtcctcaaatcatggccctttacagctacaacattaagaattaacatctagcatttcaaattggtaacaaaggtgagctgtctacaatctacctttgggaagaaaaaaaaaagtaaaacctcaacagcaataaatgaataatgctcaactgaaatatgagaagaaaataaaccaattaaaaactagagggtggggcgcgatggctcgcacctggaatcccagcactttggtaggcccaggccggaggatcgcttgagcccaggcatttgagaccagcctgggcaacggaatttgtagagacagccttgcctctacaaaaaataaaataagctgggtgtggttgtggatgtttgtagttctagctacttgggaggctgagggaagaggattgcttgagcccaggagttggaggctgcagtgagctatctatgatcacaccactgcactccagtgtgggtggcagagcgaggctctctcaaataaaatacataaataaaaataataataaaaaaataaaaactagaaaagcacaaggtcttaggaagaaattgacatgtatgtgagactcactaatcacaccctgcaaatgtcttctgagtgagaatatgatctccctagtgcagaaaccattgtcttagttgcctttgtgtctccaaggtaaacctttgggctacatgacagaagacaacaaagggtgctgatccaatgcttgaatgttattatagaaaagtatcaagaatgaaagaagaaagaagtctacaggattgtataatataaacggcctgcgtacttttattgtctacccctgcctgcatttccagcttcccctcctgcctaactccccattgccgctgttctcaagccacacctgtcacttcagatcctgactgcactgggctccttcgagccctggagtcttcgcatgaaagtccctctgctcaccaagaccttcttaccctaataacttactactgccccttcaaccgcccgttctcaatatcaatatgtatcctcacaactggatcagaaactttggaaaccagctctaccagcatctaacatgtatttcagtttgtaattatacttgtgggtgatctgatgattatttttcttcaactgctggaagagtttctcaaccttggcactgctgaccttttttggtcagataattctttattgtgaagggggtctggcctcttcccactagacatcagcaacaaatctcagtcatgacaacctacactgtccttagacatcgccaaatgtcccctgaggcaaaattacccctggtgaagaaatgctacatcagagtataagccacattaaataagaaactatgtcttttttgctccgtattcaatgtctaaagtctagtaccatgaagagtacataggagatgctcataacatttagatggatagatgaataaaccacaagtaactacaggttaatgtcaggtctggttgtagctcgtagaatattctgggatagccaattcagagcagcaagtcctgtgtatcaatttctatcaaactttgagcactaaaatggctctgaagtatatgtaacaacaaagaatgcttattttcttctatgagttttgttgatcaaaattactttgttctttcttggactctagttggtgtctgatctctctctttgacagcagaaaacttgtcctcattcacttaagtgtttcctggtatctatgactaggcatcaaccttttaaagttgaatggataaaaaagtatctactatccattcttacaccataaagaactacttatataataatacctggtacacagcaagtgctcattaaatatttgtgaagctgaactgaactgtataaatcagcattaatttataatttaacacagaggaggcaaaggatgctggaaaaattatcagatgacaatgtgatgatgtccatttgaagtcaatagacttgtctttgcttgttgcaaattaaattctgcataatcagtctccctaagctttgtttttcttctctgttaagccagtagaaaatgtctttatagcctgccaagaccagctcggtccgggagaccctaacccagcagcgctagaggaattaaagacacacagaaatatagaggtgtggagtgggaaatcaggggtctcacagccttcagaggtgagagcctcaaacagttcacccacatatttgttaacagcaagccagtgataagcattgtttttatagattatagataactaaaagtattctttatgggaaacaaagggatgggctgaaataaagggatgggctctggctagttatctgcagcaggagcatgtccttaaggcacagatcgctcatgctattgtttgtggtttaagaacacctttaagcggttttccgccctgggtgggccaggtgttccttgccctcattctggtaaacccacagccttccagcatgggggtcatggccatcatgaacatgtcacagtgctgcagagattttgttttggccagtttgggggcaagtttatggccagattttagggggcctgttcccaacactagcctagttcatcagttgctgtataaaatgtgaaaatgtctgtgaatggctatgtgtggaaagcatttactttggttttatgcaaagctaagtcagggtcttcactcaatcaagtcttatgtggtacagctgagtgttggaaaatacaagataacatatagctgcaggtagagtccagtgggagctccgtggagggaaatttatctctacccagaagtagttggcaaaggaatcttctgcaatctgtctcaatgagtgggaattaaacaaataatgaaaagtagagaggacaatacagatagagaaacagataccataccaacggcagtgataacattagaattcatttattcattcatgcacttcacaaatattaagctttgaataaataggcctagactctgcaaggtagtactgaagaaaacaaagacccacagtcttggagtttatattctgaagacgataagcagataaatatatatacgataaacatatataccatgaatatagatctctgatcaactcctttctcctcatccttctcaatgtcatcaacatgaatatcatctttatacttgaggcagactagagatcgattgcattccaagaggcaggggaattgtggcagtcccaggaggtaggaaaatcatgtctcccaaaggagtcacttgaaagaaatataattaaatatgaaaaaaataaagaaaaaaaccaaaacatttaaactataaagagaatgtacttttcaggatgcccccacgtgaggcctctcagaaatgtaatcttactttaaaactcaatatgacattggaaataattaacaaaatatgccatgcaatattcaggaatgggagacagataaacagatggatggacagatagatagatggtacagtatgctatagtctgaaagttctgtcctctcaaaattcatatgtttatatccaaacccccaaagaaaggaaatcagtatatcaaagagatatccacacccccatgtttgttgcagctttgttcacaatagccaagatttggaagcaaactaactgtccatcaacaggtgaatggataaaggaaaatgtggtacatatacacaatggagtattgttcagctataaaaaagaatcagatcctgtcatttacaacatagataaaactggagatcattatgttaagtgaaataagccagggacagaaagactgttatcatatgttctcacttatttgtgggagctaaaaatcaaaaagattgaactcatgtgcatagagagtcaaaaaagggttatcaggcactggaaagggtagtgggggtgggatgtggggaagtggggtggttaatgggtacaaaaattatagtcagaaagaataaataagacctagtatttgctagcacaacagggtgactatagtcaatactatagtcaatagtaatttaattgtactttttttttttttgagactgagtctcgctctgtcgcccaggctggagtgcagtggcatgatctcggctcactgcaacctctgcttcccaggttcacgccattctcctgcctcagcctcctgagtagctgggactacaggtgcccgccaccacacctagctaatttttttgtatttttagtagagatgggatttcactgtgttagccaggctggtctcaatctcccgacctcgtgatccgcctgcctcagcctcccaaagtgatgggattacaggcgtgagccaccgtgcctggcctaattgtacattttaaaataactaaaataatataatttgattgtttgtaacacaaaagataaatgcttgaggagatggacaccccattttctatgatatgattattatgcattgcatgtctacaccaaaatatctcatgtactccataaatatatatacctaccatgtacccacaaaaattagaaattaaaaagaaaaaatatataaatcttaatccccaacgggacagtattaggaggtgggcgccttttggaggtaatgaggtcatgacagtggagtttcatgaatgggatcagtgcccttataaaagggatcccacagagctcccttgccctttccactatgtgaggacacagtgagaaggcgctgtctatgaatcaggaagtgggtccccaccagacactgaatctgtaagcactttgatcttgaacttccagccttcttatgtgtgtgtatataattttgctcagttacataacaaaaacctgtaagtaatttgctgaactaagagagagagagaggattgatagatatatacatacatacatacatacatacatacatagacagatagatacatagatgcatagagatgatagatacatatagataagatagatcgatatatatatagatacatacatatatgcatacatacatacatagatacatagagatgatagatataaattagatagataagaaatcaacagattagatagagagagaggggtagatagattaaatagatacttcacatgtagagacactacttatcaggaaggcatagtgagacatttagtcaattgtatgagtacatgatcatcagaaaaatgactcaattaacaagattcagggttctgaggaaggtgattagggaagctgtgaattctctgttttgggaaattactaagtttgaaaacacaacagcactccttgaaagtatgcaatgctcagcccgtgggtgtgcaggtggtatcctgtggttgctttctactgctcattttctgacataagcatatatttggaaaagagtagatactaattgagatgaggtttaatatttacttacactggtggcactcataaagtgcttatcagtggaaacagaaggagaacaaaattagttcacaaatctcatgtgatcgcccactctcccagcctagacaaactcactcatgtgccttttgtctttttctccctggagttcctctccattccaattgttcctcccctccattttctggaaggaaagctgggatggattccaacttctcttgttcctttttagagggtaaaaaatacaacttagggtaactagtagacataactaaatgtttcaaaatagggtgaaagggatgagatggaaatcacagttgcatgtctttctgcaatgtctaggagtgcagaatatgaatgagccaaatattactacataacaacatctgcgaaattttactgaatcctcctaaataagtcagtgaatctcaaatcgtacctgtgcagatgtggacaccatcatttggatattctaccatcattacatagagctttcctgctgggtagagttacagtaggacacctgataactgttttcctcgctacagttcaacacctatgaaacctgatgtcaacgcattggtacttaatacatcagtattttatttcagaatgttatcaaatttgattttaaaacattaatagtcactagttcgatgttgaaaggaaatacacagtatctctaaagcacacgcaccttatggtattatgaattagaccataactttgtggtacatgatgagcattcaaagcattgcaaagaatagtaatagaatacgtatgtgcaattgggtgcacctgagtgttgcacttgtgcgtgaggcatgtgtgtgtgatttgcataagtgtgcatgcattgtgtgtgtatgtgtgtgcacatataggtacacataaactaacttctgaatctgttaaatgttttctggtaccgcacagatctacaccttacttttcaaagttgctaatatttatcctaaatttcacctccaccgcaaattcttccatcatcaaacatttaccttctacttagtaataaccagcttaaagcactgttggaattgcatgtgactaaaaatttctagcaatacagaaatagaaacttatgcttgtcaagagaacagaaggacatactgcataagatttggcttgcttcataatcttcccaagtaagggctttagacgatattatttatgatgaaatatgttatcaactacattctcaggtggataatatctaactgcacatgagtttctgtgttcatttggcagagttatagctcaaggcatttatcagttgttcatttatatttatttctccatcttctctctctctcacttttatcctgaagatcttttttgctctctctctctctctctctgctcagactgaaatagaaaccaagatgcaacggaaacttggacctaggaacctgagaaatattctcacaagagtgccttcagtacctcatcttcccctcagactatttagatgatcagactggagttacagaaagtgaacaaaaaaggaagagtcaaagggacaggagaggatgggcagtctggaaagatcaggagtccctgagatggcagaaagaaacagatgacagacagattaaggagatacctgcaagcctcctgcatggaaggtcaggagcacggacaatgtatatggagttagaggtaggaaaacagaacctcacaccctaatccaagttgaaccaaacagatccagtggcctgaatttaatagcagagatggaaccaaaactgttagaaaactatgctgcgtaaactgttatcataattcagatactgggacggtaactggattagcaagataaaatcacattagaccatttaatcaacattattttacaaacgtgaaagtgtattatctccttttttttttttgagatggagtcccactccgtctcccaggctggaatgcagtggcatgattttgactcactgcaacttccacctttcagggtcaagccattctcctgcctcagcctcctgagtagctgggattataggtgtgcaccaccatgccccactaacttttgtatttttagtagagatggggtttcaccatgttggccaggctggtcttgaactcccgacctcaagtgatccacctgccttggcctatctcctctttagacaaacttgattcatgacattgtgtgtgacacatttatgtaatttagaatatggaataaaatgttttacgtgacataatttaacaaagttaaagcacaagcaaaaaaaaaagtacattagattagcaaatttaaaatatactaagaaattttatgtgaacaaacgtaggtgggttcatttacttttcagtacttagagactatcgtctagcacgttttcttaagtaacttatttcatttctcattaatgttaatggggaaattaccacctaactaactgccactgagtctcagaaccagcccttggaaacccatcccaatcattaagccaggagtttagctggcaaactgcacacataacacaactcagtcccaggctcttttctccaaaaagaaatgacattattttgatggaagccacttttcttgatttgcataatcatccatgaacacaacacagatgtcagtctttaaaggtaagggaggtggttagattgtctgttgttctttggaaatcataaaattatttctgcagtcattgcatgaggtccagactaacacatctctctccacacaactattttccactgaccaccaacattatcaatgagacctttgatatcacagatccaccaatggggatctgaaacccttgggaatgagtatgcttttgtggacaagaggaaggggactcagaactttttaatttttttacatctgttttatgcagcaccctcagaggaatatggaacatcactcccaaatcaaactcattaatattcctgcaggaaaatatctaaatgtccaccctgaggtggaaaagaaagaacacaaatagtcatctgtcagatcaggttttgcccccaaatgagttttgatatcactgtaaagttttgaactgtttttgactttcaaattgtagataagggactctggatctgtatgtcctctgatttctattaaccagtcctagaacagtaaacaaaacaaacactaaagagcaccccatttacagagtggtttaagtccactgaagttggttaacacttggaccctgaaaatccatgcatactgtatggaatcaattatgatgaatgtgaacagttaattagacaaaaagaacctccttgcatccaccattacagtataacacagaatatcttccctgccataaaaatcctctatgatccacctatttatcttttctttccccatccccaaccgaaactctgacaatgatggattttttattgtcccccagttctgctttttccagaatgtcctatagttggaatcatactgtatgtagccttttcccatcagcttctttcacttagtaatatgcatttaattttcctccatgtcttttcatggcttaatagctcatttctttatagcatggaataatattccattgtctgaatacaccatagtttatttacccattcatctattgaaagacatcttgttcacccagagggtctcttaatcttgatacttcccacaaaacagaactaggaatcagcggttatgtcaactttccagggaatccctacaagtggaaggctagaatgataggacaaagaactgcctgtgcctctccaggcaaaaacctgcaaacatctagcaaaaaccttaagcactcttgaaattcatttattcagataacctaaaaattgaaatatgaatttatgctttattctttctttaccaatatagacatggtctcattgatttgtggacaatgatgagcttgaattcaatgcgaagaatctttgaacactttcacatactttggccctagttctaccacagctggaggagctctgtttcacttgatcgttgtgctggatgccattcggccacatggcttattccagccgctcttgtggtgatctgctctgcctagacttcagccagcttcacgcaggtgcagcctcacttcatacctgcaaacttgcctttttcttgatttcctgaagtttctctgatgcctcacagtggatgcacactaaaacctacttagcactccccaagcagcctggagaggttacccccagtaaactaataagaggtgaaagatggtgtgaatatgggtcctccattttcaccgggtaaaggtggtctggagacacataacataagggttttcagacaacctcactgggtcaagcagcagtcactcctctgtggccaatacacttttttgtgtttttgtttgtttttaaattttaatttggattcaggggtgcatgtgcaggtttcttacatgggtatattgcacactggtgacatatggacttctagggttccaatcacacaaagagtgaacattgtacccataggttaatttttcaaccctcaccccctcccagcctttcccttgtttgagtccccagtgttgattgtttccatctttatatccatgtgtacccattgtttagctcccagttataagtgacaacatgctatatttgattttatgtttttgagttatttcacctaggataatggcctccagccacattcatgttgctgcaaaggacatgattccattctattttatggctgcctagtattctgtgttgtagatgtactacattttctttatccaatgcactgttgatggacacttaggttgattccacaactcggctattgtaaatagtgattatttctcgttccttcccacaacacagtgctggttcctcatccctatttttggcataatatttgcaataaacaagggttttctctaaacctctgctttgagtggaatctgggctaggaaaatacacagtggatcgaaatgtgcagcccttactgccaacaaaataaagactcaaagtgaattggcttttgaatgtgacaggtgtgtagccaaatgcccaacactaatgttgatgtcagcttcaagtcaaagcaccaaagccttctcacagaaattcattttccaacagaacttaagcttactttattttggaatctgcaggatactgtgaattattattaaatattattttttgtagaataactatgaatgcacacataccaaataaaaatggtggctcatgcctgtaatcccagcactttaggaggccgaggtgggctgatcacttgagctcaggagttcaagagcagcctggccaacatggcaaaaccctgtttctacaaaaataaataaataaataaataaaaaattggctgggcatggtggtgtgcatatgtagtaccagctactctactagggaagctcaggtgggaggatcacttgagcccaggaggtcgaggctgcagtgagccaaaatcgctctactgcactccagcctgggtgacaaagcgagaatctgtttcaaaaaaaaaggaagaaaaatactgcgtagttgtagaaatcaattttccatgccatgcaaggaactgatggcagaatttggtgtgtaggtctgctctttagttagtcaatccctgctcatctctcaggttttggactacattgtgcttcccctgggaagccctccaggctgcctccaagattggatcagatgttcctgcagctgctcctaagcatatcactgttttaagcagcatgagactaacctcattttaatctcattcttatttcattatctctaacaaaaactctaggtaatggccaagcacagtggctggcacctgtaatcccagcactttggaaggccaatgcaggaagattgcttgaggctaggattttgagaccaatctgggcaatacactgagatgctatcgctacaaaaatcaaaataaaaaattagccggatatggtggcatgcacctataatacaagctactccagaggctgagggtggagggtcgtttgagcccaggagttcaaggttacagtgagctatgattgcaccactgcactccagcctgggttgatagagcaagacccagtctctaaaaaaataaaacaacaaaatctctaataccctatgtactgcatttacaattttataaaccttcagaaaccaagtaatacctggatgtaatattataaatatggtgcaaaacattcaatcacgtgaaatacagggttatattagaatgaggtcaaaactatgagcagattgtatggagattggggttagccatgccataatccaacttttattattacagacaataacaaaaggttttactgtagcagtatattaactaatcctaatgaacaaaagaattaatgaattgattcactgacttgttcttttaagaaaactttcgcaatctctcactttctgatccagcaatccaaaaaggtcaaacaagggtctacagcagtgatcttacaaacccagaccttccatagctgcagaagtcagacatgcattgatcacatgcatttgggtgtgctcactgcatctgtgagcagtctgagcgaaaaaataaaaacaaacaaacataaatgtagaatgtgcaaaccccatagctaactctactatacatttctctttcaaaatcactactttattttgagattgcaaacctttttccaaacctgttaggatccagtctcctaattatagcagttagggctcaaagggagggtttcagaaataagccagattagggggtacaaatgtcagcatcacctgactggttaatgtgcctgggaggtggctagtcaagcagcagaaaaacgctttcctgacacagaaaaggaaaatcacaggtttcactccctccaaagcaaggctgccatgtataatctttctctcctttctcttctgccaagccacacagaagggcacagccccaaggagagactaaaaacatatgtggaattatagtaatatctccattagcaactaaatgtattccagagatgtatggcacagtcagaaactttgctcacaggtacaaagccaatctagggggtgggggcaggctgctgtctagacgctcagagtcaagtggaaagaacttcccagggctctgctgttccctctctgccctcactccttatccacaagaggctcccactcacagacagtaagtaccccttgcaagaaagaaatttggcgaccctcccaattgcaagggggctgggctgtcagaatcctgagtttctgtgcatccctccttgactgggctcaaaccctataagcagatacgcagcagattggttcttctaatatgcttctctactcctaggcagccttcatgctggaaatgcatttaattataaattattaatggaacgaaggggctgtagagagtttcttctctgaagcccctgttccatggaggcaggaaaaatcagaagtgtccctctcactaggaggagcatatctggacaataagcaaaaatcctggaaagagaaagaaatgcagttgcctgtagaggcacttgtaatatccacccaagagaaacagcttctatgtactttgagactctggctaacaaatttttgagtgtctcctctcggtcatcattgtgaaggactttggaggaactagaaattgaaatggaaggcaataataagaaaattcttagacctcaaacctgttcctgaatctgcacacagacagaggactcaaggttttgcattagaagtgacaggtgcgttactgaaagctgaagcccttagaggtggttcgaggcggaaatacctactctgcccagcaaagcgaagctaatcctaaccctaacccgaaccctaaccctaaaagaccatgatgcaaggcaatgagctgttacaaaccattctcattttaagatataggatagcattggtttccttatttagttttatttcagtgaaagtaaaaatatgtgaaagggcttacatagattcactcaagtgcagaacaccccaaacctaatgtatcttgttatatagtctgaatggtagtgtcctcccaaaattcatatgctgaaatccaatacacaacatgataactctaccctcatgaatgggatgagtgtccttataaaagaggctgcaggcccttccaccttgtcccttccaacatgtgaggataaatcaagaagatgccatttgggggaatgggccctcactagacactgaatctgctagcaccttgatcctggacttcccaggaccatgagaaataaatgtgtgttgttagctgggcaaagtggctcatacctgtaatcccaacactttaggaggtcaaggcaggagaaatgtttaaggccaggagttcaaaaccaccctggtcaacgtagtgagtcctcatcgctactaaaaattaaaaaaataaaaattagccagggatggtggcacacacgtatggtcccagctactcaggaggctgaggtgggaggatcagttgagcccaggaagtcaaggctacagtgaaccatgatcaagccactgcactccagcctgagcaacagaaagagaccctgtcttaatgataataataacaataaatgtctattgtttataaattacccagtctaaggtattttgttatagcagcctcgacagactaaaaaatatccctatatcttaccctgggatattaaaacatacatttatagctcttaaagatgaaatattgtaaaaattttttaaatattcagggtagcaaaaaagcatttggttggcaggagaataattttaaccaaacaagctagagtcatgaacaaatacattcataacctggcttcttgtatgtcaaagttaactagaaaatacttatatgctaaaatgtcaaatataattttgttttgctggtctaccttctagataaaataactgcatgttcagtgcttgaaaattaaaaatgatcagtctcagattatttcctacaatctgttgcagaggggggacaaggactaaaaaacttcctgtgctcattatctgggcacagaataacctagtgacgggatcaacggaagcctgaacctcagcaacacacaagatacccttgtaacacacctgcagacgtaatccttggatctaaagtaaaaacagggattttctaaaaagctatccctcaggaatttgaaaaaaagttacgtaaacacaaaatctatgcagataaacaacatcacattagattacaacccaaagtataaaataaatatccatgagtccatactgatatatgtaaatgagggaataaataaatgagtaggcgagaataggcacatctctcatgcaaaataacttcaaataatttctgtagatactctgccctcaaggaggggattatagtccccgctttcttttttttttttttttaatttatttttgtttttttgagatggagtctcgctctatcacccaggctggagtgcaatggcgcgatctcggctcactgcaatttccttctcccgggttcaagtgattctcctgcctcagcctctggagtagctgggattacaggtgtgagccaccacacccggcctcctgctttcttaagtgtaggctgcacgtagtgacctctttccacagggtacagtatagaaagtgtgtgtgcaggaggacgaacgtgatactggagatatctggccaacatcacctcatccatgggatcaaggttagtatcaactgcaatgtcatggtgctagtatgtgcccttgatacaatgtaatgaaagtggcacttcacctctggtcttcctctgcacaatccatagccccccagtataaccatgagaaaaacatcagacaaaccaaacaaggtaccaatcccgtgaccagccctcctcaaaactgttaaggtcatgaaagacaaaagaagaaaaactgtcacagtcaagaggagctcaaggagacatgacggctaaatgtaatgtgggatcctggataggatttgaggaaagaaaaaagacagaaggaaaataccaacgaaatcagaagaatgggtgggctttagtaaaaaattgcacacatattggctcattaatagtgtcaaatgtacaataatgatgtaaggtgtttctagtagtggaatttgagggtggggtataaggaaaactctacacaatcttcgccaatttagcacaaatctaaaattaaagtttcttttaaaaaactattataggtaatatttttcaaaacaataattcatatatatttaacttttaactcagatcatgtagtaaaaaagaaaaatctaaaaataaaaagtagtgacacaggtatttatcaagaaaacctgtagttctttaagttttggaacttactagatgttagagaaagacaagaaactaaaaacttacaacattgcaataaatctgaaatcctgaactgtaaaaatggcccagaattataacatcctaagggctcgttgcaatgccctggctttcagtgaatattaacattcaatccaggtgggaacgtgcttgtttcaaaaaaaaaaaaaaatgcacgatacacaaatagcagatggacttaaggactgacttatccatccataactgagtgattgcagtctgcagaattagatctacctctgggttttttgttttgttttgtttgttgctgttgtttttgagatggagtcttgccctgtcacccaggctggaagtgcagtggcgcaatctcagctcactgcagcctctgtctcctgggttcaagtgattctcttgcctcagcttcccaagtagctgtaactacaggtgtgcaccactacgcccggctaatttttgtatttttagtagagagggggtttcaccatgttggccaagctggtattgaactcctacctcaagtgatccacccagctcagcatcccaaagtgctgggattagaggcatgagccaccgcacccggcctacttctgttaaaccaataagtcttaaagtttttctaaatttctatattctctgggtttcttctactccatgaaagaatcatagatttaaatcctcagagactttaaatggctttaggcaaaaaagcatgtgtgaaggaaaagacttagtaggatattagtcactttacttatttagtttattttatacttatggaatttattgggacaaattccaaggttgtgctgttgtttataatataagataaaagtcatacttcttgtgagattgccttttaagccacatcctaccattttccctggcctatgcaatcagtgttataacttaaagctctaatttaatggaaagttcttaacaaaaaatagtctctgcaaagtcagcctctttccatcaaagtggcaaacacacacacacacacacacacacacacacacacacacaaacatgcacacatacacctgcttggaataagaaagtttacttttatatgaattatttacttttctcctttattattttagtaacgaaaatcagataaactaaacactacatatgaggatttttttcttaatacatacaatcattaaaaagaaaacactgaggcacagctattggtagtgactgagggtggaggagttgtgggattggtgaattattccatccttaggggaagctcagtaaacaatcttgccagccttccacatttctgccttgtcacaaagcctcaccatcgtcctacaaaccatcggtgtcctgcagataagctgtcacacagcaggttctgtcttttgtgaaatctacaaaaaatatatccctaacagaaataaacagtagtcaccatatcttcaattgttatagtctaaactaaatgggttcatgttctaaagtggatcttcatctctaaatggtttctaggaagaaaaaacaataataatttagaaacaatgcctgtgtgttggaataagtgtgctctttttttgagcaaatggccaagagaaccacttaataattcagaatcaggtaattccaggaggatggatgaatttcggaggaaatatggttgtaggtgggccagtaataactcataaaaatgtagagtgaatgactacaatactttaagagacatttattcttagggactggaaacaaaacaaattctacaggatcacggtggcacatatcagaacaaagtcatgttgtgccttgggaatataggataactcatgcatcctttttagaaggaacaggataggaaattcatgttcagtggacacatttctctaacgaatattacaggactcctgtatcattgtaggtaatggctgggcaaaaatatgcccctgttctcaggggcttcatgtcgccttgaaggagagagatgaattaacccaagccctagcatcccactgagggacgagaaggtaaagttggcatggtagaaccaaggaagccagaactgattcttgctgaagcaactgcaaaagatccagaaatagtagctcttggaaaagtacagacttggaaggagcatttcaggaataggaccacgtggaggcaaaaaacacatagatggatgctttctgtagtgggagaaatgtttttagaactggagaggtaaggaggtcaaggcagaatctttgtgattgtcttctgtctctatgcaacaattagaagcatcgttttaacgtgcacacctgactctgtggctctcaagatgcaacatctgttccaaatgcccagtgctttcctgtaagcttaataggaagacaccacccaattctccagctttatcatgcacagcttctctgtttgctcaagaattaagaggtgagcgagaaagtgctctcacggagttagagttacctttacaaatgtaataaagaactgaatgaggctgggcgcggtggctcatgtctgtaatcccagcactttgggaggccaaggtgggtgcatcaggaggtcaggagatggagaccatcctggctaacacggtgaaaccccgtctctactcaaaatacaaaaaattagccaggcgtggtggtgggcgcctgcagtcccagctactcgggaggctaaggcaggagaatggcgtgaacccgggaggcagagtttgcagtgagccaagattgtgccactgcactccagcctgggcgacagaccgagactctgtcaaaaaaaaaaaaaaaaaaaaaaaaaaacactgtgaaagagcggaaactttgaattcacacgtccactttcattcaacaagtaggtattgaacctttctttcttttttttttttttttttttttttttttttttttttttttttgagacagcgtctcactctgtcgcccaggctggagtgcaatggcacgatttcagttcactgcagcccccgcctcccaggttcaagtgattcttctgcctcagcccccgcctcccaggttcaagtgattcttcggcctcagcccccgcctcccaggttcaagtgattcttctacctcagcccccgcctcccaggttcaagtgattcttctgcctcagcctcccgagtagctggaactataggcatgcgccaccatgcccggctaatttttatattttcactagagacagggtttcaccatgttggccaggctggtctggaactcctgacctcaagtgatccgcccgtctcagcctcccaaagtgctgggattacaggcaagtaatcccaagtgccaagaagtgcttttaagtgccaagaagctttccagtttttggagatacaagtttcacaattaacatacttcatttttctctttatgtgtgtgtttagtgtgttctaatggactgccaggtagtagatacgattttggttgattgcttttggtcctgctttttccacataagaaaatcaaatttttcttcattatttggtgaggacattttcatgtcaacaatgcactaatgggattagccgttcaccttatgggaattggccagttttgtgggattagccattcatcttaaggagctcactttcattccctgtatcccaaccctactctttctctctcccttgactgcctcctctcctcatatttgtccgcatctttgttaaattccatgaaccatcttttcagttaatgccttggactcctcaattcctgactctcaacccttctttactcatggagcatcacctgtggctggttcaatctacctcctacctcctctgaacctgagcagacaggacatggctggaaaaaaaccctccaaccatacagcctaggttcaatgcatgctctactgcctctcacatcaaacactctcaatccatctcctagttaactcttctacactttctcctccgtctccagctcctccacaacgtcccatctgttaacctgagtaagtcccagcagtgagagaaaaacttgcccccacctccaactagcccaaactgcagcatctcaaccaggattcctggtcctgccttgttcctgggcatgaaacaaatggcctatacctctctacaagctactcaagttactcatccttgtgttactgcactcatcagcagcatttagcacagctgatcctttttcctgaaagtctattcacagccccctcaatccccagccactgttgtgccccttgaagtatctcccagagaatagaaaaatgctttggacaatcgcatatgagtggatgtgcaatgccacatctgagcagaagctgaaagaactgttgtacatgaacaccatttcctcagttcaggcatggcctccagcctggattctggaataaagacttggaagagaagtggggctgatgatagtccatcagtgaggtgcaacataagagaaaaaaaaaatgaagctttcatattgtaagtcattaaaatttgggttttgggtggatgtaattcttcccccagtctctctctctctccttctatctatatcttccactttctccctctctctctctctttctcatacaagtgcacacatgcacgctgcttctttcctcttcctcactgtcttctctctctcctcctcttcatccttctttttcttctagtacacttacttctcctctctatctacattcattgtgttggaaatgcgattcagtctcacaactgtaaatatcatctacatgctcatgtctcctgaccttgtatctccagcgtagacctctctcttcatgtccacactactgtacccagctgtctctaagacatctatctctccttggttgttcttaacttaaacaaaagcagtctcctaattccctcaccctaaagtgctcctctcacaatctccctgttgtcagcacatggcaacgcaattcttccagttacggcggccaaaggaattggggttggccataagttgtctctttctcattcattctgcattctaggaataatcgatttgttggatcttcctttaaaatattcccagaatctggccatggcttatctatcagctctctggtgaagccagcatcctcccttgagcgtattattgcaaaggccacctaagtatctccctaaatatacccacagatccttagagctcattctccaaccagaactcagggtgatctgataaaaatgtaaatcaaggctctcattttcatgctcaaaattacattgtgggttccaatattcatcacggaaaagctaaagccctctcaacggcctactgtccagcacctctctattcttatacccccacttcaccctcattttgtcaactctagcccaactggtcttctccatattccttggacgcatcaaggattctacaactccagggtctttgcacatgctattccatcctcataggaaactcttctcttacttgcttcagatatcagtatgaccacagcaataaaaataataactgtgtgggtccattcctattattccttatctactttattctgaattatttttcttcgtagcaggaatcacgatctgaaatactccaaaataacttccttattcacttaaattccataaagaaacactgtccactgtggtctactatttcactacaattatcagcacctagaaaagtgcccagatcatagtaggtcctcaatgggtatttgttgaatgaatgattgaatgcctatgttgggcaatcaaggagttcacagatatgagcttggagaaaataggaatcactatcctatctagtctttagttggataattaaacagatattttatgagttgataacagcaacagaaataaatttctgaagtgctcaataatacaaactggtaaatactaaacttttgagtatgtgatcccaaattcttaatgcaaaaagctcaaaataaccacatgaaaaaaatcacaaatactagaaagattctgaggaaaagaaagtaacaatgatcataaggttgaccatctatgagtgggtaataacgttggaaaagaaacagacaacagcctgggggttggagacacaatagggagcggtggggagtgtgactatggcaaagtgagtgctgtgtctaaagggaacagccacacctcatccacagtcacatataggccccatgttcccaaatcttttcaatattcaaaagatggtgtgaatgtaagttttcatgtaaaaatttacaacttttaaagatgtccagaattcttacttttgtatactttacagagcgagcaaatgtacctatgggtttgaaatggcccatcagtcatgaagacgtgatctttgtattatggaattaaggtaccattatatttatattactattgacagtgccaccatatttattatgatgactaacactccaaaaaatagctccaaatgtagattagataaattaattaacctactgaaaaaaatatgcattgcatcttgtcactgattcagaaaattgctacgtaatcacagctacacaaaacagaggcaggtgtggtggagtgtgcctgtaatcccagctactaagaaggctgaggtgggaggatcactgaagcccgaagctgcaatgagccatgattgcaccactgcgctcagcctgggcaattctgatttttatagcaagcccctgccgcaacacatatgtatacaaaacagaggcaagaatcaagacctataatgaagagggacatcataaaaaatggcccatcgacaaaatgatgactacccccatacgaacactgttttgatcatcatcatacacccagcacctagcctgatgcctggcacttatttggaactaaagaaaaatttctttgttgaattaaagaactgtagaacagtactgggagtggcagagctccttggtagctcaggcagctcattatgataaatgaaattagtaactgctaccatgaattaaagatctcgcatgagtcaggcattgtgctagggatttacataaattatctcagtaatcctcacaacagccccgttgaggtaggtgttattcttagtccctgtctgcccatcatataactgcagtgttcagaaagtaaggaacctgctgaatgtcaatgcttacaagagcaagaacctgtattcaaactggcttcctcactgccttgtccctagagagaaaactatactggtttctttattctatgtccagtagaactctgttgagcttgttaatcagattgtgtagcatagatcacattctgaagggaaaacagaggtaggcactagtgtgaaagcaggttgcccagggagaagaaaggagaggtataaaaagcgtgaacaagaataaaaaatccacaggtgtttgatttcatttaacacagcctcaagaaactttagagagtagaactgaccctgcaggcatcttctatgctaaataacatctaccatgacagcacttagtcaacaagtcaaggtgctgtatcctttgttacctctgtttgaagaagcatgaatgtgtttttaaatgattcacaatgagcttcgtccaaaatcattaaattaggagggaattctgcttaagggctaaggcctctaaaaaatatctaatttaaatttaaaatacacacatatatatacatacacacacacacacacacacacacacacacatatatatcgcctcaatggcagaagaaatcttatggtacatcaaaacctacgtttgaaaacataatattctagaatatacaaaattatctctgtttgaattaccctatgactaacatccactgcattgttgtgtctgacaaaaaaaaagcgttctaggttcaactcaggtctttgtaattgtcattatgacatggaaggagggatatgttgaaaccaataggaagccaaaaataaaaacacaccctatcatgcaacagacatgtcaggctctcatgcaatgaaaactgttggcaattaaaaaatcccaggctgttgtgggtctgtttgcccatggagatgcaggaagatgctgagagagaatattcttgcagccagaagtaattcctttgtgtgtgtgtctgtgtgttttcagacatctggcaaatgcctcctttattcttacgggaagagtgatgcttcacaactactccagtcacagaattttccatgccatcttttgaacaagctacccaaattctgttctctattcctttaatcaaagtatttacctactttgaagtcgccatacaaaatgggaaattcctggacagacagatggcagtggagtcctctgagactcaggtgcatttcacaggacagtcaggggagatagagctttccacctaggtattgctcttcgctcctcactgtctgggcggatcaatgcttttctcatcttcgttattccgaatgaagaaggtcacagtgcaaagctaggaaagccacattccaaggatttctggtaaagcagtggaattttatggcaatgaaaagaatcaggctggcgaaatctctcagaattccttctccttccctaagtgttgagtatttataactgcacacgacagttttcagataagagccagccagtggatggaagtgatagggagggaggaaagaatataaagttcttggtttagaaattagaactcgagttccaagggctcttcacagagggaccctcttttccctccaatttacccagaggcatgaaatcgagaggtgggcctttattttttgttttttatttttttcttgagatgcagtcacactctgtcacctaggctggagtgcagtggcacaatctctgctcactgcaacctctgcctcccgggttcaagtgattctcctgcctcagcttcccaagtagctgggactacaggcacatgcctccatgcccaggtaatttttgtatttttagtagagatggggtttcaccatattggtcaggctggtcttgaactcttcagatgatccacctgcctcggcctcccaaagtgctgggattacaggtgtgagccaccgcgccaggcagagaggtgggcttttgattgcccattggacacttggtaccttccaagacctctaccggcctcaagaaaataaaagaactcccaagaaatttttaagagccagtcaaaaagcaaagcacttaaaagaaaaggaacatcctatttaaaaaataataataataaaatgacccaagtaaacaaactgggattcaaaagaagcagatccctccaatggacagagagacaatgatagcgatataaagttggaacaaagggtttcaaaggaagtcacacgagataccggggagaagaaatgaaattgttgaactggagagcacaaagaacagactgaaatggaaggatacccacaaacaatgcacataggagccaaaagacagagatacattttcccaaaatggatctgggatgaaaaatggtggaaaaacatcctccaaatgctaaagtatggaagatggaaatagaagtgttaccagtcctataaaaaaaaatgacccagaaagagaacaaagagaaaaagactaggaagaactacattagacagaaaggctgagaatttcccagaatgaaagaaaaaaaaaggcttaaaagtgaaagtactcacaaagtaaataatacgttgatttaaaacagaacaaagcaaaaacaaattccaatttttgagtacctcaaatgtaaacaaaatatgtctaatttttccaaggagaaaaagcaggcgatgtgcaaaggaatgaaaaccaggctaattgcaaagcaacgtaggatacaaaatgcagtggcttctcacccccagcaagtacaagggaaagaaaatcagcctggattttatgtccagtgaaactgtcatttaaatgatagcttaaatccaaatccacttacatcacagaaatcttgacacaatatatttctgcaaggagaggaacccagaacacagcaacataatacaggtaacgacaaaaaattattccgaagaaacaatgatctaaaatcaaatttttaacatgatctagagcccagattctcttagaatctaacacagtgtggggtgattgagagagagagatgccgaagagtagagaaaatgctaaatcaatatcttgttttgaggaaaattatggatactgaaatgtttgatagctaataagactagatacatcttcattaaaatataagtgcagcataaaatgggaagagggaaatttgatgaatcccaactataaggaaaaaaaaacagaagaaagaaaaatataataataaggtcagtaaaagaaacttttaaaattatataatggaagtcaggtaaagcaaaaaaaaaaaaaggtaaaatttaaaaagcatgattgataaatataaaatataaaataaaatgtcagaagtgaaatctataataatgataactgcagaaataaaattagaataaagataaaatattgattaaaatacttttagcaacatattgttgaaaagatatatttaaaataaatggatacataaacttgaaaatgaagacactaaaaattttaaatataaaacaaaatataaatgaaaaaatatcacaggaagcaaatttagtatcaaacaaaaattgtaaatgtcaaaaatggataataaatactagaaaaggaatggaagattaaaaaggtgtaactgacactttcatgtaacatcctaataatacagcttcaaaacatgtaaaaggtatataagtacattttatatatacatactacatatatataacatagtatatccatatacattaaatatataagataaaggacagataagaaaagataaaatgttacagtagaataaaacacaacattcttggagtgataaacttaggaaataaaatgtaattgaggatataggccagttgcagtggcccacgcctgtaatcccagcactttgggaggccgaggctggtggatcacttgaggccaggagttggagaccagcctggccaacaaagtgaaaccgcgtctctactaaaaatacaaaagttagctgggcgtggtggtgtgcacctgtgatcccagctacttggaaggctgaggcaggagaaccacttgaagccagaatgccgaggttgcagtgagccgagatcaggccactgcactccagcctgagcaacagagcgagactctgtccctagccccacccaccaaaacaaataagatatagaagactgaagtaacccatacatgtgatctggtgggtatctatggaaacctatgctcctcaaaacacacattctcacatatacacgtatatctgtatttgtatttgtgaatatgtctatgtatgtgtaaatgtgtccatagctttcaagcacacaccgaacgtttacaaaatctgcctttcataaagagtactttaaagaaacagcagcattcagcactatattctatcggtcaacagaattagaaatcaatagtaaaaagcattcaaaataatgatagaacactaaacatatacacacacacatctatgtgtgtatgtatatgtgtgcatgtgcctttatgctaccgtataaacacaaaacagtcagagtccagtgatagttcaaatgtcacatgtgaaaatttgtcagatgggactgaagaagtgcttaaaagggataattaaaacttcaaatatctttacaaggtaacaagaagaattggaaataaacgagccatggaggcaagtcaagaaacaggaagaagagaaaacagaataaatccaaataaatctgaaaataggaaatgatcaaggtaagagcagaaattagcgaaacagagaaaaaacagttgagctaattaccaaaatgaaagctagtttatcgaaaagcttaataatataaacaaacttctggcaagactgaccaaggaagagtaacatatacaacaaataatgaaacaaataatatacaacaatatacaacaaataatatacaacaaataatgagaacaaatagtctttaaagaggaaaatcatttttaaaataacaaataaacaaagttataaaaaatacaaaatactattttaatagtataagccctggtattaaaaaaagaaattgaaatatttgaggaaaaaaacaaacaaagcaactttacgcaaagaaatgaataaactaaaagctataagtagtaatgaaagaatcactaaaaatctcccacataaaaactcaccacccaagataattttcacaaaaattttagtaattctacttatttaagttttcttcagaaaatatacaattaaagaaagctacccaaatccttttgtatggacagtttaacattcatatcaaaagtatagagtgtataacatcagaaaattataaatcaaattcatttatgaaggtagatgtagacaacctaagtggaatatttacaaaccaaacttagtagaatagtagctatttttcatatacaatatattccactataatagaataatggccattttaaaaatgtttcttttaagattaaaaatgtgttattcccgaaattgaatatatatttaaaaatatattaattttcagagcacattaattataagagaagaatcatataaccagctgtagaaatgccagttgattatttggtcataatcaacatttatgaacaaaagaaaacattttttaaaaacttagaaaaaactgggaattgcaagtaattcatattatctgataatgactgcatgctttaaaatctctcctcaacgctgcatttacaaaaaagatgttagactcatttcctgtaaaatcatgaatgggaacaaaagtttgtaccaacagtattcatcctcgcactggacgtcagtgggccatacaatggtacaagttataaaggaaatgaaaattacaagtattgaaaggaaagagagaaaatggtcattatttgtacataatgtcaccatttttatggaaaccatgtaatttaacagaaaagctactagaaataatagggaatcaaaaaagatggctgaacatataatcaatgtataaaaaagatcgacattcttttataccaggagtagaaaatgtaattgaagatatcatttgcaaaataataataataatcaattaacacataatgctcaaagtctttaataaagctatgattagatctcaacaagtaatgaactatgccagtttacaaatgagataacatgagcttggaagatgtttatttttcctcaaaccaacatttcaataaatacaattcccagcaaagacagaagaatgttgcagattttgatacattgattccatattgtatatgaaagaataaattctacaaaaagcaacgagaatgttgaagatgaaaaatatatgggcatttgtactatttgagtcatactttaatcttgcaggaatggatcaggaaatcaacaagaccaaatataaagcccttggattggctgatgtatatatgatgaattttaaaagcttgtactattttgtggggggaggagtctgtccccttcaagacttttcctcatctccactcctctctggtgtggaaggtaaataaacaggttcactcttgccttctggctgctcctgggtttcagccaaggaagacactagcaggtaatccggagggcagaaggcgagtaaggcctgtatatatgacctccagttccctccctggtaggtaggtccagttcaacctcagcgggcatcagcaacttcacataaggactccactatcctgtccccatcttaattacatttctcaagttgcatgccatttatccctatcaaggtcctggctgacaccacaaatcattgggaaagaatacattgtagctgggcacagtggttcatgcctgtaatcccagtactttgggaggccgagggtggatcacaaggtcagcagttcgaggccagcctggccaacatggtgaaaccccatctctactaaaattacaaaaattagctgggcgtggtggcgtgtgcctgtaatcccagctacttgggaggctgagggaggagaatcgcttgaacctgagagggagaggttgcagtgagctgaggctgcaccattgcactccagcctgggctacagagcaagactctgtctcaaaagaaaaaaaagaatacattgcttccttcatgtgtcaaagcaatgttcccctattggggaaaaaaataacatgagattcccacctcatttcatatataaaaataaactctgcatggattaaaaactgtctgtatgaacaatgaaattctgatacttataggaaaatgtttttgtgatgttggggtagaacaggatttctttaacaggcactacgtaggagaaaccgttagaaagaaaaatatgttgatggcattttgctacattaaaactaatggttttgtttcaatcaaaaccaggaatgatgggtgggtgccagtgggagaagatatttacaacatgtaaaactcaaaatggttgagtttgctttaattttttagaatgggagttttgctatgttgcccaggctggtcttgaactcctgacctcaagagatcctctgtctcagcctcttgggtagcaagaggctaccacaaggtgcaacacaggttgcaccactgtgtctggcttatggttgactgtttaaaccagagcattctcccctgtgtgcccgtgtgtcttcaatgggtcattagggagttgaaacatggggccctacgaaggctgggacagactgaggcacacacccctggcaacatctttttacaccactgtaaatagtctcagcagagaatgcgccaagctatcattatcttctattttacataatatgcaacaaaactgagatgcaatagagtaaataatacaagggagcccacaagaaaatgacagtccactctagtaaaaaacgatatgatgaaaatgtttgtatataatacactctgaatattcctccatatcactaaatattatcctgtaatgccattttaacagctggtattcaatgcttgtattgtatctctaattatgtaatggattctacattgttaaaaattttggttacttaatggaggaatagaaaacaaaacaaaatatcacatgttctcgcttataagtgggggctaaacactgagtacacatggacataaatatgggaacactccacactagggactactagaaggggaggaagacagggggatgtgggttgaaaaactacctgttgggtaccatgttcgctacctgggtaatgggatctataccccaaacttcagcatcacacagtattcccatgtagcaaacctgcaaatccgtgtctaaaatgaaagttgaatattttttaatttttttttgctatcataaaacatgtaacaatgaacaactatatatatatgcattcttctgcactttcccagttacatcctatggataaaattccttgaagtgcaatgcattcccagctcatatttcaggcatttatttaatactacactacccactgctgtgtggtctcctgaaaagatgtgtgacaatctgtgtatcctcctgtgctgcatgagtgggcatttcaccccatccacagctaatggggtggtaaataacagtgacttttaagagatggaagaggaaataatttataaagtaccatggctgcagagaaaactgaaatcttcctttcaaagagaaaaaagaaacaacaggtcgaccatccacactgtgattcacatacatttgacagataattattgtcagctatactttctgtgttgctttcttcagcagcttggaagacccaagtggaagacacaacccttgccagtcaatagagtactactagccatgcacagagaaggtcagcaagtcaccccatgaaacagaaaaggggaaatcagtgtgtggaccagagagtacacattgcaggcaggaggcacccttgaggtgtgagctggcagagaaaccatatgagaaacaagcttagttagacccttctattgatgcttgattttgccttgtacatatttcactagctaaaaagactaataggtatccaacataacagtttttgctccaaaacattaaattcaccaatgtatgattgcttttcaataagggcttcatgtatccttatttttgaaacgtttctcctttccattatgtgacaataaacaatatgtttaggagtttcatttccgtggcaaaaagaatgctttgcttacttcatgggtctcacaacagggcaggtgggaattgaagaagccaaagcaaaatcatgtacccatgtgaaagccagactccttttttatagtgaaatgtttaaaaaaaaaaactattttggcttaaatgcacagttttcaatgtatatgcaaactgtgggggaaagaaagataccaaatcttttttttttttttttctttgagacacagcgtcttgctctgttgcccaggctggagtgcagtgatgtgattacagctcactgaagcctggccctcctgggctcaagctatcctcccacctcagccttcctagtaactgagactacaggtacgtgccatcacactcagctaactttttagtcttttttatagaggtggaggtctcgctatgttgcccaggctggtctcaaactcctggatcaagtgattctccttcctcagcctctcaaaacactgggattacaggcatcagccacgaggcttggccccaaatctttaaaatattccccatgctccttttcttttttaaaaaatgccaatcttgattggattttccctcactccttcatataacaatgttatatattttaccattttggcactccacatgaaagcctctgaaacagagaaaaggccccaatgtaaatacagttactgttgttgttactataaaaaaagccatccatggaggtataaagcttacctaaagcaaacataattttgacaccaacctttcctttttaagactgtgtgctttaactttttcctactaaaactctgttgctagtagcattacttctgtttcatgcactcacaataaatcatagaaggcccactttcctgcctcttctataaaactggcaacaatgatgttaattgtgcatgaaaaatatattaaaactgtaaatcatctctattttcgagcaggatgcaagaaacaaatgtaaagtaacaaatcaagtgctgtttcttttgcccatatttggccagaggccattattttaaaagcacaaaattagagcccactttcatcaattaggccttattctttggctcttgaatctaatcaagaacatgtaaaaatgtatccccaatcccatggtaatgagcacggattaatcctgttaatagtggtggaaggttctttttatggtgcattctttagagtattcatatatgtggacatttttgtgccaactgtatataaaaaaaaccaaaacatttctttttgatgctttcttctcactataattatggcgtagtgtttgtcacttcctaatggctacagcaaaattctgctttctattccaagcaatagtaaatacatgtttttctgcaaagatgaaaagacgatcttttatttttaaatacacctatggatactcttttacagtcttgccatgccaatcaatttcaaagaataccaccgataaataatattttgcagcctaacttagaaagcagaaacaaacataaactatatttaccaaaagactattcatgcattaaaaaaaaagaaataattgggacaaagatctcctatcttccctgtatatgttactctccccttctttaaatgttccatgtcttgataaattagcatggcatgctaatcatctgataaactaatccaatggtcagcttgttccctatctaatccattctcacttctttggtgactcttggaaatgagatggccatacactaaataaataagtctttggtgttcagaaattcaggcagtgtgccaagataatgtaggggccaatcacccctctgcagaataaatcaaattacaccctctagatgtctgcttaggctgaatcaagcaagttaacaaataactggcagtctctgagtcattaatctcaaaaggcaaatcagagcttgtcactttgctgcttaaaaatgttccttcatgggactccagctgtcaacatgataattcccaaataggatcaatgagataatacatgcacaccaacttctgtagctttggagcactttggggatggtcaagaactgtgcattgtaggacttgtcccttttcactgtcccattggtgctccattgcaatttggtgccaatctgtctgcacaagcatttgttcaattgctccacattcttcagtgttccccaagcacaacaattttctcagattctcttcttctataggcttctacagtctacctcatgttttctctacctcagtactgttcacattaggggccagatcattctgaggtgtggaggctgtcctatgcactgttaagatgtctagtggcatcccttgcctccattcccagtaacacactccatactcacaacaaacaaaaatgtcttcccacattgccaaatgtacactggaagcaaacctgtcccctccccaaagttgagaaccactgatatacactaggaattaaaaattgagtaagacaatgctttgacttagagcagggtttcacaacatcagcactgtgggcatttgggggctggatgattatgtttgttgtgagggctgtactgtgcattgtaggatgtttagcagcatcctctgccttctagatgtcaggagcacacactgcccagatgggataatccaaaatatctccagacattgctgacacccccttgccagctgaatctagaatcagtaagtaaaaaacgattacacatgcacaatacagagccaagtttctcaatatcagaactactgatattttggactagataattctctgctgtgtgagtcgttcttctgcattttaccatgttcagcagcatctctggtcaccacctactccatgtcagtagcacctccccagctgtgacaaccaacaatatctctagacattgtcaaatgtcccttacagtggggccaaaattgctcttagttaagaatctctgctatgcctaataacattcttccacgtcttcaaaatgccattggaaatatctccacaaccgctaaacccatctgagagctccagatagagttggctgccctgtcttcccccaacaacttggacttatccctcctttattcatccttgccccagtccagcatcattgctccctgtaggtccccaaggtaatgtcaattcctcaaggcggccattcagacatgtggatcagcagctagcacacttggctcactgagtgatgaggggatggtgtgagttctcctaagatggtaaaaatggagacaggagggcattcattgtgtcaaaagcagcagctgagtttcgaacatggtaagtttgaaacatctctaaggtggttctgtttgtatggagtctgggggagcaactgagattgacgcatagaaacagaccatcaccacaatcattattatcgccataaattatcatcacaataattgttatcttcattgctatcatcatcataaccatcaccatcaccatcatcaccatcgtcatcacgataaccaccatcatcattatcaccatcatcactatcaccatcaccatcctcatcatcaccatcataaccatcatcatcaccatcatcatcatcatctagtagtagtagtgtataattgtgtatatttattcatattttgattgattgtgttctttggccactgggctgacagtgttttgtttacattgatttgattttaaagatctacggctaataattccttgttgcacacacacctcctaatttaactgaacacagatatactttgcaactatttcatcttgaaggtcacttcagaaaattatcttgcataagccatatggaccatggttttaaaatcaggcttttatcattttttcctaattggtttttaatgacagaaaggagtatctgtttatatgtggattaaaaatatttcacgtccaattttctgtttcatgaatatgtacatatataaaatttttgccatcaatatcacctctaaggtcactaaaaggcaaattgttggaatctatacccagattttgagtcactggaagcctggatggagcccaggaatctgcatttggaaaaaattcatagcaagtttgaaaacaattgctgtctgacatggaacttctgtactcttccattcatgtctatatggtaactagaaaatccacatgcgacttcatgaagttggtcctttacatcaggggtcagaaaactttttaaaataaagggtaagatagtacatattgtagactttgcaggccatatggtctcttttgcaactactcaacttcgtctttgtagtgtgaaagcagacatagacaatacataaataaaagggcttatttgtgttccattaaacccttcacaaaaacagcagtgtgatagatttagtctacaggttatgctgtccacccttgcttcccatctctaaaaggaggtcagacccccttttagctaaatacttgtcctggttgagcttctcagctttcataagagcacatctgtcaatattctctctagctcgactgatgactgaaggatgctgccctgtaattaactgaccatacagtgactacacttcatacggttggctgagtgcaggacttcaaattcactgtcatttggtttctttaacaaaacttagctaagagaatcgatattaatgtcaggctgtggacttcagccttgaacgtgctcctctgtctgtctgaaatgactctcctcccagcaatttggtcagttactgattcttcaaatttctccttagtgcattttcaccctctcagtctgggacacatgcttctcccagatgttctcacatctccccaacttgttgcatcattgcatggattacactaaatgatgattccagttagttgtgcattttcccctgtatgttctgcaaggaaagtgatggaacaacatttagcaaagtggcctgacaattagaataagttcaataaatattcactgagtgaataaataaatgaataaactacatgtttgctaatgcctggggcccatatggaagcaaatgttagcaaacaatccaatgacacttaatgtcgtaaggatatttagtggtgcctacgtggacttacagagctgcacaagaattgaagaccaggttatatcaccagcctgagaactcactcacagcatagtctcacaaagaagtctactgagcagaaagagcaggctgactgagaaggacctcctttgctttttgaagaattccttgtgagagaactggaagctcttttgtcagccatttgcctaatgttctacaacgaaactcttcccaaactttcaccctgctaaacgcttaggctgaagtttggccaaattcatgttcaccagatcagctccccaaattggcttatccttcagtaaacctaacctttcagttagaactcttaaaagagatggcaagcacagcatgttgcgcccactcctaaacagcctcattcatttgaggtcacgtttcccatctggcattaaatctcagactatctctgatttgccaccagctgacagcttccagacccaggagtgtcccaggagggtgactcccaacatagaactgcctggataacatcctaatagaaatatcctcatctgttcctgtcactttatctctctatgtcactaagagctacagctgtttacaaaccaacaacaacagcaactgatatacaagttttctcatttctgaatgtccaagttcctctttttagctgaaaaaaggaaatatcctaggtaaggttttgccccaagttcatctcctcttccatgaagcagccatgccattctttcttgtttggtactatttgtaatataagcaacaatggacatcaatgagttttgcttacctagcattcaattttcctctggggagcaatcttacttccatctaccctaagcctactggacttacccaatctcttctcatttctgaagagtatacataacccaagcagtccatatcaattcaagtatctctttccactggatatagacattggttggcatgcaactaaaattaggccagtacgcatagttgctaggccaatgtgcttctctgagaaaaggatgacatactaggaaatgctgttgactgcctaccaccacacacggacaagcctctctaagaaagccaaagaagaaacatggcgccaaagtgccagattcctaacagcaatgattagacctgaggacaccattttcgaaactaaatgcaccgctagtaaatggaacccgaaaatctcttcttttcccttaagtgaattcaacctgaatttctttcacttgctaactaattgttcctaagtaattaaggattgcaaagtctcaaaatatatatccctccaatggagacataatatctatgtagaagttgggttacaatctggccaaatttgaaatccatgtctttttttagaaacaaggtcttgctctgtctcccaggctcatagctgccatgagctatgattgcaatggtgctatcatagctcactgcagcctcgacctcctgacctcaagcaatcctcccacctcagcctctcaaggagctgggattactgtgctcagctgaaatccatgttttgcatattatgccacattagttattgactgctatgtaacaaataaccaaaacttaacagtttcaagtaatgtatttattttatgagtttctgcatatcaggaatccaggcacaaccttagcagggtccactgctttgaagtctctcactgatgaaggtgttggcctgagctggggtctcattttaaagctgaataactgaggaaggttcgcttccaaacttatgtggttgttggcaggattcaatgccctgtggactgctggactgaaagcctctgttccttgctggctgttgtttcagaggcagctctgagcttcttgccatatgcacctgtttaatatggctgctctttcatcaaagcatggaaaccaagaatgcaacaaaaagggtatactagtaagacacaatttatatgcttatgtaacataatcatggaagtggtgttccattatctctaccatattccatgagacacaaacaaatccaatgtcctgcctacactcaagggggaaggatttacacaaaggcagtgtctttcacttggaaaatgccagccctgagagactggaatccaagacctacttctctggtgagcaggggagataggacatagcctaaaggctaaaaatgtgtcaggggagctttgccctggacagagcagtgggtactgagagaggattttaggaaccaaaaatgcagacatcacctcttctggcttctggcattcttaggcagcatatgtacgcagaatatacctaatccagactgcattcatttctggggctttgtaactaattaccacaaacttggtgacttgaaacaagaacgcattgtctcactgttctggggcagagtccaaaattaagatgattccttctagaggctcttaaagaaaatccatttcatgcttctgtcttggattgagttgttcttggttcctggtggtttccaacagtgctccctggcttagggatgaatcacttcaacgtttgcttccatcctcacatggtgttctccctgtttctgtctttgttgttgtgtctcttcttacaagaacaccaattatattgggtttaggatcttccctaacacagtatgaactcatcttaccttgattacatttgcagaaatcctattttcaaataaggtgaaattcctaggcaccaggagttaagacataaacaatttttttgagagacacaattcaaccataacacaagtcaactcaaaactcatgccaagagaaaactttactacctatgacgtggcctgtcaaagtttttaaaacacagattctaacctatgctctgcagtcttaaaataacaatatcaaatctcaaagaaattgattcctctaaagctaggacctcacaataccttctcatagctactcaaatttagataatgatgatggcgatgactctgatgatatttttgatgatgacaagtaactacaaaaccttaagttgaatgaaatgcaagaggaagctcattttatcctaagtcttagaataagctttccctaatgatgagctccattattttccaacctatgaactttaattaatttcttggaaatgattccttctgcattctatcaaattatagaccactgcatttaaaaacaggcaaccagctgctttctcaaaactataaaccaattagtttattggccattctatcacacatgtatgctgccttccctccttgtaacacctcaggggcttggcatttcagggaaacgtgcagtaaacagactcctggcttggctggtgattgttgtgcattcagcatccggtgggaaaaactgagcttcagcaacaaatggctttgccttgctgtatatgctgacattttgtcataggaagtggaggtattctattttctttttaatttctaaggcatattataaaatatattacttttaaaatattacaaaaacttgtggcttccagctcaatatatataagccaagggtttaatgcatttgacaaaaaaagatctcacataaactctgggtatattcataacctgtaatgtgatgcatgagaatagatgcttgacactgaagaggatgcttgcaaaagactacctagaaggaacataccaacatgttttctaagacttccaaagctatgtattaggagagaaaggaaacattccaaatttcttcatctctgtttgtagagagtgctcaggtaaatattgccaaccctttctctgataatgaaattaaaaagctgtaaacgtctttatcggtcaggttcaaaaaaaaagctgggtggccaggcactacaggtttattcatttgttccatgtactgaagtatatgattcattcttttatctcaaaaatgctctgggtcttcaaagggtttaccatctactggggagggcagactcgtaaaatggtgattaaattcaacttctaggaactcaggggaggatacttcatctctgcttagagtgccaaaaggttaatgaacgggaaaatactgtatggtgaaagagttttggtgaaatgacctcaaaagctccttctccttggaagatgttatcattctgtgattaaagtctaagttgactctatcgtttccgtccaggtaaatttccagtatgatattcaatataccaaaatcccctcttataaagcaaaacaaaaaaaaaagtataaaatgcaaagatccctgtagaatgtgcgatggtgaaatttgttctcattattatctgattttagctcaaaatgaaataatttgttaacattttaatattcttgggaaagctgaagttttctccctaaggcttacttctctatttttaaatgtaaacattttagaaacatgcaaaatagtattataacttgatttcatactagttatctggattagtacatttccaatataaaattatgaaagtactttactagaatagaaatttggaggagactgaaagcttttgtattaatgatttaaacaccaggtgataaaaagtatatttgaatttggtaagaatgggacctcatgttctttgatttaactttattctatagtctgctaaaaagaaaagataggcattagaattagtttggatggaattccatttatgaaccctccaatgtcacaatgtaacaatttaaaaaatacccaagtgagtattttgcatgttaaattacaacatcattgcaccctcctccagttttgtcttagttttatctctcccttctccccagttttgcatcttttatgtctccgtgcagctaaagaagcaataaacaagaacttccattttaggaaacatagacagcatttcctcactgcacaaacatgtgtttacgctctgcatattcactcaaggctgggtgaaaacttttctatcaaggatcctccatagaaaacatccactttcagatttgcctccattttcttttccctgaaatcctaaagcagtccctgaagacactgcttttgatgaaacgttggtttagttgggtcacatatcaatggggctttcccactcacttttccagcagcgggtttagatctctccagatatccacttagactcacccaaggccttgtctatgctgattgcaaataatgatttatttactaataatttttaaatgagttatctaaaatgcctctaaagaaaataaggaatggaaaagagaaaaaaatacccaaagagtctagattggaattaggagatcaatagtgtcattggcccgactggaggctaaagtccatatgtgacaggcaaatgggatgttaggtgaatattagatgttcccttgttgagtgaatgactgattatgtcataaaagacagagaagagagtagaatgtagctaaagacatccattttaaggaagaagaaaaggagtgttcaagaacctacaattttcatatcttgttgaaacccaccacaagagctcctttgcctgagataaatcagtacctgctgcattctttctttctgatggcaacaggcactttccctgaggcaaacttgaggaccgtgcagacaccatgcacagtagaccaagaggatgtctggcttgaaggagactttgggatgtttggggtttcagagaggaagaggatatagtttaggtgttgtaaaacttggcacttcccagaaaattgtaacatgtttgatcttaactgaattgtggatatttctcctaccgggtttccttcaatagcattcacacacagacacacacacacacacacacacacacacacacacacacacaccacagaccacataccaatgcctaccttcaccatcaaaagtcatcgtcagatacgtaaagtctaacaaggaaatgtttctcttttatttcttttttagatacagggtctcactgtgtcacccaggctggagtgcactgctgtgatctcagctcaccatagccttgatctcccaagcacaagtgatcctcccgcctcatcccctcaagtagctgggactacaggccagcaccaccatgcccagctaattttttttttttctggtaaggacagggttttgtcatgttgcccaggctggtcttaactcctgggctcaagcaatccacccacctagacctccccaagtgctaggattacaagagcaagccaccactttctaatttgtggaaatctggacctgcttctctgaacctcaatatagaatattagattgaaataataaggtggagactacactgtctcatctttgctttattttaccagtagcaattgcatgaagagatcactcctttggagtttttccctctggttcccttgcctttaagctgactgtgtgatttaggtagctctgatttatttactgagagtggatgtttttgatctcacaaactctctgtggctctcaaatctggagctcacaacttctcgatttctgtttgcagtttggctgtgactgcaccaaggaaaggggtgcttaaacataaagacaaaatgttaaactaactcattatgaaaacagcctggttttaggagaaccagccaacagtctagtaagatcggatctactctcaacaatggcttccagtaccccactcaggcaaagaatcttgcaatgaaagataaagtcatgggattaacattcaattaacctgacatcaaagtcttaatatgcactaatcttatctcttttataattatttcttatatagttgtttactcccaaatcacaataattataaaacaaattcataggatgtataatcatattactcttatttttaatagctgaggacactaaatatttaaaggttaaatggcttggctaggccaggcacggtggctcacacctgtaatcccagcactttgggaggccaaggcaggaggatcacctgaggtcaggagtttgagcctggctaacatggtgaaaccctatctctactaaaaatacaaaaattacctgggtgtggtggtgggcacctatagtcccaggtactcggcaggctgaggcaggagaatcacttgaacctgggaggtggaggctgcagtgagcagagatcataccactgcactccagcctgggtgacagagcaagactgtctcaaacataaaaaaaataaaattaaaaaaataaataataaaaattaatagcttggctaaaatagtacggaaaataaataaccatgttcaaaccagcaatattaattgacaacaaataagactacaacatcttaggaagcaagactccacaaataaataatgagctaattgttttaaatggccaaatattccagtggactagttgtacctaaagtttctatctctgacaatttctaaaaaaaaattcttatgatatgcactatgtgaaaatttgatttttaatatattctaggtaatctgtatttgttcaaattatgacaagaatctaaattgcaaattgaattgaattaaaattcatgtattggaagattatgtacataagggaaaatgttctttgttaggaaaagatatttcttaattattcaaacaggcataattcatactactaaatagtattattccaaacatatgtaatttctaaaccctcaataagattattactcagtattcaaattgctgaaagctttttgagctgggggagagacacatgctatcggaaatccactccagtttaactgtgcttacaaaaaatactaaatacttttcaattaatccgtgtcagggagatctttatttaataatctttcataattatctttacttataagctgtgtctacacaatgtcaaacatccaactgacagatgaaaactggagtaatttaattattttcacctagttgcatgttgatgttgattggttaaaacatctgtctcaccgtgttaacacagttttcgtttttcacctatattttgtgactgtatgcgtacaattggactttgtgtgtctagacaagaagagaaagaaaattaatttctctttaatctcacacacaaagaatggtgttactgccttttcacggtttaaggaacttttccaaaaaagttaattctaatcctttcctagtgattaatttctctaattcacatatgctcaaaatccatttgataacacaggctcaaaaggactaaagttaggaataaagcagaatgataatagtgggctctttttaaaaatgttattcctcccaaaattcccttttgttaaaaccatactagaaactgccagaaatgatgggctatttattggtcttacttcttaagcttacccctctactactacaatagttatgtcacagacgttcaacatttattatgcctagactaatatacataccagacccactatgcacatgcaattttgctgaaattttcgggttcccttttctgttattaatgatgctgcactaacatcagattacagggtgcttgtacgtgctggctactaagcactttatatggattaaaaccttaaacctctcagccgcctctattttagacataaggacactgtggcccaagcaagctgggtcacttgcccataatgactgatctgctaaggggctaaactggcatttcaactccagcaaacaagttttggttggaggaggaaacaaggtgtagcttgaaaaggtcagagaatcactttgcccagaagagaccacagcttaaggtgtagccggaaggagtggggaacacagaggattttgtcagcagtgtttgtaagtaggaaaataagacatgtaaaggtgcagccgcgatcttgagtgaaactctgtggagacagatgaggaaagaacaatttcggtattttgttatatgtcattcaaagccatctactctggaaatctgttatagcttcctgaaaaaattctaaatgaccctttggtacctttctgtgtcaaaacagtattatcttttgaatataccatttaggacaattggccatgaggctatattaacatgatgcaaaatgtcaaatttgcaaaatgtcactgggcgtggtggctcacacctgtaatcccagaactctggagtttgagatgaaaggatcacttgaggctagggttccagaccagtctgggcaacataggaaggctccaactctttaaaaatttaaaaactagccagtcatggtggctgaaaattgtaatgtaaatctaatcagggataatttttcatcgtttcttttttaaaaaatctgccaccattttctaatttgcagacacctggacatgcttcttctctgaacctcaatatagtagtctcagcctatagtcccagacactcaggaggctgaagttgggggatcacttgcggccaggagttcgaggctgcagtgagctatgactgtgacactgcactgcagcatgggccacagtgcaagaccccattcagagacagggtacctatctctcaaatttttaaaaaatacatttttaaaaatctgaaaaatgtctgccctaaaataagaattgatatgatctccttagcatgcttgagcaaggtagaaagctctaagtgcccaagggtgttttcaactagaaattcttggaagtagaatcccagaatggagaggggtccagaaggcccgaaaccaaacaacttcagagactctgaacttttgttttcagagtaatacttcattatgaatttcaaataatattacagggtgataaaactcttccttagttttctattaccactaagacaaatctccacaaacttagtaagcttagaacagcacacatttattcttttacagttctaaggtcagagtttcttccatggggctagaatcaaggtatcaggagggctgtcgggctccttgctggaagctctaaggaaaaatctgtttccctgtctcttccggcttctagagactgccacctgcgttcctttctcctggctctctcatattcaaagccagcaatgtccaggtatctctttctcacgttgctttacaccaactctgatctccttttgagtcttctgcatccacagtggagggtctctgttaatatatatgagaatccaggatagattctccctattggaaggtctgctgattagcaaacctaattcaatcggcaaccttaattcccctttgccatttgaagtcattatttaaggcagagtattgaagaagtcaggtgccatgcctccaacctattcccaggttccaggaatgggcgagttggctggggggtaggggtggagggcggtgcttgcacatctctcagggaccatgacttttctgcctacaagtacctatctctcaaaattaggaatgcttgtatctctcacaatctcagcctctaaggcatgtctggcatataatcgatgctcaaaaatattttggacagtgaagtgaagtagtgcctgctcattccagacaccttatggtgagaactgtccttctccccctgccaactggtatacacaagaacagcccagttttatctcttcttactcctgagtcaagtgggccaatcaaaaccccgccctgggatttttagtatggaattatggaactttgtccctcactggtggtactgagaaaaacaaaatgcaactaacaaaaactgcagagaaccctcttactgccatttaaagcaagcctatttccagaaagaagcaaagaacgagatatgaagattggtgatgtccttggattcaatgcttccaggtgtgtctaaagtctagctgcatccctgccattctgccaatctgatttctcaacttttacagtaagtttggatatcccatagcccttctaataaatttccattttttccctcaaagtcagattgaggctaggttgccttctaccatttgaacacaaatatctcttgactaatgcagaatgccagaaaagtttgtaagaccctcagaaaagatgggagctattcaaggatgaaaaccatgctataaattatatcttgaattagatccagtggtatctataaaagaagcgaatacattttttttttgtaaaatcgctagcaaagctggttgactttccagcttctttccctgttgttctcctgccaccctttcatcttaggtagcttgtctaccctagaaagtatagggtcagcagctgtggataacataaaaaagtttatgggcccagtgcaatggcttatgctggtaatgccagcattttgggaggccgaggtgggaggatcacttgaacccaagaccagccagagcaacatagtgacaccccatctctacagaaactaaaaagattagccaggtatggtggagtgcacctgtagtcccagctactcaggaagctgagatggaaggatcccttgagcccaggaggttgaggctgcagggagctatgagtgcaccattgtacttcaccctggatgacagagcaagatcctgtttctaaaaggaaaaaaaaaaaaaaaagaactttcatgatatggcactgccagaaacagcccatgctaaagcacagcttctgttaccacgccacacttaacacccaagtagtaacaacagcaacgattgacaccaaactgcttaacatagatttctgtgttcaaatgttccattcatcagatgctttaatagatgaatcccttccatcacccatatattcttcatggcacagctcaacaacttaacagcttccatcaagtttttcctcaaaaaatagcctgtccctgagctgtcacagagctttctttgttccctaactaggatgctctggcttattatctacctctaggtttattaactgtgcaaactcctacaggtcattgtccatgtcgtgtctgtttatatttcatcataaagctccatgttttcaccaaataggtcctcaatcaacaatcatagcaagcttacttaagtcatagtattcaaagagtcaggtgtcatcttgggggaaaaagatgatagggacaccttgcatccaataatctgttcttttttaatatcttcctttttcaattgtattgctagcaaaaaaaaaaaacaacccaaaatttcacttttctagaaatcataatggcatttgctgttatgctacaatgaaaatacaatgataatgagtggtgctttgttttgttttgagagggattctcactctgttgcccaggctggagtgcagtggtgcgatctcggctcactgcaacctccctccacctctcgagttcaggtcattctcctgcctcagcctcctaagtagctgagattacaggcgcacaccaccatgcccagctaattttttgtatttgtagtaaagacggggtttcaccatattggccaggctggtcacgaattcctgacctcaagtgatccacccaccatgacctcccaaagtgctcggattagaggcatgagccactgtgcctgggcgataatgactttcatttatattttcctttatatttcccagtatttttagtcccatgatgaagaatggaagggcttctcgcccctgaaatctttcaagaataagaccttaagatgtatgtccaaggatccagagaaaaagcacaggtgtaggtcactcaggaagtggttccatgggtctgtccatttcccaaggcaatctggactcacttgtggctctttctcctccaagctttatatttaatatgatatcttgtctgagcaactccttcaaaatgtgtcttttatttttcccttactttttaacctcacttctaaacagtatcactggttctcattaaaaaccttaagtgtttccataactcatctttctgtgttcagtctccttggggaccaagacgaatcacgaactgtactgccatcccctcatgtatgaactcaagtggacttagtatgtgagactggaacttctcggcttgactttcacaatttatgtttaatcaagctaccaagccatattctgcattgcttcctcaaagtagtcactcagtcacactctctctgctatctctctctctctctctctctgtcacatacacacacacacacacaccatgcagattcggtcaatcggtctccaactgttccttgtcaacaatggcccacgtgtcctactagagcttccgactggcttgactgactttgaccttatttgagcacctatcaaaaggttaaatatgcaattcaagttaattaattagcctgttgtctaacaacaaagagaaattaataacctatgaaaatttaaataaagaaatttgtaaggtaggaaatagttataaagacccaagcctaagtttagtagatcatgatgccagtttaaatgaaaagactcaccttcagcaagacctgatttattttaaagggaattataaaaagtattgttttctacagaaaaaaaatatatgtttcataaactattgtactacgaagaaatttccaacacttttcctcatgcaagttagttcttaaatgtaaggataagtacgtatctaaaatagtctatttttgtatttttaatatacctacacattttatgaaagtagaaacatagaaatttgagccaatctgatcaaggcagaaagacaaagctaaacaaaaaaagtagatttttgctgttgttattgtttagatttgtctttctggctttgtcagactggtcagagtggaattttgaattccaaataataatattgctctctctcctgctaaataaaagcattgatctgaactgagatactccctaagagaaggcctttggagagaatcagcatgatgccaacatttcaatatgttgtggatgcggagttcattcatttagtgaataattaataattaaacatctaaagctctgcattggttctttttttgtttttgtttttttttgagacggagtcttgctatgttgccaggctggagtgcaatggcgcgattgtggctcactgcaacctccacctccttggttcaagcaattctcctgcctcagcctcctgagtagctgggattacagacacgcgccaccatgcccagctaatttttgtatttttagtagagatggggtttcaccatgttggccaggatggtctcgatctcctaaccacgtgatctgcctgcctcggcctcccaaagtactgggattacaggcgtgagccaccgcgcctggcctgcactggttcttcgttgatagagttaagaaaacaagcaagcaaccaaaaataaaaactcctaacccaataggctgtgacttgtggatggtacaaacatgcagggctgtagctttgaactctcaccagcaaaattctaaagtttacacatcgtggggagatcgattctaccttttcagtcactattagatttctgattcccttgtcaagatcatatgcacatattgcttcaaaaagcctaaagatctaaacaagtggaactgggtttattatgaagtttggattactttttcactgaatagcatttttcacatatttacattcctcaaattttaattcaataccgaattgcaatgaaacggccacaccgtttgtggtctccatccacacaattgtacatacagggctctgcagtcagggaggctattgattctttttcatgggtggtctcattctgtccaactcctatatgaggaggccttctatttgaagtgcattcattgttgccaaggctagctctacaaaatcaccagactctagcacatccaaagtattatgaaagcaattttaaccctttgtcctgtttggggggttttctccccatttttgtcttcctttctttttggtttttgtttgaatagttcattatgagaaagatctcaacccaggtggctgctcaaatgagaaccctaattgcttttgagagctcttattcatctcacacacacacacaaagagggactgttaggcacggagacagctcagaacaccccatggaagtacagcgtccaaatgtcagtttaactccttgaatcacattcagacctggactttatgagataattgagaggtctgtcaccataacgacaagggcaatatgccagaaaccactaatataatgaagcagaatcctttaatttctttctctgggctgttctttgtaatctcaatgacaatttgtaacctcagtgacacacaaccctggtatggtttttcatgacactctacttaaactatctggcatttatatggagaaagagtaatctgatagatgcaaaacaattttggagatcagtggattaacgtcgttgttgatttactattttcagccaaatcttactgaaaaatgttttccagggattgaagtttaaaaaaaaaaaaaaagaagaagaagaaatttctccataaaagaaatttatcacactttccacgaagaactttatacaaaggacacactctagtttctacattagatacatctatcattcccacaaattaacttcctttctttccaggtatattttattctctgttgttctttctcctcatctaaaaacggcatatggaaatgctaactgggaaatgtgataccattatggcatactttagtctggttattcttccaaggaaatctgaatttgaaatctatacagacataaaactattcatgttttactaacattaggttaatatattaaacgttattgtgtctacagactttcattgttgttttatataaaaaaggaaatttttaaaaatacaaacgcattcatctctaatgtagctagaatcatctgattacattttgccacttgattgcagcgaatattggaagaaaagaacatccaaatttacgttaagaaaaccgattctaaacaatgaaatccaaccattgtatgaactatcccctacttgtatattaaaaacaatcaagtttttctttgaaaactcaaaaaaggtgctaatatcttaagtcattaaggcagaaagaaccattttctctatctttcagtttgcaaactggagcataatagtgtacttaattctattatttttctatagattcattcctttacagatgattcaggtataacatgcaacattatatgctcatatttattttcatctgcaaataagcattataaaaagttaagaaggcaatatatgaaaataattaaagttattatttatagttttgtccagtcagtagatggcccaatacatacaagtggaacatgtggtaagttgctgcaagaattgcatttggaatatgaaaaataaattaaaataaaataaacgggttatagaagagatcatgcatgagacattataaaaccctcctagcaaatctctctacacactgcacaagaggtattgttttctgttccagtgaggtactcaccatcttccgtgggcacgtagatgtttaagtaaaggcagtcttcattttgatcttgaacataggtcatcaaagtatccaaattggcggtaaaccagatgggcagcatgtcatgcagtaaggatctctcatccaggtgctgggggcacacagcagcaaactgagtagtatttcggatgccagtccaggaggacgggggttctgggggctgaaaccgcctctctccagtggggggtgaggcataggggacccctaagtactgctccactggacccaagatctcattgggtaacggtgttcttaggccccggattttgccataatttgtgttgacaactggatactgtgcttggctgtcaatgagggtgaacttgatggcaagagcagttaaccacaggaggacattggagtttaacatgacgcagaccggggtgaacaacaaaggaagccatagcagtccctggggccgtgacatggttcaaatctgcatccacatccacagctgtcccagtgatgtggctccaaggagacaaagcccagaggcgagcctgcagagagatagggctttccagggagcagtagacctgggagagactctcagactgatcacagacagagcctgaggttaagaacaagcacagccgttttcttggcagcccattgcaaggaggcagccctcccttaatcctgaaactggattccagcaactgcaatgctccaaggaagctgtgatcatccaacacctccagggacaatttcttatgaaaactccaaggcagcctaaaagaggaagaaagcagacaagaataatgaagccacacaacgaccacctagaacactggctggctcttccacgaaatccacaacatctctctatgaaattcctattcatttgtatagaaatgtgtatagtgccatctccacatagtaggcaacagcaagaacatcacctgtctttatttattttgttttttttagagatggtgtcttgctatattgcccaagctgcagtgcagtggtgctgtcatagctcactgcagcctccaactcctgggctcaacccatcctcccgcctcaccctcccgagtagctgggaccacaagcatgcaccactatgtccggctaattcgttggatttttttgtagacattgggtcaccctatgttgtccaggctggcctcaagggatcctacccctcgacctttcaaagtgttgggattacaggcatgagtcaccatgcctagcagccaccacttgtcttaattcctctgtacatcctatcaccatgaacaatgcctgacatttagaaaacactaaacaaatctgtgttgaatgatcaaacagatgttcaagagttatacaggttatgcagattatagtaacaacacctcccagttttgctattgtttaccagactggttatcaatacatgggtacttccaaaacactgtttctcaaatgtttaaggaaattgtcacattttcctaaggagacatgcatggagctctaaaagttttccagtaggagaaagatggaagcatgcatccaagtcaatctggcatcatgatgtggatatttatcaggccacaaagggaacatcatcaaatgaaaagagtgtagactttggacacaaattctccttggtctggtcaagtgcatatatatttaggctacacacttcactgctctgaatctcagtttccttgtaaaacactatacaagatggtgcatttcaagtacatgctgtagtgctagtttcttgaagacttcattcataattaaaagtgttgatacaattatcctgactttccagtaagccactgcatgccttagagggtatcctcttcacccttcagcccatttaaaaagctgaggctgcatttgagttactttcccattgagcctggagtcaacttttaaagggtcaccacctcaatttgtctttacatagataatataactatccctacataagtcgctgctcctgtgacaataaaagaatgctgtgcaggaatggacattatgttgttaaatgatcccctaggaacagaaaatatttcactaggtgttgcaaggagggtgcctttagcatgttcttcaactcaaaatatacaaatgtgtttctaaggattttgtgggttattcagagcatctgcatcagaaaataattatccatttcatttaagtaatcagttgaacagaatacatcacatggctttttttttttaaataaaacatattggagctggatctatcacagaacaataatacaatggggggaaattccatagtacatgacatcctgggaaaagttcaccagagttggatgaaaacgcactgaaaatctggattataactttgaaagtgacaaatagcatctcaccaatgactgatttaggtgtttgcttctatctctgaattctactgtagacaacatttggatgtctgccatacagcaatcccatttctgaataattaagagacagacaagaaaaacaaagaggtgatgtcctgtttggttgcttctttcctgaaagatttttaaccagaggtagctgttactttcagcctgggggccaaaaccactctcaaatatttaaaagctacttgggactaaatgagatagtatgtatcctcaaggtattgcacattccctgaaacacagagctcaataaatgtagaattcagtgggtggacttcttccaaggtatataaagttagttccataaggaattccagcccacaccttaaattctcaaactcaatgtgaatgagactatgagtcacttattggttatgactgatccagctgtatgatcaaaaccctcctctgcctaaatctacatcccacaaggtcctgatgggcagtgagcgattatgaagcagcagcaacctaagaagacgcgcccaagggcatctgtacacttactaggtctagattgggcattcacaatattcacaggttgagagctatcttttttcactcccttgttttttgaaatttggctaatttgcacaaaattgctataattaaagcccagcgtttccccatctcagtataaatgacattgtgaaccatataattctttgttgtgggggcgtcgcctgtacaatgtacagtattttgcagcatccctgacctctactcactagatgatagtggcacctcctacccagttttaactatggaaaatgtctctagatagtgctaggtagcccaggggccaaaaccaccctcaagggagaattactggtttaaggcatcaagtataaaattatagtggctgtgtaaatgattaagtatctgtaggtatatttagtgaatataattagtgctgtcgtgtatgtgtgtgtgtgtgaaaatatagtcatattcaaaaaattggcaacttgtaaatttttagcattacaagaaatgttgatattgaagatatcaatatttattattgatatcaatcaaatgtgcattatcatcattaaagaaccactgtaaatttaaccaacctacatccttgtggggaaaaaaaaaaacaagatctcccatgtgagtttcaaaaactgaaaaggatttcacaaagggtgaaacgtggttattgatagttattcataaataggtagatatttaatatctctaagataaagaggatatgctacaaaatgaattctaaaattgttaatggattaaaaattttaataaaaaaggtgaaaacttcattaaatatatacatatactttgggagtgaagaagggctatatagcatgtattctctgcaaagactgcataaaataataatatctcagaatggcattttgactaatttataacttgattgggtattttaaatgattctctgcagggcagttattctgactcaggttgcaattaaggtgaggctcacactcttcaggcctatcagaatttaaagtgttctgaataaaaattgtaataaatttctccccaaagtatacattccttaaattgagattggtttaattttaagatacgtatttaattaaggtgagccctgatgacaggcattttggtatctggaccttaaaaagaataaagtcacatctcctgggtgtttatggccttgtctttcaaaggcctgggaatatattagaaaacaggaagctttgtagatgcttttaaaaaaaaataggataactgagaaagagcacccttccctgtgttttacttccagccacgctgaacgtctgggcccactgagatgtctgctgccaggaggtttctgagaacaagaagcacttgagacatccgcttccatctcacattcattacggagcatccagaaaacaaaagcaacagaatctgatccttgcccaaattactgggcttgtacaataatccttctatactgttcactaagaaagtctagaatagctattcccaaaactctgcataagctacagacatctctggcttccttttcttttgtgtctagtggagacaacattttagggtacctgagtgggatgtggcttatcttttgttctgaagcccaaagctctatgctgttaccaaaatgaatgaccactctccacgcatggccatgcatgcatgcacacacaagtcctccatccctgctcaacatccatccaacaccagcaatctgccactttgtctatttttgtacatgtagatattttaatattctggtttttatttcccctcctacataaaggagattacaatctaatttgccttttgtcaaatcttaagagttctttgcacagtcacctatgcagtttctattaaatctaaaaatgaaatcccatttaaaaatccaccatttttcaccagagaaatgcaagtcaaaaccacaatgagataccatctcacactagtcagaatggctattcataaaacatcaaaaaacaacagatgctgttgcggctgcagagaaaagagaaggctatatacaccgttggtgagaacgtcaattagttcagccattgtgtaaagcagtatggagatttctcaaggaacttaaaagaggaactaccatttgacctagcaatcacattactgggtatatatacaaaggaaaataaattgttctaccaaaaagacacatgcacatgtatgctcatcacagcactattcacaatagcaaagacatggaatcaatctaagagtccatcaacagtagattgaataaagaaaatgtgatgcgtatataccacggaatactatgcagccataaaaacaaatcagccggcgcggtggctcacgcctgtaatcccagcactttgggaggccgaggcaggtggatcacgaggtcaggagatcgagaccatcctggctaacacagtgaaaccccatctctactaaaaatacaaaaaattagctgggcgtggtggcgggcacctgtagtcccagctactcaggaggctgaggcaggagaatagcgtgaacccaggaggcggagcttgcagtgagccaagatcgcgccactgcactccagcctgggcaacagagcgagactccgtctcaaaaaaacaaaacaaacaaacaaaaaaaaacaaatgaaatcatgtcctttgcagcaacatggatgcagctggaagccattattttaagttaattaatgcagaaacagaaaatcaaataccacatgttctcacttagaagtgggagctaaacattgggtactcatggacataaagcaataacaaacttgggactactacagcagggagagggagggggaaaaggtagaaaaactacctgttgggtgctatactccatacctgtgtggcagaatcaactgtacctcaaacctcagcaccatccaatacacccaggtaaaaaatcctgcagatatatcccatgaataaaaaaaaaaagttgaaattttaaaaaattgtcaaataaagattgaatatgtttaaggtaaaaaaaaatgttattggtatacacacaaaaaaaatttaccattttgaaccattatctttactatatattaagcaattggagagtaaaaatgtggccaggcatggtggcacatgcctgtattgccaggtaattgggaggctgagccaggagcatcacttgagcccaggagtttgagtttagcctgggcaaattagcaagaccccatctcttaaaaaaaaaaaggatgccaaatgttctatcttcaagatgatcttgcaccatatggcagctcaaggtatcaactccatcacctccctcaccatttctgttcttccactgaagtttaatgggtcaggaacatgcatgagccataattgtagaaaccagaattttcagcaggggcctcagcagaacccaaactaaacccaagggtaaagagttaatggcttatatgttgcccagccaagacgaattggataagaggatattccacagataggaaagacaaatataccatgaggaatagggcatacatctttctagagtaaactatgtggacagaaagatcctacaccgaccaaagaaataagacaacaccaaaacttagaagttggcttagtccattcaggctgctgtaacaaaatatcatagcttggggggcttataaaccacagatattcattgctcacagctctggaggctggaagtccaagatcaaggcatggtagattcagtgtatggtgagggcctgcttcctagagggctgtattttccttataactttggaaaaggggaaaagggcaaggaatctccctggggtatcttttaaaatgtcattaataccattctggggcatccaccctcatgatctcatcagctccaaaggccctacctcctagcaccatcactttggggttacaacgtcaacatggggattctggaaagacacaagccttcagaccacagaagtatcccgtaaagatcactatgctaggtaagggtacgtaatggggtaaagaaggagttcctgcccactaggagcttacattctcatgaaggtatctatccctacctgtgatgcattttttcttcttattcatcttctgcatatctaaagctagcacaaggactggcaaataataaaagtgcgttaatgcttgattttctgtgtgaaattaaatgttttccagacacaatttctaaatctaaatcaaatgatttgcagatctctctaggctttgtgttcatctctctcaccgaactcaaagtcatatgtcctcaaggtcatggaggcatacacctgtagtgccagctgataacatggtatgtgccaccatgcctgtagtgccatgactattttctcttcaagaatatagtcagatagacatcttatggtgctcctaaaaatctcattctccaatccccaaactgcttccatgcttttgtttcatatttggataactagatcattacttttctagtaattcagcctacactcaaagccatctttgttggtttctccaccataaatccacatccaggaaggagtcctcaaatctacagatagcctcaacataggacaagaggctcaatgtcattcattattggtgaaatgcagatgaaatcacaataggattaataaaaatacaaacaaacaatgataccaagtactgagcaacgatgtggagcaactagaactcccatgcatcaggaaacatgcacggaaatgtccactgcagccccatttttttttcttcaacttttaagttccaaggtacatgtgcaggatgtgcaggtttgtgacataggtaaacatgtgccatggtggtttgctgcacaaatcaacccatcacctatgtattaagcccagcatctattagctagtcttcctgatgctctcccctccgggcatccccagacaggcccaactgtgtgttgtttccctcccccatgtgtccatgtgttctcatcattcagctcccacttatgagtgagaacatgcggtgtttggttttctgttcctgcgttagtttgctgaggataaataagccccaattataattgcaaaaaatattgccacaatccagatatccataaataggataatgaataaataaatgttggcatattaaaacagaaggctttacaaaacagtcaaaaatgaataaaatacagatatatggaggaaaatgggaaaatctcaaacataaaaggcaagtcacagaagactacaaatagtgtgattttatttacataatagtaaaactaaacaatatattgctcagagctatgtttgtcctgaaatatacagcaaggacagtatgaaaaccaaatcttgggggattagatttcactgaaaggtaggagagagggaagcaactcacactgatatataaaaacagtgggaatgttctctttccttgtctgtcagtgggtacaatactatgtatctgattattttttactctttaaaatgaatatccaaatacacattttgatacactttttatgactatgattattttacaatgaaaatttaatcaaaagattctcatccgtataagttttactcaatgactttattttcccatgtgctatcaaactatcttggatttaaaaattgaagggaaaatataaactgttttctccatgattatgcgacaagcccaaggcaatagaccatccacccacatattacacagaaaagccctgggatcctgccagccatggtaagcacagtcatggaacctgagcctgctatagccctggtcactaattagccaagtgccctcgccatcaactccctccactgcaaaacgagggcttgtgccagtgacctcttaagttgctttcaccactaagacgctctgacatctcagactattatctccaaagcagactcagtataggagcccagtgggaacagaaagtccttcactgaagtagcaaggcataactgaagcgagacaatccctactgcagaaaatggcaaggtttagtgtgccagaaacagtgagagtcagtgtggccttccagcctattctttaaaaatatttctttcagttgcagtcagggagacagagagtagaatgatggctaccagaggctgggaagggtaatgggagagagagagaagtgaggatggttaatgggcacaaaaatatagacagaatgaataagatctagtatttgatagcacaacagggtgactgcagtcaacattaatttactgtatatttttaaataactaaaagcataattggaaagtctgtaacacaaagaaatgataaatgcttcaggtgatgtatactccatttattctaatgtgatttttacacatatgcctatatcaaaatatctcatgtacccacaaatatatacacctactatgtacatgtaaaaataaaatatgttttccaacaccagataacctttattagcaggatataaaaatgccaccagatttttctttacttgaattgtacatgaggatttgaaatgagtatttactgactttttcccagaattcactgtactaattgtactgtacaaataatcttcttctttcccctcatatataagaggagttgtttcaagagtttgtactttaacttatcatatatgaaattatatctataaaataattttttttttttttgagacagagtttcactctgtcacccaggctggagtgcagtggtgagatctcggctcactacaacttctgcctcccggattatcttgcctcagcctcctgagtagccaggactacaagcatatgcccccatgcccagctaattttttgtatttttagtagagacagggtttcaccatattggccaggctagtcttgaactcctgacctcattatccgcccgccttggcctcccagagtgctgggattacaggcgtgagccaacgcgcctggccaaaaataaattttaatatattatacgtatagatatcttcaaactaacctgctatatatagagagagaataatataaaatatattattctatatataaaaaacatatatattacaaaatatattataaaaataaaatataaataaaatatattattctatatataatataggatataaaatatattattctatatataatataggatataaaatatattattctatatataatataggatataaaatatattattctatatataatataggatataaaatatattattctatatattatataggatataaaatatattattctatatattatataggatataaaatatattattctatatattatataggatataaaatatattattctatatattatataggatataaaatatattattctatatattatataggatataaaatatattattctatatattatataggatataaaatatattattctatatataatataggatataaaatatattattctatatataatataggatatataatatattattctatatataatataggatataaaatatattattctatatataatataggatataaaatatattattctacatatagaataatataaaatataataaaaaacatataaaatatattattctatatacatagaataatataaaacattcacaggagcttaatacctcaatattttgcttggttatttggagaaatactttatatatataaaacatagaagcttaatatttcaattggttagtttgaagaaataatataatagataaaagaaatattatatttaggagtttaattgctttaatattttggttggctatttgcagaaatacatataaaacatagataggagcttaatatttcagttggttagtttgcagaaatatttatatataaatacgtggaaagagagagagggagaaagagagggagagactgacaaataattagtttggatatatacattttttgaggtttaaagagatttatatagatacaatacattaaaacttattttatccatgtcatttcatgcatgtgcatatgaacatatatattcgaactaaccaagtgaaatattaaactattaagctgcttaggttcaggaatttttcctactccattccctgaaaatcccgtgttccatgcctttatgctacagataatcaatactacctgttgcatatgatgctgatcatctgttttcagagagatggtcctacataagagcaaactaagaacaacaggctcaaatgcactataacaggcacaaaaacacctactcatgtgtgtattatgtatctgggaggtagtatggggcagaggttttgtgcagttttatgactatgattcaaatcctggctctcactttaactccatcagcaaccagagaagggtgtatacaccattgtgatggttaatgctgagtgtcaacttcattggattgaagaatgcaaagtattgatcctgggtgtgtctctgagggtgttgccaaaggagattaatatttgagtcagagggctggggaaggcagacccacccttaatctgggtgggcaccatctaatcagctgccagcaaatataaagcagagacagaaaaacatgaaaagactagactagcttagcctctaagtctacatctttctcctgtgctagatgcttcctgccctcaaacatcagactccaagtccttcagctttgggattcggactggcttccttgctcctcagcttgcagatggcctgttgtgggaccttgtgatcgtgtgaacaaatactacttgataaactcccctttatatatctatctgtcctattagttctgttcctctagagaaccctacctaatataaccatcaatgcttccatctcttatgtgtaaaatgggcagagtagcagatgtaactcaaggatattattgcacgtgctatggtttgtgtttgagaaagtacaagagtatatgaatatacacacctatattcacacaccttacataaagatatgcatatgtatgtgatatggtttgactgtgtccccacacaaatctcatcttgaattgtagctcccataattcccacgtatagggagagggaccctgtgggagataactgaatcaagagggcagtttcccccatactgttctcgtgatagtaagtctcatgagatctgatggttttataatgaggagttcccctgaacaagctctctctttttgccttccgccatgtaagacatgcctttgttcttaccttgccttttgccataattgtgaagcctccccaaccacatggaactgtgagtccattaaatctctttttctttataaattacccagtctccggtatgtctttatcagcagtgtgaaaaaagactaatacagtacatatatgtaaacacatataaatttagaacaataagtattccccaaagaaatcctagctaattacaattattcactgaggtaccactgaatgcttccaaggtgaaacccattttgataaaatgtaaagatacaccaatcaagtacccatcctcaagtagtaaacactccagctgatgagatgaagcttgcctttcaattgctacaattaagccagcctgtgctccattgcttttcaactgttaccatgaagccagcctgtgctccattgcttttcaattgctaccatgcagccagcctgtggtccactgcctcccacctgctccttctgtgggatggtgggcttctgcagaatggactttgcaatggagtgcccagaagatgcttctacaattttagacatgtagagagagctaggccagaggacttctgtaaagacagcatagagggggtaagcattgacattcaagaattaagaccaccaagatttacaaagagtggggaagatgataccacactgaacattcacattatgtcaccattacttcctcaatgcttacattcattgctagactatgataagtatctaagggcaaagcccagagatgactaatacttgaacttggaagacagaaggtcttcagtaaacactattaaattaaaaggaagaaaagagacacaaggaaaccagaaggaaccaggacacagaagacagaaaattggcaaggttaggtttcagggcattctccttagctcatctcctgtgggtaccacaaccacagaagatgagctacttccaccacctgctccactcatgtttccaccataaaattctcataggcttcacgatgtagtccctattgtttttgcctgcaggaatttcactcattgacacagcagtaaagtgttagagtattactttcagccaatgtcaaataagccagtttctgaaaaggtatcacaactagttctgggaatatatttgcctgcaatttagcaaacaaaataaagaattctagatacccagtcacttttaacctcatttcctttaaaaggctttctcattgctgtatctgatggacagagataatattgatcatgtaaaggaaatatttaagccagagtggaagctgagtgagttcttctacaaaggaaaactgtcagtttgagtaagaaaaaaacactcaatttctaaatagcacagtttaacctgcagttagtacttctgacctggcacgaccctcaactggcagtgggtctgcagatggttgatcatgtggacagttggaggttaatgtggacaagaacaagtgtgtactcccaagtgcaagacaggagccagaaccctctggagtaatactgttgagtgtatctctatgtctcttacataaggagcttcataaccactgcccatacctctcctaatgaactgtgcaatatccgaaaagctgagtgtcttcagaacgtttcccaagacaccacctgtgaccccaggaccagctccatctcacaaccctggctagagtgctccattttctgtagcacagatcctatttgctaaggttactttgttttaggcagacggctctatctgagaagttcctatttcggtgtgatgcttgctctggcagcctacactcttttctcatgtgcttctgacagtgcagaatgacaaggtgagggccttacaaggtgttcggctctagattactaaacaccacctttcccacacagtttatttcctgagtatgacactgtacaagctcccaggaaaggcaagcttcatcctcaggcttgaacctcatcacctccacccactccccaaaatgtttcctctgccctccccagacaggaatattaatttgtgaaaacaggctctatcccagtgagtcagttactccagagaggcttcttgtcctggggtcagaacttaactgagatcagaccttccatctctaggaaataaccaaggcttccaagatccagcatatagacaacaggcttctcataaaaacctctgtgtctcacattagcatgggaaggaagaataggatggaagaaaagagtcgtaaaaggaaggctcttttaaacagggttcaggaaggaaagaggtgcaaagtcaagagacagaatcagggtagacccaagaatatacctcaggaatcaaaggcaactatctcctaaaactacctccaaagccttacaaacattcaaacaagacaaaattcattaaaatgaaatgttttttgccaaaaatgtcagtaaatagcagtcaatattaattgatattgacacttccaagctttttaaatgaaaataacatgaagattctaatctgccagattcttcactttctttttgacataaaaataattatctcagtatagaatgctctatgctgcaaactagtgactctcacattcccacctctggcaaaattcctactacacatgcaggttttttaaagaaaacagaggtataataaataaatcaaaacctttcctctacacaattctaaatgcagatgttctccaccctaagtccaaaaaccccaatcccacccaggtgtctttatttatttttttgtgagtacatagcaggtgtatatacatatacatatatatatatatggggcacatgagttgttttgatacaggcatgcaatatgtaataatcacatcatgaagaatggggtatcataccctcaagcatttatcctttgccacccaggagtctttagatagattccatgggttctacaaattgcaatgggcaaaagtaattacatctttagtttcactaccatgcactgaaatttagtatttgcttccattacccgtgtaggtaggacacttaacactgttatcacagatatcccaaaatactgtttacgcttattgtactttgaaattgtgactattacgaacctcttaagtagatccaggtacttagcacacaataaagatgcacatgtattactgtagcccagtttaaatatatctttttatttttattttttattttattgattgtagaaacagagtctcactttgttggccaggctggtcttgaactcctggcctcaagcaatcctctcacctcagcctccccaaatgctggtgtttacaggcatgagccactgcaccaactttaaatattaatattaatataccttggtaactatttcaataaaaccgatttccttttatgcgttatttaccttattgtatgacttaaacatatcatttttacaaaatgtatcaattttccaccaaaccgccaaagggatctgtcacacacactcacacatgtagcgtgcacagctgagaatccttggctaattgccagtctgtggtcatcacctgcgtatctacctatcatgacctagtggggacagcaaaggttacagctttctgcttgtggataaggagcatgtgcatggaaggatgaaatgccacctcctcagctatctcatacgagtcttatctggctgttctcttcccttggaagacctgccctgagcataagtacttgagaataaatgggtcaggcaacatggctcatgcctataatcccaacactttcggaggctgaggcgggaggatcacttgagcctaagagttcaagaccagtctgggcaacatggcaaaaccttgtttctaaaaataatttaaaaattagctggacatggtgttgcatgcctgtagccctagctactcaagaggctgaggtgggaggatggcttgagctcgagacggggaggttggtgtgagccatgatcgcaccactacacttcagcccgggtgacagagtgaaactgtctcaaaaaaaaaaaaaaaaaaaaaagaaagaataaaaggcaaatatctccaccaggaggtcttgcctagctcttgccataccctcccaagtgagacaggtcttcctgtcttcctagtcatctctccccggtaacctttggtggaacctgagaccacctcagctgagcttccctagaggccacagctgtgcacacaagtaatgaataaaaaaactctagcgcttctctcatgtagaaaattaaacatctatgccacctgcatagggcagggagatctttcccaagaccagggaacctccaagctagagagcagtcccagcaactgcacacatggtccttctctgtctgaaccaaagctacttaaatatcaagactaagacgtgaaactaaaggaaggtcaaagacaaacatgtccttccattcacaaacacatagaaaaccacagtccaagtaagttttcatctgaattcccacaaattaatggaggaagggaacttatctgaggaaataaagtttcattaattggccactggatgtcatgcaccgggaaggagtctctactctttaaggcccatggagaagaattccgggaatgaacagaatcaaaagaggcatttcaaaccctgcttcttctccatccccatcttatccactccccacatcccaagtccaagaaaaaataggatgaaaggatcaacgttatagaagctccaaaattatttcacagcaagtggcaaaatcctcccccttcctgaaactcaagaagagtaggactatcatttgcctctcttttgaattataacctgaaccatggccctttgaaatctcaaacctccccactgtttttcttaaatatgtccgtgggaagatttccttctccctatcacttctttctgtatagataggatttttaaaggtggatctttctttcactacagtaatcagatgtcacagattttctgcaattaatgctttccttggctatttctagacctcctattaagagctattctttcactccggcctattcttcctaacccaattaaaccctattaaatcctctgccatgactgttctatttcccccacgtttaattatcccttaacaagcctgtgtttctgcatgttcttttcaattggcccaccccagactgtgtaacttagagggtgtgactgtccacatctataacatcttcaagctaaattatcatctggcaaaaattccctccatggaaatctatcaacaaagcgagtgctatcttaagactaagttctgtccgcaacttcaaatactaaagcgtcatagactgattcagtcaaaaaggtttttaaacaaaaaacgtaaaataatttgcatctattatgtttatgccctttgaattaattggataattaggaaaacatactgaatttgtgggaggacatatactaattctccaataactggtttcactatgtattaacacatacatattgctcactgcatcctggaattcctaggctctagaagtcctcctgctggtctcagccccacaagaagctgggactacaggggtgtgccatcatgtccagctattttttttttattttttgaagagatgggtctctctatgttgcaggctggtctagaactctggcttcaagcaatcctcctgcttcagcctcccaaagtgctgggattataggcgtgagccactgcacctgtcctttttatttttttgagacagggtcttgctctgtcacccaggctggaatacagtggcaggatcacaactcactgcagcctcgaccttttgggctcaagcaatcttcctgccccagtctttcaagtagatgaagagcttttagtaatacactagagaacattaaaaaatcattagctttaaggacattctaagagtaaagttataaagccaaaacccataaaagataaaggaaaatcggaagaggcggtatgaagactgtcctctctcagagggtcccttcttgtggaaataggctgctattccaggtcagagggagggtcccccaaggcaagacagatcaaaggtatccccaagacagaagggagccagtaagtcctactgaaatcaataatttgagcaacagaccaaaggataagatcatgtcacctcccagctgtaaatatcagcactgcatggatttgagttatcatccaggataaaaatgacttctcaaaagccaatgcttttaagccactgggttcttatttaacaacacaaagaactacaccctgaggatgatcaacaaataatctgacatttaccaggcagaaggtacattgaagaaatgtagaacacactagctgcaaaagatagagaaagcattcacttcctaggtgccaatactctttagtaggaactcaatccccttcactttgaagcttggcaaaggccaaattataatgaaagaaaatttggcctctgcacaagcatccttgaccacggaacgaatttctagagctggtaattatgtccttggccctcgagttaaagggcatcacagaattagaccagtggaatgcacagagctcctccaagaagccacttaggacgactgcctgggaaatgcaaactgaggaaattatatttaattcaacctcatgtgtggtcggagaaacaggaggaattggaacaattaagccagcatggcgccatgagccatgcacaattggcttcccgtaggatagacaaagcattccacacacgagaacattctgtgacttcagttaagaaagggaaaaaaaaatgggaagcttgggagaagcattaggtcattttcaagcaattaaagcctttccataaagaacatatcagataacaaagaaatgactgagtgatgaagttggctcaatctaaatcatcatgttagtagtagtttattactgaaaccactgtatcttggtgaagagaacactggacaagattttttttttttttgaaacagggtctcactctgttgcccaggcttgagtgcagcggtataatctcagctcactgcagccttgacctccagggctcaagcgaacctcccacctcagtctcctgaatagctgggaacacaggcacgctatgttgcccaggctggtctggaactcttgggctcaagcaatcctcccacctcagcccagcacaaagtgctgggattgcaggcatgagccactgcacccagctagagatttttaaattcaagtaagaatctgagctacctagatccatgcttcctaaactctgctgcatcttagaatccctaaggagaattgaaaaatttcactgcccagtctgcattgcagaccgagcaagtcagaatctctggaggaccacagcacaggcattaatacctattacattctccaggtgattccaatgggcaggtacatttgagaaatcatgcttttaactgtcatattcacattcacataccattcaatcttggccttatcatttttcttttgaaaaaattttgtttcaataaagaaaggcatgcatgaagttttaaaggtcaaactactacaagtgttatttgcacaacaaacagcactttcttgcccaacatacaacatcccatgaccacacttgctttagaaagcaaatgctttcagatttcttagcttctcctctccaaatatatgctctatgatatttctaagtaatagtttatgctattttttcttgatatattatttttagatattacctataaattatcaatgggcaaccaccactctatttgccccttctgcctttttgttttttcgagacagggtcttgctctgttgcccaggctggagtgcaatggtacagtcacaactcaccgcagccccaaccttccaggctccagcaatcttcccacctcagcctctgcagtaactgggactacagccacacaccaccatgcccagataatttttgaattttttgtagaggtgggatttcgccacattgcccaggctggtctcgaactgttggactcaagagatctgcctatcttggcctcccagagtgctgggattacaggcgtgagccactacacctggccttctctctttaactttattgtaactgtgcaattaataatcactcctgaatgaagcattctactctaattaaatctccttcattgaattgcctcctgttttatctggagacaacaacaacttcacattttcatttcatgcttttctgtgtgtctattgttcaatttttctgaatgttccaagggaactaaagcccatctcaagtactatttctacatggtcaaatggctcatttccttttcttttatgtactttctccttgaagtctcactctaggattccagctgtcccagcctgctctgggcattaatctgagacctgcattctttcagctctcttctgtgaaggccactgttccttggattccccatctttctatttgtcatttattccgctgtttgaaggaagacataatcacacagctttccaagaaagggtgcacaaaaggtaaattttcggaaatgctacatcagtgtaaatgccttgaccctgcctgcccatggacagtttgctccaagagttctacgtagtaaattgttttttcttagaattgtgaaagtttctatcttttaacgttcagtgaagacatgaagcattctatgacattacaaattcttgattcttaataagttttttttctttgcctctgatatgatttggatctgtgtccctgcccaaatctcatattgaattgtaatccccagtgttggagatggggcctggtgggaggtgatggcatcatggggagcagagttctcttgaatggtactgtacacaccccttggtactgtatagtgagtgagttctcaggagacctggtggtttgaaaggctgtagcacgtcctctctctctcttcctcgtgctccagccatgtaagatgtgcctgctttcccttcaccttctgtcatgattgacacgttcctgaggcctccccaggagccgccatgcttcctgtacggcctgcagaaccatgagccaattaaacctcttttctttgtaaattacccagtctcgggtatttctttatatcaatgcaagaacggcctaatacagcctccaagctcttaggatcttccctatatatttgttcttctgaaatctcgcaatgtgcttttgtagtttggagtttcaattcattcactatggtgagccctgagtgttgtttcataagcctggaagtgtagatccctcaatgctgggattattttaaaaattattcataagtcacttttgcttatttgtattctgttgtccttcctgaaaatactcttcgaatgtcagattcctagagtctccatattcgttcctttccattttgctatctctctctcattaaagttttgtccattggagatatcctcataatcgttctccaatctgattatttaatttgcctaatatgtcacattttaatagaattcccatgttttttatgagtcactatttcatcatatctcctacaagttacagattagaaattttgtctcttgttttcttggttggtgttgtctgtgctacctccagatgattcttttttcaatttttaaaaagaatttcttattgaaagcttctcaaaaatatctaggatgtaagactgtcttttctcacttaagaatcaggtctgtgtggatagccaggggtccttcctcagcaggtgaacatattgtacagtaaataagtaataggcccaaatggcctccaaatgccagttatggaatacttttctctgccagttcagtttaccaagaaagggatcctccaggatggacttgaaggagtccagtgactttcaacttggaaggaagaacaagaaagctgatggctgtgagtatgcagagtgtagacaattcccttacagacacagagcgtgggccctcacccctactccactctctgatgtctgtgggtccttatgtcctaactttctcaggacagatacggagtctgggctctcgcccccactccactctctgacatctctgggtccttctattctgagttaacttcctccaaaataaatttcatctgctccctgtggagaggagggaaggaccgtactttagccacacagcgtagaaacctgtattctaggctcaactgacctaagagttttgcatgaagttaaaaaaatttgtgttgttggggctcagagaatgataccacaaaatgaaggcttcagcagcctcagaggcaaaaggtttttctctgaccctcccctgacctgttgtctctcaattccattctccccgaaggctggccataggaactggaatccctcctccctaaagcaggtcatacaaaccagaccccttccccacaaagcacccatgaaaccaaaaaaagatgacctcaactttcccctgcctttctgtaaacactggccataaataaatcctctgacctgcctttttgactgtaggtcctaagaccccccattccacagagggtcctacctcacacccagaaggaatgctgctcagagaggccaagaagaatctaggcagacagacctggctgggtttccccactcagtccattagctttagatcaggccctttttgtccaaccctatttctactgggttgtccacagttagttgaaccttagcataaaaactgagtttccaaataaccccattaaaaactgtgccaagggctggtagtggtcgctcacgcctgtaatcctagcacttcaggaggccgaggcagcagatcacttgaggtcaggagctcaaaactagcctggccaacatggtgaaaccctgtctctactaaaaaaatacaaaataattagccaggcatggtggtgggcacctgtaatcccacctacttaggaggctgaggcaggattttttgaacccaggaggtagaggttgcagtgagccgagatggtgctactgcactccagcctgggcaacagagctagactctgtctcaaacaaaacaaaacaaaacaaaacaaaaaacaaaaaaaaactgtgcctagaacatgaacacacacttctcaaaagagggcatataagcaatcaataaacatctgaaaaatgctccacatcattgatcattagggaaatgtaaatcaaaaccacaatgagaaaccatctcacaccagtcagaaaggccatcattaaatagtcaaaaaaaaaaatatataacagatgccagtgagtttgcagagaaaaagggaacacttatacattcttgctgagattgtaaattagttcagccactgtggaaagtagtttggagatttctcaaaggacttaaatgaaacaaaactaccatttgacccagcaatcccgttactgggtatatactcaaaggaaaataaatcgttctacaaaaaagacgcatgcatttgtatgttcactgtagtactattcacaatagcaaagacagacatggaatcaacctagatgccaatcagtggtgggtggaataaataaagaaaatgtggtctccacatatgcactgtggaatactatgcaaccatgaaaaagaacaaaatcaggtcccttgcagaaacatggatactgctggaggccattatcctaagtgagtcaacataaaaacagaaaaccaaatactgcatgttctcacttataagtgggagcttgagaaaacacggaaataaagacgggagcaataggcacaggggactactagaatgggaagtgagtagggtgaggactgaaaaactagctggtggtcactatgcttaccaccattgattgggatcaattgtaccctatacctcagcatcacgcaatattcccatctagcaaacctacacatgtaccccctgaatctaaaataagttgaaataaaaaaaaaattggacagtctcccctgtatctttgtgtcctcattctgaaggctcctgtgttacacaaatctacaacttaataaatatgtattgctttctattaatctgccttttgtgacatgattttccgtgaccctccagagggtgaagaggaaggtttccattggctaatacaacattcaatccaacctggatatagagaaacaccatgttctccatctatctttgaaataatttgctatgatttttcctctgagaaaaacagcacagcagcaatacaatcactcaaattctaacttgaattttaaaaaataatatgattaggagaaaggatgagtatagtataaaattatctctgtatttctgcctcagcgtagagaaaatgttctctatgaaatataatcattttattaaacactacccaacaccatctagtatttaaccagttccaatatttctcaagtactattacattcttttctcccacatatcgtcataaagcatttgtttttgtttttcctttttatctggcaaagatgctacttataccagtgattaacacaatttctaagtaagaaatagaactagaagtgaaaacttacatagaaaagtaagatggaaccagaagtgagggctaggatatgggatacatttgacaacctacagttgtttttcaaccccttcaagttatatcattatctattacagaaaaaaaaaaaaaaaaaacaagataaaaccacacctgagcagacagttttccaagggtgtctccaaggatcatttaattttcaaagagaactctttacaagttaatctctgttctaataatctcctcaacagaattcctcacctccccctcccatcacctgttttactgggatccaagcccccactctttctgtaacctcaggatggtgtataagcttctggacctcatttggagggtagatcttcattccaaaggctcctgtgtatctgcattaaatacacttgtaatgtcatttctcctgttaatcagtctgcctagtcagtgatttttcattaaaattttagggagtaaagagccttggcccctacagttatgacacagcgagcggggtcaacaaagacgctctgctcttttggaagccacagtgcagagaacccaggaacccacactgctggccaaagggtaagaatttctcaccagccagccaggctcctggtctctctctccctctgtgcaatccagttgagtggacagtaaaaatcactttgtctccatgatttttcattgaaccttcagggggccaaggcccttgaccacaacactgcctagcttccctgtgtacactcctaattttaactggctctaccatttagcagcccaacaaccctgagtaagtgatttaactctcactgtttgtctttcttgtctgtaaaatgaagataacaactgtgtggtctgcagaataacggaccccccgggatgaccatgtgttaatacaagaacttgtgactttgtgtgaccttacatggaaaagagattcaaatgaaagaggcaggtagaattaaggttcccagtcagcagacctcgaaatggggagatgattccaggttatccagtgggtccacataatcacaaggatccttataagtagaaaagggaaaaagaaaagaggaagaaccagaaagatgacagaatgagaaggactcaatctactggcattgaaggtgcagaaaggaacttatgagccaaggagagtaagaagtctctagaatctggaaaaggcagggaaatctgtcctctcctagagcctccaaaaagaacggtgtcctgatgataccttgattttagcctcctaaggctcattttggacttctgacctctagagctgtaagcagccactaagtctgtagtaacttgttactgcagcacagataggaaactaatactaatggtaactatcaggtagagtggttgagaccaatgagttaatataaaaagcacttggaacaggtcctagcacagaagaaacgctacataactgtcagcctatattataactaataaccaaagacataactctgaattaaggaagcaaattagcaggtagagtgacaaagtaaaagggaaaatattagactgtgcataatgacatttgagagcatacaactccccttacagttttcatttaaataataccctgttctatccatcattgctttttgtttgattgttttgtttttgagacagagtctcactctgttgcccaggctagaatgcagtgacaccatcttgactcattgcaacctctgcctcctgggctcaagcgattctcctgcctcagcctcctgagtagctggaattacaggcgtgcaccaccatgcctggctaatttttgtatttttagtagagatggggtttcaccatgttggccagggtggtctcgaactcctgacctcaagtgatccacccacctcagtgggtgtaatcccaaagtgctgggattacaggcgtgagccactgcgcctggccccatcattgttttgattacaaaagcattatagtatatcttgacacgtgcatttatttcctctatcaagatggtcaagatttatttataattgtactcatttgtcaaataacaacacgctactcacacaaaataatcatgtcctttgaatgtgaaaggtttaatattgatgatgaaagctctacaaagttttgaaaataccaggagacattaatagagttcaaaactcaacattaaaaaatggaaataggactgagactgaaaaaatctagatggcttcatggagttgggcaaggctcatctctctccctgctatgatctgaatgtttgtgcccctccaaattcctatgttgaaattgtgacccccaagatgatggtatcaggaggcgaggtccttgggaggtgatgaggtcatgaggttggagcctcatgaatgggattagtgccctcataaaagggaactcagctccctcaccccttctaccacatgaggatacagggagaaggcaccatctacaaaccaggatgtgggtgctcaccagacactgaatctgccataccttgatcttggactcccagcctccagaattgagcaataaatgtctgttgtttataagctacacagtctatggtatttccttatagtagcccaaatggactaaaacattccctatgtgctctctaatattactatggcttccagaccacctaatataaaatgcagatatccatcttttagttagacaaaggttgaaagcttgtgactccaaaaatgatgggtagcatcataacaaaggcagttagtagatattgattatataaagtaatttaggataattaaatgccatcgtgttcacccaccgagctctgatacctgactcaatgtttgctttgagtggaagtgggtcccctatgtacattaatacattgacttttcaaactctaaactccttgtgggaagatgccatgtgttatgatacttttgtaatcagtggacaaggcaacccctgggaagcaaaccacagtgattttccaacaactacttcacttcttcacactgtttctaccactggaaagtgggacagattgaatctgcctaaactgctagcagaatgaaatacgaccatgaatataaaaagaagtttccaaattctaaagaaacaaatgcctgtaagactattctagtgaacaatgaatatttcacttattttcaaaaaaagtattgtagtgcagtgacagccaccatcatagccatcgtgcaaatccttcaacatcatgatgtgcacagttgaacaaagcatgagaaatatagttctttcacggacttatgctaaaagtaaaatatagaaatactacgtggctgggcgtggcggcttatgcctgtaatccaaggagcacaagacaggaggatcactagagtccaggagttcgagaccagcctgaacaacataggaaaaccgtgtctctaaaaaaacaaattttaaatcagctgggtgtggtggtgcatgcctgtggtcccaggagaggctgaggtgtgagatgggaagattacttgagcccaggaactcaaagctgcagtgagctatgattgtactactacactccagcctgagcgacaaagcaagaccctgaaaaaaaggaaggaaggaaggaaggaaggaaggaattctaagcatctattgaccttttttggtaggggagtatgtgtgtatgcatacattgagataatttacaaagctacaacatcaaacacaagcttttgaaggactaagctaagagagctcctatccactaataactgaaaaacacccatcgactcattttgaaacaccatcatgaggaaaaagaggcatattttgttcacaaaagttagaaaatattcatatagccaagaggaaaggacaaggctttgggtcatattgtcttagcatcaagatcactccagttgcatagggctagagttttctacaatatcaacctgctccgatgagtgttagggctgtgagtaagtcattttttaaaatgatagtaggttaaaatttagaatagtgctacttatataattttgatggaattcctaagaggcaggaaacctaaatgtcagaatttcatggtgtgccttggtctgagaattggatgagtgtgtgctgactgtgatgtcccagtttgatccatatggtgttcacaccatattatatggctgtcattgctttcagttttctcagtagcgaccatttgccacctgcagcccaatctctcaggtccagcagctggaaagagacagactggtcttctctcaaaggcaattccaaagttacaaggacaccaccaaagctaggatgcaacccacttgcaaaaagaagacagagaagcaggcggcctattcaagactcatgtggctatgatgggggatgccatagcttctgttttctcataagcacgttccttactccttcgtatcttctaatgatgctgaagacaaggatggttagcaagcagtggatgctaaagttatcttttcagggcacctaataaacaagcaataaactagtatcaaggcagtaagatctcttctagtttttagtacatttaccatagaaaattaaatagatgcccttaataaattggttcaattggaaaggctttaaaacaagtaacaagcaagtaaaagctctaagtgaatttccatgcgagagaacaccaacctaaatctttcctatgaaactataccaaaatacaaattaagatgaaaatgtgtccctatccaaatctcctgtcgaactgtaattcccagtgatggaggtggggcctggtgggaggagactggatgatgggggcggagttctcatgaatggtttagcatcggcccccttggtactgtatagtgagtgagttctcatgagatctggttgtttaaaagtgtgcagcaccttgcccctctctctctcttcctcctgctccggccatgtaagaaagctcactccccctttaccttccgccaagattgtaagttccctgaggactctccagaagcaaaaacccctatgcttcctgtacatcctgcagaaccatgaaccaattaaacctctttcctttataaattacccagcctcaggtattttcttaaagcaatgcaagaacggactaatacaacattcaacgttcgagtgtaatgctgggtatgagagttgattctaggtaactagcactgaatgcatctgttcattgtttataaacatagaaagtagtggcagaactgtactaaaaaaaaatgtctcagagttgctataaactccagttaagccactctccacaggactttggaacacctaaagtactgacagcttttttttttttatgttaactttcatttcttgatgttattttcaaagcattaccctttaatgtcttccctggagcagagttatatccacagacacaaggttatcagttcatttccactgccctgccctgcttttttctttaagtaaagcgaagataaagcattctttggggaaaaccaatattgcattcggaggcaccaatagtttgcttctctctctctctaagtgacagcaactcttaagtctctgtgcttaggatggaacttaattttcagtctccctggtatatcagctgctatcagaaatatgagggtaggcctgtggggaataaggatagttaagggcatctgaaactctctacctcttttgacaagtgtgtatggatgtaaataaatttgagcggtggtacaaagaaccctcaagtgtttcatgactgctttagtaatctattacactataattacagctatgcacacagacgctcataccacggaactaacatgaatacgtagatttaaaagtgatagactaaaaggagtgaaactatctctaaacacagatttaactactatgattttatggtaatattattaatttaataaataatttttgactgtgtgtcttagtagtcctgtttcccgctgcttataagagaacatctgaaactgagtaactttatgaacaaaaggaatttatttcttaaagttctgggggctgagaagtccaaggttaaggggctgcatctgatgagaagcttcttgctaatagggactctctgctgattcctgaggtggcccatgttatcacatagccaaagggctcagtgctacctcaggtctctctccttcttcttaaccaattaatccttttacacattaatccattaatccttgatccaatcacctcttaaaggcccacctcttaatactgccacactgagaattaagtttcaacataagtttcggaggggatattcaaaccatagcagtggggcactgcattagacggagtggtgattacaataacgtaagatatttcctgtattcaggggaatttttagtctggtagggaagtaaggcattgaaattaacaagagaggaaagagggttatcatgggggtactcttttggatacatgattatagagggggagcaggtcatggaaggctcccttgagaaatgactttcaggtgaatgtggaatcattaggacctccactgcagggagaaaagtcaggcaagggaggaaggtagcaataacagtgacacggaggtctgtggctaaacactgctggtaccagaaggttgtgtgtccttcaacatgcctgagacacaggatatgtagacagatgtcatgaaatgggatagaaaagggaacttagggccaaatcacctaagaccatttcactggccatcagtctttggtcacacacgtgataatattccaaacataccttccatcgagtatacaatgtacaatgggattcccaagggagatggagcaaggaggagggaaagagacaagggaagaaggaaaataaagagaaaagcagccatcagggagaaaaagggaaaacaagagtgttgtcaaagatgttgaggaaagcatcccaggaaaggtatcaagagggagaaagatgttgcagaggccaactaagatgacccctgagatgcatcaatcatacgattatagcatcctgaggctgaataatgcactgtccccaaagctatccacatcttaatccccagagtctgtgaatatgtgacctttcacggcaaagggactttgcagatgtgattaagttaaggattttgagataaagagatgatcctgggttagctgggtgagcccagtggcattacaagggcccttacaagagggaggcaggagggtcagagtcagagagggagatgtgacctgccacaacagctaaggaacgcaggtagcctccatgggggaaaacgacaaggagaaagattctcccttggagccttccgaaggaaggagccctgctgacactaagattgtagctccaccaggtccatttcagaaagtggcctccagaaccatgtttaccaatgagtgttcttcaaaccattaagtttgtgattatgtgttacagctgagaacatgaacatgctgaagaaggagtggaaagtaaggaaaaacaaatgtgactgctccttctggaatcctagttaagaagtatacaggagggatgaaacagggctgctagaaagtgtccattagatgtgaacgactgcatttccaaatagagaagacatcagaaagaaatcaattgaaacgattctctataaccatctagtggaaaacatttgtagaaaaaaagcatatactattagagctggagtctgctttctaagcccggaaaacccaaatcattttgaaatttctttccaaagcagtttaaccttttaaacaccaaaaaaataaatactggccgggcacggtggctcacgcctctaatcccagcactttgggaggctgaggcgggcagatcacgaggtcaggagatcgagaccatcctggctaacatggtgaaaccctgtctctactaaaaatacaaaaaattagccaggagtggtggtgggcgcctgtagtcccagccacttgggaggctgaggcaggagatatgcatgaacacgggaggcggagtttgcagtgagcggagatcgcgccactgcactccagcctggacgagagagcaagactccgtctcaaaaaaaaaaaagacaaaaaagaaatactgcaatttcttcctgagacataagatcaatgaactgatcttcaactacacaaaaacaagatggcactgctgttgaaaatgacgtcaaaggtccactcactttgaaggataattagattaaatagaatgtttcctaaaatcggtaattttttggttggatagtcaaggaatcccaactcatgtggtactattttatcccttttaattactttctcagatggttgatgccacatcatttcagagtgttgttctaagacttaaccatagaaatggtgatgattttaaaaacacctgaaaacactgagtgttagcaaaatgtgtccagtattctagttacactttaagtaaaatgtttaaactataacctaatatttcaaatataaaataataaatgacaattattcactctcagttaattaactgatttttaagcaagtatctggcttaaacattgaaaaatacaacctatgatatcttatcaaaagaattagttgagatttttaactaattattataaaaggctaaatggaaatagtagcaacaaaagctatcaaaaaaccaccttttatgaactttaaaatctgtagctggcaaattttccattttaaagtttaccttgattatcaatcttcaacttttgaaaggtaagaaattagtgaagacacatatcactggacacagtgtgctgttcttttcatttacctgatgccatttgcttattactttgccagattttatttgttaacttcttctcagaacagcataatttgaacaatccaatcaattaccattaaaaggacaagtgaaagactaaacattccccaaggaaggtttaaattttccaagtaattgagaagaaaatatagcagctaaaacagtagtccttttagaagacttaattacagataagtcaatgctaaataatttatatttttctgtacatatatatgagatcagaacaaatgctggggggggtggggaatctcttagactcaacactcaattgcttccaagttgctatcttctattaaaaaaaaaattcataagacattgcactgattttcttctccacccaggtttgcaaaactcaagaaggaaaattatacctactcatcccctggtgaaaacagaatgcttcgtttaccaaaacatgactaacatagcccagagcccaagataacttcatcttcccatccaatgttaaagcaccacagaaggttttctgcagaatgtgaaggaactccactcaggaagttggtgggctttggaccaatacacgggagagcgtaggcaaagaatggcgccttctgagagttggataaaaccagcattgcccaggggcactgcctgcccttcttagctgaggggatgggcaataggttagggaacccatttggactgctcagccaggacttagaccttacggctactggtttccagccagggcttgtttcacttcctctgaaactgctgagttgagaacactggcctgcatccaacacatataaagcatcttctacgtggcctgcactgtgatacatacttggcagcatgacattttcttatttatattttaaactgtgtacaaagaggaatagcacaaaggttcatggacaggaaagagtgaccgctgttccaggcctttgcactgaccacaattcacatggatcatgttaccttctacctttagtcctaactgctatttccccatcaccccatgtcacacttaaattgaccaagacttagaaacacaattgaaattcatgttttcagcaggcactgtggaaagggaagtataaaagattaagagaatgtttttcagcaaaagatccttaatcatctgtgtctaaaatatatttagttaatatttactacaggtccacagcatgccaggtgtggcagagaacaacatgccagcgaaagacaaaacaattccattccccattaatattaattatccactccaaggaagcgtactgagtcagaattacttctctctcaaaaattcccacaaaaaatagaatccaggaaccccctggttttaactgtacaaaatgcacttcattaaaaagttcagtgaagcggaataaaaatcacaataattgtttgcatttaagcgttcctttcttctagatcataaaacaaatggattggagtgtgaaaaaaacagtcaagatgtttctccaagatcaatctgtgcaataatgaaccttagccctaagagagatcaaccagcaactggaatccatcacttgagcagctagagaccaccaatgaaaacccacacgaaccagctgcagcttcttgtgttgttgaacgccactgaatctttccctggtgcacataaattttacaggtaaaattcaagggtgttcccaggccccactcatccatacaccccagatgccaggctttaaacttgctctgtgtttaagagttgtagtgcatgcattcatagaattcctaatacaaaagcatatgctctgttgttaatgctaatgtattacatatttctaatttaaaatgtatgcacggatgcattaactcataggcccaagatgatcaccatgaattgccaaagtatgcattgccaatgttttctggtaaaggatcacatgataaatattttaggctttgtaggccatgcagtgtctggggcaaccattccactctggcactgtagtataaaagaaccatatatgaaaatgtaaatttaagtgtgtggttgggttgcaaaacattttatttacaaaaattggccaccacccataggccatagttgactcaccataaggtagggcatgtgtgcggcaccatcatttgctcaaacttgagctcatttttatcctccagagatcaaacattagcttatgtataataacttacaaacagtgtaaaatgattcatttaactatatatgcttgcccttttttcccattctgaaatatagcctcttgacagaaaagcagcataaactagggaggaaaaacaggcaaaaaagtatctgcacaaaggaaaccttatgagtttgagaaagagatgaaaggaaaaggataaaggaagtctaaagacaaacacatacattagaaaccaccatagaatgaaaacgttccttaaaaatcatgttaaaagtctttgtttttctcttgacatttaagcactgaaagaacacagatacaagacataagccttactcaccatttgtgtcattgtggattcagaattgatggtttttaataaaagcagtgaacatattaataattactgtaaatttaccatctaattaaatcttagaaaaatcataattaagctacctgtatatcaccttcatcagtattttgtctctataaaaatacatgacaatctgttttctctagaaatttaaaggaaatataaactctaaccaggctggagtacagtggtacgatctcagctcactgcaagctccgcctcccgggttcacgccattctcctgcctcagcctcccgagtagctgggactacaggcgcccgccaccgcgcccggctaatttttttgtatttttagtagagacggggtttcaccgcgttagccaggatggtctccatctcctgacctagtgatccgcccgcctcggcctcccaaagtgctgggattacaggtttgagccaccgcgcccggccaactccaccttctttagtcagagtggcttaaaaatttcctagaccgtcctggctaacacggtgaaaccccgtccctactaaaaatacaaaaaaaaaaaaaaaaagcgagcgcccgtagccccagctaccccggaggctgaggccagggaatggcgtgaacccgggaggcggacgcatgcgcacgtacacgcacaggcacacgccagaaggcacgcacacgccaggaggcacgcacacatttccgcacccgatgccctacgcatcaccgacgtaatgtcccgcgtggagccccacagggaggaagtgccattagaagaaggtggggcgaaggtcccaggcgaagtctccactgaaggagcttctgagaaatgctgagataaaacagtcctcgccaaggccttcttttccttctttcttgtactaagcattaatcttcctatccccagaggccagtatgtcagtgcccatgggaatcctatcgctccaacatgtccctctttttctctagcagatgtcatggacccaccttgtaggattttggaggggaatggtccctggtgagagaggaatcaggaaattagttttgcagaatgggaaaactgaaactgttgcctcagcatgaaaaggtaattgacataaaataatctttgactcgacacaaaacaaagaaacacagatgagctttaaaaaattaagttacattttaaaaaaattaagtcggggaaatttttgaataaacaacaaaatatatttattttcgtttgatcaataacctacaacgcccttcccacttcttaatttagcaaatacttattagtttactgctatgggacaggcactcttgtggctgacagagaaagaaaagttaacaagaaccagcacccgtccctggtgtttccatgtatccaccatagtttacataaaaggattagatattgaagttttgataattgtacactttttaaaatgtccatcaagtactaattttaaaatctaaatattaaactaaactttattttccccatgtctgcacaactctgttcatctcttttaatttccgagaagacgaaatactctgattagctcctaaatactcccaagctagatagaggagaaatcttttttagcaattactcttcaattgatgagctttcatcccactttctaagtggaaggagcatatcatagagattgcgcgtgtatttcaatcacaatttaccccattgtctgcctttgaaatgtccttcaagaatcgcaggtgtctttgtaataacattcaaatactgtccttttttttttttagtcgttgattccctaacatctgaaggttatactgtagttgctgcaccacattgatttgcataactactctatgtcctttgaaaccacaaaatgtttaataaaagattcatttgggtaatatgtgttcagaacttagtatcaacaatctcaatgttcaaacttacaggcccctagaattatcctgatcatcccttgacttaaaaattatgttttcaggaatgccatgaaaggaatttttcttgatcatcagttttgaattggactaagtcatcctagcaataaaataaattctaacataagatcactaagactatccagattatcatgaaaatccattgcaaagaattttccctaataggggttacaaaaccagaaagtgttcagtcaactgtatgtagaaaaattgaatgaactgacataaattgaaattttcgagtattaaataggcttcacaaattatttgtacttctcagctagctgtggttcttaatttacattcacacattcttcatagtgaaaaggaatgaatgcctgtctctgcagtctttaaacataccaaaaacctagtaattgcaaacaactaattagcagcagagctggattacagcatagatgtcctcattatcaggcctatgtgtgtctccacgaaatcctccacccctcctcaaggacaactgatgtcactgaagagtcatgatgccttcagttcttactgaggattttgagaatactgggaaaggaaaaaccctttgtcacttgtttttcatccagccaactgattcttggtgtacaatgtaggaaattccaacctaggatcaccattcagcaaagaccactccaaattatcaggaaaacacactccaaagcattccccccttaagagaaaatgcagctaccaattaagcaaaagcagtagctgactcttgcagagacatactgataatgcccagtggtttcaaatgtagtttgaacctaagtgcatatggtaaaacaattttaaaaaagtcctaggttcagaagttctcatttccttctcatgattgtgcactttatataatgttccctttgggtttcataaagtgagtctatcatattataagctgtgactcgtctatagctctgagcctgatgccagacctgttactactgcttctccttggaactaggacagtctgattatattcacctgaatgtgctttgcactgcagctactgaaataattacaaccaatgctgcattgggttcctgttccaaaggctgtaagtgtgagagagaagacaaacatttcttagacttcaggccttgattatttattaagactcatccaggttgaaaaaaaagaaaatggaaaaaaagaaagtcgtgtaattcaggagccaaagggatttacataatgtatcattattgattatttagctgtatatgctgatgaaaaatgatgtgtacctttattcgttttacctttgataagacaaataaatctatactagataaaaatagcaaacagctgatcaatcatttttccaagtatgattttcttccaatttgtatgttaatgatcaaatgggggaggtgggacagcattaatctttctttataaattacaaattatctttgaaaaacaaaacctagtatttgtttatggcaggaaatatggagagatgtttaaaaatcaactttgttggaaacaagagttccataaaggacatgaccttgacaatcttctagaatcaaggaaaaatactgaagttttattctgtaaagagaaagccatggataggaaaattatctggcaatcattaaagagatactcaaaaggcctttgtggtctaaattttgacaaaagtttggaagctacaacattcaaattgataagaaaatttgtcaataaccaatatttaagcaatcaaattgtaaagacttcagatttgcagctgaaccatgaaaagacagagccatttacttgagatgtatgaaagcatcagatgaacctttctaaaatttgagtttgtggggaagggtccagattttcaattgtgaaatatctccactaacatgggctcacagctgtatatcacaaaagtattctacccatatcttttccttgggctctgctctctttctaatgtccagacagtgagaaggatctcatggtctgagtgtcccctctgcctgtactagtagtacctgtctgacattttgaaccccactctgcaggggctacaaatacaaagggtaaaatgagatgctggggtcattcaaatggcccaagatggactttttgagtcctagatcattgcaaatctttactctagaagaaaatggacttccggtgagcagtgcagccaagggtgaatttctgagaggtttacatacagtgagtcagacaggtgaccttcatctgtgtttgtctactttatgagatgtaccccgaagtgtggccatgaggaggagcagacaattatttcaaaatcctaaatttccaggcatgtcactttggacactccaaatgagcttgaaaccactgctttctacttttatttgtttcaaattgtttttttttttttaagtaaacaattttcaccaccaaagtaatccgaaagcactgctagacttggtttaaccaggctcaaaaatgcatcaatgaaataagtcagtagaggttaatgattaccaataattattttttcaaaattatccatcaactcatgcaacacaggatggggtagaacttcagtaaggagggaaaggaaatgttgcacacaggcagacagaatagcctaaatcaaaggctagagataggaaggcaccaggcttgggattgcctgggtggaacaagggactggaaaagaagttcagatgctctaaagggggcttgatccaaagtgaagtgtgtgctgggcacagtggctcatgcctgtaatcccagcacttttggaggccaaagcggatggatcacttgaggtcaggagttcgagaccagcctggtcaacatggtgaaaccctgcctctactaaaaatacaaaaattagctgggtgggaaggaagttgtggctcacacctgtaatcccagcactttgggaggcaaaagcaggcagatcacctgaggtcaggagttcaagaccagcctggccaacatggtaaaacctcacccctactaaaaatacaaaaactagctgagcgttgcagtgggtgcctgtaatcccagctactcgggaggctgaggcaggagaatcacttgaacctgggaggtggaggttgcagtgagctgaaattctgccactgcactacagcctggatgaaagagcgagattctatctcaaataaaaaaaaagtgtgtatgtacttcagaaaagtcgattaaccagtaagactgaccaatatggcatttttcagcattctaaagtttcctctgaattttctgttgaaatattttaattctggatcaggcactttcagcaatattgatgagttcccattcatgctcatccaatgggactctcacccaatgcatcccctaccccttacctagaaagtttgggcattccttagacatcaccaggcactgagcgttgcatagacattgttttcacctaattttttttttctttgagacagggtcttgctcgttggccaggctggagtgcagtggagcaatcacagctacacagcctcaaactcctgagctcaagcgatcctcccacctcagcctcccaagtagctgggactacaggtgtgcatcaccatgtctggctaatttttaaattttttgtagagatgaagtctcactgtgtggcccaggctggtctcgaactcctgaacccaagtgattctccctcctcagcctcccaacgtgttgggattacaggcatgacccactgcacctggcctcaattacttcttataatatgacaggttaggtattttattacccatgtttgacagcaaagaaagaggaagatattaaaaggtaatgaatgaaccatctacctaaggtcatgctgtagtgtgtgcttccatcctgcagcctaaagatccttcttggatgcctcttccaacagacaccctggcgtcctgataggcccaggggttacaaggagagcatgcaaacagaatgaaggggcctgcgtaacagcagcacatgtttcccataagtgtggccaatgatctggggctgaccctcccttgtggatctgtttccccttagaaaaatgaggtggtgagaatgaacctactgctctcccagccatgcatgactcacctgggctgtcctccaggcagaccccaactccaccacctttcttcccaatcttgcatctaagctctgatcagatgggaacaatcgggctcaaggaaggatgaggttcttagggttacaatgaatgacagtgagcctcccatacaaccctctggtctgagctccaggttcagggttttgaacaactgccggagcccacagcctggccacacagtggttcccgagtccaacggtgcagtccagaacacagtcattgactgctgtgctggactcgccaataactattcctgatacttaccattgcctcgtccttctgagatggtgcctttaaaaatgcctccctgggccgggcgcggtggctcacgcctgtaatcccagcactctgggaggccgaggtgggcggatcacgaggtcaggagatcgagaccacggtgaaaccccgtctctactaaaaatgcaaaaaattagccgggcgcagtggcgggcgcctgtagtcccagctactcgggaggctgaggcaagagaatggcgtgaacccggaaggcagagcttgcagtgagcggagatcgcgccacagcactcccgcctgggcgacagaacgagactccgtctcaaaaaaaaaaaaaaaaaaaaaaaaatgcctccctggaaacctacttgattttttttttccatcttagcacattgttccctatttaaaaaaaaaaagaaaaacatacctctctccatcagtaaaagagatgatattgtttcaaaaccaatgtgacattccttataagctttcttatgggtagttacaagaactagccgatcatgacatgaagtaattcttaacttgttccctaataagtcaaggaactagtctagtgggagcacctacacacatgcatggctgcatgtggaatctctatgcaaccattttagcacacacatgcagtttgagaatacaaaatcaatgaagactccttgaggtttccaatgggcaactcataatctggttggcattgatctgggtggcattaaagttttgttggagatcatcaactcactgtatttctccattagatataacttgtttaataaaagaaatctgcaaaatgtgtgaaaagaaccaatcaatcatttagaaatcacttatttgcaagaactaatcctcaacctgcagagatgttttgctgtggcagaaggtcagaacaacactgccattgactctactgcaagaaaacttatctcaaaattagctggatgtggcggcatgtgtctatggtcccagcggactcaggaagctgaggtgggaggatcacttgagcctgggaggttgaggctgcagtgagctgtgatcgcaccactacactacagcctgggcgacagagcaagaccctgtctccaaaagatatatatattaggttggtgcaagcgtaattgcagtttttgccttacattcacgggtataaaccgcaattatgtttgcgtcaactgaacagatatatcatctccattggatcagttatcatctcaggaccattcggagtttttcttgccatctcacccggaatgctctctttataggatgcgtctcatgcgacactcctccttctacttttaagcaagaaccatcgataagtaacacctgcgagatatctaacagagtaccacgtggcctttcacactcaggattttgcatctataggaaagatggtaagggaagaagaggatacatcactcaatacccttctgggcttacttccatgcttgaaaaaatattaatacaaagtagataaggcctttgggtttcatagctaatgagccagcacattattaaattacaggaagacaagatcatattttaactatgtttttgatttctcataacacctagcacattttgttattaataggcattatcataaatattgttgatgaaactgtatttgtaaaaatgaatttatatttaacaacaatcataataacattcatcttcactgacccttctacagccaagggcaggagttattatgacatcttattttacattgggaaaaaaatgatatccaggtgttaagtaacgcagctcactgaagcagggagtaagacctatcttgactccaaagaccatgcattttttcaagatatcaagctacctcctcatccaaacaattctaataatagtagtaataatagttatttttttattttttatttttattttactttaagttccgggatacatgttcagaatgtgcaggtttcttacataggtaaacgtgtgccatagtggtttgctgcacctatcaacccgtcacctaggtattaagctccacatgcattagctgtttgtccgaataataagttataatagctaatatgtacatagtgggtcagcatctaacttgctgaattctttacatatactaactcttaattgtctccaaaaacatataaggtatatgtgagctttatccccattagttgagaacactaatgcagggacagattagctaacctgcccaacaccacagaactataaaagtggagccagaactcaagctgggtggcttggctttcacctgcctgccataggacactggctcaggtggggattgagaccatcatttctctcccacatcccgcaatctccgcactgtggggatccatggctgaaacagttttcaacagtgacaaaaattaccagtggaagaaaaaataaagttttgtgatattagcaccaaacacagtcccatgatgcatgagtgtgcatatagtaaatgctcaattaatattagctcttgaaattgtattattaagactttgaaattgcctatacatttattttacttgatcatacctttgttcacaccctccaatcagtgttaaatttacaattatcaagttagtgatgtatgtgtgtttcagaaaattttacaataattagtgtgcattgtatctgactggctatattttttgtgatacggtaaaaattattattattattttacttatttattaactttggagacagacctcactcttttacccaggctggaattcaatggcacgatcacagctggctgtaatctcaaattcctaggctcaggtgatccccctgcctctcagcctcccaagtacctgggactacaggtggatgcctcgaaacctggctaattttttaaataatctttatagagataggatctcactattttgcccaggctggtctcgaactctgggctcaagcaattcttctgtattagcctaccaaagtgctgagattaataatagtcatgagccaccacccccagcctattattactgtattaggtttgaggttttgtttgtttcttggttcgcttagctttgtttacaggtttgtttaaatacacaagtgagatggtgaaactaattgtatctgtgtgtgcttcccctattttcaaatccgatattgctaaaatctgatggaacaaaatattcccactgaaagtgtttcggtggctcacgcctgtaatcccagctactcgggaggccgaggtgggcggatcacgaggtcaggagatcaagaccgtcctggctaacacggtttaaccctgtctctactaaaaatacaaaacaattagccgggcgtggtggcgggcgcctgtagtctcagctactcaggaggctgaggcaggagaatggcgtgaacccgggaggcggagcttgcagtgagccgagatggcgccactgcactccagcctgggcgacagagcgagactctgtctcaaaaaaaaaaaaaaaaaaaaaaaaaaaaaagtgtctcatgtgtagtcatctacctggtgagtctccctgaaaagaactctgttcatccattctagttctgcctagtaggagtgtgttcacagttgctgcccttgaggtcaggaatgtttccatgcatcctgcaggcctcggtcaccacctctccttttatggggtccctggtctctatcctccatgcagactcaactgtctttcctgcagtccatggttatgtatttcctaactaggtctgcctcttcataaaggaaaacccttcctgggggtactcacaacacagcattcttcctggcttctcttttgctgttgttggaaatcccaagcactgaggagggagagaaaggcaggggctttttatcacacccataggtgatgccatttgggtgcaaggcagaatgcagaccactaacactctctgttcaaataatcactatttcatgtttccccttggttctcagtgatgtgattcactctcgcaaacgttatttcatttatttagagctagttataagccattgtcatgtagctgatacaatatttcaaaggttaaagaataaattatctagattaaaattcttctggactttattccagaatttggacaagataacctattacagaaggccacaagacagaacgagatcctgtatcaaaaaatgcaatttcatattaatatgaagatgatcagccatttgtactcatatttatctgttgcctagactggagtgcaacggtgcaaccttggatcactgcagcctcaacctcccaggctcaagcaatcctctcacctcagtctcctgaatagctgggactacaggcatgcaccaccatgctcagctatttttttttttttttgtattttttatagagacggagtctcactatgttgccctggttgctctcgaactcctggaagcaagcggttggtgcctgctgggcctcccaaagtgctgggattacaggcatgagccaatgtgcctggctagaattgcattttataatctaagttgtcatataaaaactttatcctatggtattcatatcatttgtaataatttacattctacttaataaataagtttttgatcactatctaaaagtatcttttaaaaacattaattatacaggatgatagattttcaatagtcaacatgaactaaagcagaaaggtgctaattaaactaacagttatggggccgggcgtggtggctcatgcctgtaatcccagcacttcgggaggctgaggagggaggattgcttcagctcaggaatttgagaccagcctgggcaacatggcgaaactctgtctctacaaaaaaatacaaaaattagcgaggtttggtggtgcacgcctgtagtcccagctactccacaggctgaggtgggaggattgcttgagcccaggagcagaggctgcagtgagctgtagttacgccactgcactccaccctgggtgacagagtgaagccctgtctcaaaaaacaaaaaaaatcagcatttatggaacattcatatcattttaaagaaagcttagcataaagagaatacattagtcaaagcatacaaaactttggaggaatatcagctgtggaaactaagaaggttatcatccacactataatgacgtttcgaataagcctctccatgtaagttcatcattacaactaaagatttgggggttcagagagatgcacatagccattccaactcgccctgggtagtcagtcaagaagacacctaggacataagatataacgatataaatattttcatcaagatgacattgatagaactctgacttttcatatgatgctaatgttatccctttatatcaacagaaattacaatacagattgtctagaaaccctaagtcatgtcattgtacaagtgtttgctgaacgtggaccatgaatgtgctgtgaggacagggaagggatcctaaagatgaacgccacctgatccctctcctcagggtctttcagggagcgcatcattaaggcaagtgcttacaaattgcatgagctcctatactggtgatacaagaatagacagtgtcgtgctcagaagaggcagcatctcagaaaaagcttcagaagatgtcctcaaagatgaccttgaaagaggagagagagagaaggagcatgtttctcagagtgggacccatgaaaagcaagaggtggaaaatgtagccaaccacccagtgacctcaagaggtctagactatgattctagccaaggttctgacaacactgatgactaatatgaagatgtaggcctacacaaacacacacaaaaacaggaaaatacaaaggtatttttaaaacctgaggatatctcagagggatttttaagttaaaaagaagtatctctaggatggtccattatttattgaattttcttttgagtcccagtgaccccctaaatttctaaactaaaaagtaggaggacaaatttaattttggtagatttcttgattaactacaacaatatggtatgctcagctgagaaaagaatttacctgcaggttttagtgtagtcattctggatatttccggatgtgaatatgaatgttcaaatgaacataaatgaccttgatttgtaccctaagttatctcaacaaaattgtatgtcctttcctcaaacagagcaatctttcaaactgtatttatttttttaacttgcaaatttaataaatcatctgatttttggtcttggatttgctcccatttctcaacacaacattcatcttacttaatttttagcattatgaaatcaagaaaatattaatgaataaaaaaattctatttagaattttagaagaataagtttaaaaatagaggattgattttacacaattttgctcctcccaaatcatcccacaattctgataaactctcaagaaattaatttattgaccacactgctagttttgacccacatctttataaggaatttaaaaagcacatagactcatccatccagtgagcagtagaagtaagcaacactgcacggcagatttgtagctttagtgttagaatgtaaatgattaaacctcaaaatcctgaactttcttagactgcatcactgtcaatcttccaggcacggaccagaatgagaaatttgacaaaaattttctatgacatcatctttaatgaaatacaggcaaaaaatgtaaaaactctagggacattaatacagatgaggaagtttttttaaagatagccatttagaaaaaatcacatgcatgtactgagtgatccaaacatttttggtaaatcatgctaatttagaaataccaaagcaaacaatcaaggaagatcgatattcccttaggtgagagaggaactttcccctacagtgcgttgattttacaatgaaagacatccttccctcagtctccctggcttggctgcatatctcagaaaactgtgatagctgacttaacacttgtttttaccaggcaacatttgattttctcattcattaaatgaatatctatagagtgtcttacaactactcatttctttaataaatacccagtaagggctgatctattccagattcatgcaatacacatgtttagagaatgcagagaaaaattcactaaccccccagatcctccacacatatccataagtagacaaagaataaaaaagcctttgagatcaggtgagctcagagaagaaagtaaataatgggttaaataagaacacaatcgagggtggaacccactttaaatgggaacaggacagggtgctctgggcagagggagtggcacacaaaaatgtcctaacacggtatccactcagatcacaaaaccaaaagaggactgggacagcagttcagtgagaagaggatggcctgggatgaaggtggagaagtgagcaagaggcttactgtataaaagtggaataggtcagtgaaaggaatttggggttcattctcagtgtcatgagaaacagtcctttgtaaaacattttagactacgaaggagaaagacaaggatgggccaaagataagtaatgtcaaggccgccttcaacactttctaaatacctgttttaaagtgctttatatgcttaatttattcctttccttttcttttttttttttttttttttacaagatcttgctctgtcacacacgctggagtgcaatggtgcaatcctagctcattataaccttgaatacccaggctcaagcaatcctcctgtctcagcttcccaagtagctgggatcacaggcatgtgccatcatacctgcctaatttttattattattattattattctttgtacagacagggtctccctatgttgcccaggctggtctcgaactcctgggatcaagcagtcctcctgcctcagcctcccaaagtgcttggattacaggcatgagccacagtgcctgaccttaacttatttattttgcaaacatccctcgaggtaggtactcttctcacagccctcaacagctgaggaaactgagacacaagacgtcaactactgaaattcacactcaagaaagtatcaggtctcctggcctctgtaatggaaattgatgactaccacagaggaatacaaacaatgcatgttagagagagcagtgaaagaaacagcattttagccctcagtcatgaataaggtgtggagatgggaaaataacagtattccaggttgaaagagagcctgagaagaatgagaaaaagcaagaaaccaaggtgaaatgcagtgattcctatccatactcaggttgggtggaggatgaagtataacacccagaggagtaaaatgatgactgcagttgtaacggcggagatggggcaggtggtgaagcacagtggatgcttgtttatgaattttgaacgagatagtagtcttacataatcaattatttgtgaagatgaagaaagaatagctttaaaaatagattggagagtgtacaagtcatagacaggatatgattaaaatagtaacacataaagtgagaagatgaccaaggaaagtacagatgtatctcagaagaagaaatgacaggacctgttatttctgaaagtgatttacactggggatgggaaagagaggggattcaaatccaagatgaggaattgagaggagaagatgccatgagcagggagcagggtaagcttggcaagaaagatgatgggacaattttgggaacactgaattgagttttggccagagcatataggcaatgttgttgaaaggggagctgtaagggcaggaaggaacttggaagagaagtgagagcagaagatagagacccctgtggtctctccgatggaaataatcatcaaaccatgagtagatgcaaagctacataggacagtacggaaggaagaggagtgattcgaggatggaatttagggagcgacagtaactgcaaaggcaggaggaacagacaatcagaaaagtcagttcaattaataggcagtgaaggaaaattagaagaatagatttgaggaaggagaaagttactcaaagcaggagcaataaataagacagggcctatagagaaactccaagcaggatatgggtttgttgaggggtcagcccttccagtggtcagctagacaactgaggggatgccacctgctgtcagaaaaaaaggtataagggaagtgggaacaattacagaaatgtttctcaataagagtacctgctcttgaagtcaggacacaaataggtcttggaattatgattagaatggttgaaaaggtcttttcattttctttttttttttttttttgagacagggtctcactgtgtcacccaagatggagtgcagtagtgtgatctgggctcactgcagcctccgcctcccaggctcaagcaatcctccaacctcagcctcccgagtaggtaggactacaggcatatgctgccatgcctgactaatttttgtactttgtgtagagatggagtttcaccatgttgccccggctggtctccaactcctgagctcaagcaatcctgcttcagcctcccaaagtgctggatttacaggcatgagccaccatgcccctctgaaaacgtcttgataatggatatgtctgccaagtttcaggaaaaaagaaaaatgcatccaagcaacataatatggaagactgaaaaacagtaatctctcaaagtctattgattaccttataatcaccaaaaaaaatagtaaacatctctgtcagtctcatgtgtctccaaagcatctaataatgctgaccttcacctacctctgaactctctcccttttcttaactggacaactccacccataactgcaaccttggatggttattcattgtcttggcctctatccaatagtttgcaagattctatcagtatcatccttccaatgcctctgcagagcctcatgccatccccatttcctcaatctctaccacagttgaatctataactagatctcaacttgcattactgaccttctgtcttctatccctacctctactatcatgaaactgctattccttaaataattctgcaaaagtcctaatatgattgccccattgcctacagaataacatctatatggcttaccatcaagttgcaccacctgaaatgatctgatttcaatttcatcacccaaactcaacatgcccttgagacaacactcaacacaacacagcccattcctcaacacttgctgtacctatgtgtttgttcacactttctcctttgtccttatgacaaaattctatgcagctcataagccacctcctttggaagagcttctggtgatagtctagcttctgagatggccaactgacacctgcaattaacaccttcctggaatcctcatccacatggtgccagatttgatttgaacaaccaatagcatgtagcaaaagtgacaaggtgtcacctccaaatcaagtgcaaaagtgacaaggtgtcacctccaagatcaagttctaagagtgtgtggctttcaccttagactctctttcagcctccctctttctctcctcactttcagaaaagccagctgttaatgtcacacgtctagccctagggagaagcccatgtggccaagaactgaagcctcctgccaagtgacacataagtgagattctccaacaccgtcataaaactgcaagccctgtctacaacttgaccacaacatcatgacggaccctgagctagaactggccagctacactgctcctaaatccctgatgtatagaaatgcatgagatgataaatgtttgcagttttaacctaaggtttagaagaattttttatgcagcaatagataaccaatgcagtgtcctaaatgacacaaatggaaaacaagattctgtgctgccaaggtctgtgtttttacccacttatggaatgtgtgacgtgcatgccttgtagtataggtactttcatttctcattttctcttccttactgagagtctccctgggatcagaggttgaatcttatctgtgtttctatcactgacggtatctggcatggtgaccttctcaaagtaagatgtcagtacatagttatcaaatgtataaacgaagaaggaagaaaagatgttgtatgcatggtttctcagtctttaaaggaagaatagctgcatgcagcctggaattaccagaccttcgtttgagaagccatatacctgtggatccctgaaatgagaaacaatctgctgccttcaagttgctgtagtgttttgaatgataagcctagcatttgggggccatggggaaataaataatgcccagcacgtcaatgagtttttatggttgttgttattaatctttaagtccctcacagtccatagcacatggtagatgcccaataaatatgcattggcttgaattgactgggaaactgaaaacataaagataacttataaatcagtagagcacaactggatgacaaaaagcaaatgatgagacccagagctgtggatgccggcctctgaacaggaaggaataaaacagaatgttgagctcaaaacttaagcaggtcatgtgtgcacatgtaacccagaaataccctaaggcagtagttctaaaagagtgatcccaagaccagtaacggcaacttcaactggggaattatgggtcccatctcagatctgctgactcagaaactcctgggatggatcccagcaatttgcctttaacaagacctctaggacactctgatgcttatgtttgagaaacactacactggaccatctgcttcaaaagcaatgaagacattgggtttagcacctcctttcagtaacaatgtaccgaagactatcattctgagaaattcagcaacaaaatggatgggaattaaccccagaacccatggttttgtggatgcagcaatcaggcaaaccaggaaaccatgagccaattcttaccattacaacacatcgctgagggtctgcagcaggagctcaaactctatcccttttatcactaaaagatgtcaccctgcaacacgatcatcccccaatgtattcatctctacaaccatttctttcagttatttctacctcctcccaacttgcagttttctcatcattgggaagacctttcatgaaccctgacagcatccccatacctacgaattctcatattctcctagccccatgcccattggctgtgccactctgattagagtcatggtgtcagaagcatttatgctattgcttgataagtgtctttatcctccagcagagcacacactccaggagggagctggtgtctcttcttcacctacctcactgagcagcccagtgcctgccagtcaacgggcactcagtgatcagtgtactaaaagcacagctaagtttcaaaaagttctgacattcacatcaaatgtgaggttaaagagggtcgcattaatccaatttctaaaggttaagaaagatctcttcccagataagaaaagagaaggcatgaataacaaaactctatgtccatacaagagcagggaaagatgtagtgtttgatcatttgtttaatggtttacaattcacaagtttgaagttgaaaatacactggagaaacccaacgttgcagttcctatttcctgagagtcagacatagaataaagtgaaggcaaaaattgaatactatgaagtgtactccccaccaccaagttcaatttcagtgcaatttcaattatctaccataaattacacactgtgcttttaggatactacctgacttctgaggatctagatgtcttgcagtgtgtaaatacttgtgaatgggttttaaattacaccatttctactagcaagcctcctcttgccaattcatatccaacacttaaccaggtcacaatgaagtttatttagaaaacacacggagcatctcatatccctaatcatggtttaaaatgagcagtattcaagtcaagcgtcttaattacaatgatcattgttctcaaatcatatagcttagaaaggccctggagacaggtccaactcactcattttacagttgagggaagggaaacccaactgttgatcttcagacacctgcaatgaattatgagaccccccactccacaatgtgttgatgcagtgacatggagcagtggagtctctaaaatcctcatgacgatgtgaaagtgattctggaagacaagtgtggctgggtgaggagtctgcccttcaaacccagctctgccccaagctggctgcataacttcaggtccatccattatgtaccacatgggctatgagtgatatgttcattaatttgattgtgatcattgttacacaatgtatacgtacatccagtcatcacactggacactttccatattacagtctttgtcaaataagtatttttaaatgaaaaaaaatgaatttaaataaataactctgtgtcttggtgtatgagtttcctagagttactatcaaaaagaatcacaaggcttatgtctcaggaaacaggaatatactctctcaaagttctgaagtctagaagtccaaaatcatgatgttggccatgctccctctgagggttcttggtgaggatactttcctgtctcttctaaattcagggagttgccagtaatccttggcattccctttttgtagctgcatcatgccaaccttccatcatcagatggccgtcttcaccctgtgagtgtctgtgtcttcacatggtggttacgacaccagttgtacggaataagggccaccttaatcacctcattgtaattacatctgcaaagaccttatttcaaaataagatcacattctgaggtgctgggcattaggatttcaatatatctttttggggaacacaattcaatctgtaacacagttcaatccataacagtaaaccagattttatttgtaaaattagagggtaagaatcaaggtattttagtttcaatcactaaaatgtcaagcctggaacaaagtagaacaataaaattgcactagattctctctctctctctctcacacacacatacacacacacacacacagacatatttagaattgggaattgagaaaatgcaacctttggatggatgggtggatgagtttactttcaaacaggcattttatcatcatacaaaaatgaccttgccatttctacacatttgcatcacattgatgaatgaggtcagaatatattctctctgcacatattcaaaactgcatccaccataaatgtggagcacaactgcaaccaaactgtatttgggagcaatttgcatacatacatcaaacactgtgtgcaataatgtataataagttaacttttccttttctcctataattggctggagcctgatttattgacctatttccttgtagagcaaaaacttattgtaaacccatcccattacttagttggaatattttaaccatggcatcaacatctcaaaaatgtaaccaaatttttaaaaatgtacccaagaagaagtaaaacacttacgtttatgagtggcttaatgaaaataatatagattccttgtatcaaatataaatattaaataaatgcatatgggaaaagaacaggattcactgcattatacaattttatagaatgaaaatcttcttgactagttggtgagtatctcccagacttttagaaatttgatatggagtgaaagttggtgcttcaaatgaaatgaggcttattgctattttattaacattggaataaaaataactggttttgcatatatccttttattattaaagatgtaaaaggtgtccatttattatcaaaattaaaaacgatattataaaataacctattatgaggtcacttatgacaaatgttatactgcattctttggggttggcgacattaattctgaatctctgcggttaataatacatcttttaaaaacacatctgccacataaattcatctcatattcactcacagaatatcaaaagttcttattttgttggataatctaattttaatcaatcaatgtaacagttcagaaaatataacaccattttcaaacagtcttaaatttaattttctgtgcagcacatttctggtgttcccattgatgttaataagttctaataactgacagctctcatcaatgtgttcatatctgtggaacagtaaatctcatttttcacatcaaatgttcaaatactctcttcccatctactgagctttcatttggaacatgattttgcccaattttagataagctagctgcatttcgttctgcactttgttctatcagatacttatcaaggattttctttttctttatttccagtctttgttttctcgtaagctctcacttatataaatcaatgccacctcctttcggataacgtgcgttatattaactgtccccaaatgtcaatccgattctcattacaattgatagaattcataaagtctattctggttatgaaaaacatcttccaaaataatgtggttactatctctcattgcactctttgcccagtttatcttatctggtcatgcccagtatacacgtcggggctactagaacccaaaaaccagtgaaattccccatgtaaaacttggaataagtacacctcatttcataacagagctttttaactgggatggattttactcccaaggggatatctgagactgtctgcagacattgtggatgtcaaactcaaaacataacagaggttgatgaggatgcagagagaagggaatccacatacactgttgatgggaatgtaaattagtataagttctatggaaaacagtatggagagtcctcaaagaactaaaaatagaactaccatcttatctagcaatcccactactgggtatctacgcaaataaaaagaaatcgctatgtcaaaaggatacctgcacgcatacgtttaataccgcactattcacaatagcaaagatatggaatccagctaggcatccatcaatggataaatgaataaagaaaatgtggtatatatgaataacgaaatattattcagccataaaaagaacgaaactatctcttttgcaggagcatggatggaactggaggccattaccttaagtgaaacaactcggaaacagaaagtcaaaaaccacatgtcctcactcctaagtgggagctaaataatgtgtacacatggacacagagagtggaataatagaccctggagaatcaaaaaggtgggagggtggtaggatgatgaggaatgagaaattacttaatggatacaatgtatgttatttgggtggtggttacactaaaaacccagatttcatcactatgcaatatatccatgtaacaaaacagcacttgtgcccgttaaatttatataagttttttttaaaacaggaacgtgtatacaacgggcacctagaagcttgagtccagcaataccattcagcatcacgcaaggcacaggacagccaccacaacaaagaattatccagcctcaacgtcaagagcaccaaagttagtaaatcttgttttgtaagagacatgcatccttttaaaatatctgagtaaatcaagtcacattttaaattatacagaatttaatagtttgtaaaattctctagtgcatccttgtgtaacaggttccaatgatctactaataatagttcaccatccctgatactcgcttagaagtctggatttatatcatgcatacacacacactcacagatacacacacatacacacacacaactcttcttaaaatgaggcatacttacattagcataagaatgatagccaactatctataactgtatagattagattagtttggttttctttagtcatatttttcctgttttttagagacagaatctctctgtcacccaggctggagtgcagtggcactatcagagttcactgcagcctccaactcctcggctcaagccatcctcctgtctcagcctctccagtagctgggattacaggagcgagccatcacatctggctattttttttctttttttctgtagaaacgcggtctcattatgttgtcgaagctcgtcttgaactcctggcctcaagcaatcctccctctttggcctctctttagcctctatcattcaaaatatcacatgcaatgtggagttcaatagaactaataattttacttaactgtgggttggcaaagaggaaaaaattgcagttgattctttgtgcgtgcgtgtgcgcccgtttgtgtgtgtgtgtgtgtgtgtgtgtgtgtgtgtatgtatgtaatggtgcaacaaaagctaccttctgacacccctctatctttgcttctcatcagatctgtatctctgccaggtactagataatatgaggctgaggtgggaagattgcttgagcccagaagttcaagaccgcatcgagctatgattgcatcactgcactccagcatgggcgacagagcgagaccctgtcttcaaaataaaaccttgttaaaaatagataaaactgagatatactgagtccaaagagctgtcacgtagctggccaaatttacccagcagcattccttctgggtagaacactaccaagtcacacagcgtttgctcctaaggagttagtaacttaagactgtgcattacggaaaatacacacgttccttctaaaataacttgacaactacattttccaattctaaaacccactttcatgtagagtaaaaagagcagttttttcaacaagaatgtgcataaaaagatagggaagctatatcaattaaaagaaatgtaaaagacaaatcaacctattgcagtgctagaccttgaccttgcgtgagttacaaaactacgagaagatcattttgacagttacaactttatagtggatgatacagaggaactactgttgataattttaggcatggaaaagattctgcagctgtgtaaaataaaatggttcctatattttagagcaacgtacagacatatctttaaatgaattacatcatgccataataagaatggaaatatgaatgaagttagatactaaagattaggctatccattcataattgctgaagccaactgatgggcacatgggatcctttattctatcttctctgcctttttttatcataaccagaaattttctgtagtaaaatattccataaggtttcaagtgaatacaaatgtttacagaagggatacaagagggaaaaatgtgtacagaccaatgcagaatgttttttgaaacatacaaaagaaaataagcaatgcccctataatgaagaatgcccaatttgaaaattagaggcgggaggggtgtggagtaaaaaaagaaaaatacattagaggagcaaaaacattaaaataagccaaatgtcaaaaaatatataaagaactgggtatgttaaagcatagtcttttgagaaaattaaccatgaaaaacaatgcttatgaagatttttaataatcctaaaatagcttatgctatcatactgtaggaaatgtaaagttcaaaatggtatagatagagatatatatagatctagacatagaaatataatgtgaatatcggtaaagatatgtgtacagatacaaaaatagatatgattaagatatagataagaatagatactgttattgatatgctgtagctatagactctaatattggtacagataccatacaaagatgtgatctacaggcaaatatatatgtccatacgtacatatgatataaatgcaggtaaacacgtagatgtagatagagaattatcatctgtgtttaaaatattcacaaaatcccttgaacaaactatacagttatttactattaactactagcctatggaatgatgatccagttttacatttcttttttcaaagtttctgtatttctttcccatactactcttcattccttcaccataagaaaaaaaaacatcctgcccttaaaagcctccttgaggctgggcacagtggctcatgtctgtaatcccagcacgtcaggaggttgaggtgggcggctcatctgaggtcaggagttcgagaccagcctggctaacatggtgaaacaccatctctactaaaaacacaaaaatcagcctggtgtgctcgtgggcacctgtaatcccagctacttgggaggctgagacaggagaatggcttgaaccaggaggtggaggttgcagtgagccaaggtcgcgccactgcactccagcctgggcgacagagcaagactccatttaaaaaaaaaaaaaaagagtccttgaaatggctacgatttgcttatattccttattcagagaatagatccagttacatgaattaaaaaaaaaagactgcttcttaagcaatgcttaagtaataaccgcctgtatgcatattaaaattttatgttaaaacacatcataaggttaagaggatgatatcaccttttgaaatactgatggttgtgacaagacgcacacagccattcatctaccctgatcaatggggtcctctggaagtcttctggttagtaacatgttccttcaactttatacctctttatcaaaagacactaggatgagtgttgggaggaaagccccactcttaagctgtggtatgggtggttttgcttactgcataggaagttcgtagattaaagcaatgaagcatattcaaggacgctgtaatgtttgcccatccactgaggtttcctgatggaagaaggtgtttttgcaagctgagcatccatgaaccagcagggctgagagtttctctaagagtcatttaccattgagtcccctcatttacttgctattcaagtgaatagactctctggtgtctacatcatggccacaaggaatataaagtggaataagtcacagcaatgtagcccaaagcatatctaaaatatccatgtgtccatactgatataaatgattgattaagtaaataaaggggagagacccatctttcttagagaagaattccaaataatttatcgatattccaccatccggaaagtggagcttaattctgcctcttctcccacccccaccccactttagggacttggtttcaaagactagacttgggcagggaggggagagtacaactttacagcagagaaaagtgacaaactctctgtcagccaggtgatcaaagccaacaccagcagcaaaagtcttctggacagtagtcaccgttgctagggtgagatgaaggaaaccttcatctctgtggatttcctcccccaaacacatacccctgtctaaaacatcagactggctctagttggtggacattctccatgacattaatacctcaaaactattaaggtcatgaaaaacaaggaaaaactgagaaactgtcacagactagatgaggctaagaaaatagggcaaatccatgcagtgtggtatttcagatggtacctcagaagagaaaaaggacattaggtggacaccagtgaaatccaaacaaattgtgatgtcagttcttagtaacgtactaatgttggttccttaagtgtaacagatggtcacgtaagatgcgatatgcgtgtggagttaaagagtaactctctgtactatctttgcaacctttcagcaaacctgaaactatcctaaaatttttaaaaggttattttaaaaaatgaaaacagtagcgcacaaatgtcctttaaaaagattaaaacaggtttgtattttgtaaaagtagtcaatgtgtaagaatcaaagagtcagaattatcatctcagtggaacaattctgctggcttccactcctgaaactttccaccaaatggaataatcagcaccttcttttaatcctgcagaatcaatgcctcagtgtacaaaagcaacagcaacaaagttaaagtttggaaatgtctctcctctacataataaatggagcattcccagcgcacttactttaaagcattgtggaaaaaaataatgaacgtcagtcacacagttttatccactgcggcattctcaaatccttagatggggagttgtaaaaaccaaaaaacaccactgacaaggtcgtcaagctgtttgacaaaccataattaattctcaggtcaacagaaagcatctcgataaaagctgtgactgaaaatactccaggtttcacaggtctgcactgcaaaaaacagttaccccaaaatatgaatgtcaggagtggagtgggcttttgtcgttgacgcacaacacagcgggttctgttcttaacacatctgcaagtccttattctgcccttcgtttgcccttgaaccagccctctgagaaagactaatcatcacaaaatacagatttcaccaagtcatctctctcttggagagttgacagggcatatgtgaacccttcaattttacaagaccctccaagagactaactcctgcaaatccaacttcctattttgccttctgtgtctctttgaagctgaggatttcaatgcacaggctcacccgcaaaagagggtcgtggagcctctttgcctctaggcccttttgtttgactcttaatctaatgaaggtagatgtttcttttctcttgattatatctcccaggactaaacatagatggagagagaagtagaatccaccagtttttgcagaaagatagagccaagtgcggtggctcgcaccagtaatcccagtatttcaggaggtcagtccgaaggatcccttgagcccaggcgttcgagaccagcctgcgcaacatagtgagaccccgtctcttaaaaagaaaaatatgtgtatagaaagttctcatcacagacaaagccctgtaaggaaaggaaagaatcatccctgaaaaagatcttatcctttcttaacaatgcttgagacacagcaaggtgcattaaacaaaggcaattaattaacacttcaaaaaatgtaaaaatgctgggttctgacttacaaataaaaacagggaatgggagcggggttagaaacagctaaggtgcattcatcataactcataaaacaaaatgagttcccaccaacaagttcagcttttaatgtgggacatgtcttttcctgctttctctgctagtccctttcatagaaatgatttatctgtttaaatcgctgctgcataataaagaaaagtctgttttgaaaattaaataatgcactttgctttattttgcccatttaaaattacttctaattttgtaagcttgtcatgaactggcgtaagcagatatgttaaaaattgggggtattcctttttcattgcagggatagtgtttaaaattatggagataaatcacggccgggcatggtggctcacgcctgtaatcccagcactttgagaggccaaggcaggtggatcacctgaggtcgggagttcgagaccagctgaccaacatggagaaaccctgtctctactaaaaatacaaaattagccagcagtggtggtgtgtgcctgtaatcccagctacttgggagactgaggcaggagaaacacttgaacctgggaggcagaggttgcggtgagccgagactgcgccattgcactccagcgtgggtaacgaaagcgaaactccgtctcaaaaaaaaaaaaaaaggatgaggataaatcactgaaactctctgtgactcaatttccttgtgtacatgagggaatacaaatgattgctcaagtacattcaagtcctaacaatctgtgattctgttttccaatttcatcatgagtatcccaacaaactgtacttcaaattcaatgcaggcaatttagtagacactgaagcatatttttacctttccaaattggaagtggataacaaggtaacaatagcactgtccctggagccatcctgtcctgtctactcccagtgaagtgaaatagctgaaagatgtggagagtaaatactcaaacacttttttttttttttttgagagagagtcttgctctgtcgcccaggctggagtgcagtggcgtgatatcagcttactgcaacctccgactcctgagttcaagccattctcctgcctcagcctcctgagtagctgggactacaggcacgtgccaccacacctggctaatttttgtatttttagtagagatggggtttcactacttgaactcctgacctcatatgatccacccacctcgtcctcccaaagtgctgggattacaggcatgagccatcgtacccagaccagacccttttcttaatttgaagagagaatttttttcctgtcatataggtgttggaaggatgtcagatgagagctgggatggggagaggaagtaaggaggaaagataagcagctcccttccattctgacctgctgtggcaagaatcccgggactagcaagaccaacaggatgcagctggcttcactgaacataatttgctattagcatcttcaggaacacacactgctggataaattcccttccaggagaggccacaactgaccactacatggaagagacagctgcttcttcactagccaatgaggcatccccacccaagtgtgaccaaatgcctctgaggctcagcccctcactccagaatgcccccaggtacctgaggatgctccagatttgggggctgcaccgtctgtggtttctctacattaaacagtatttttgtggagtcaggggtgagggagtatggtttacttttaaatatagttttgcaaactcctctgtttggtttttgtttgtttgtttttcataagctatgtttaaagtcaatagagaaaaggtaaatgcataccctggaattattcagcaatagaataacaccaatcaaattctgtccagataaatgaggcatttgaattctttttaagagatggagtgtcactctgttgcccaggctgcaatgcagtagtgaggtcatagctcactgcagcctcaaactcctgatatactcctcaagtgagccttacacctcagcctcctgagtaacagggactacagacatgcaccaccacacctgacttatttttaaatttttttcgtatggatggtgtttcctagactggtctcaaagtcctgggctcaagtaaccctccttccttggcctctcaaaatgctggaattacaggcatgagccactgtacccagccacatttgaactttttacaaatactgctacagcattacaggtagaataattattctttgaaaaaccttcaggaagatgtgctccccaataaaaagtgagctatgtatgcatatgtaaatgtatgtgtattttacatatacaaatatatgtatataatttacatatgtatttataacatcaggatacatgttggtctagaaagaaacaattttttattatttgggatcttactagattaaatgcctaaatacatttgattgtgaaatgactagacacataacttcttgtgtaattttaagttaatttttataaattatgtcatattctggttattcacttacgggaggcttatcaattgagatatcaaataaatcctggaaggttattttactggtgaaattgtcatgacagactgaatcatagtacacaaccactgtcacacaaattctatgggaagccatgtgtgatttattgttctgtcctcataatatggtaccgtttaatctctaccatgaacctagattgtcagaagattttttttttgaggtattgattccctcactagggttggttggttggttttatgctgcaacaaattcagattttccccactttctactactgccattcctgtgtctgctttatgttttcagtctctgcacaggtaactggtatttaacttccatgtaacttgttaccctttctccctgggtcatccttactgtttgttactgtttgagacagcatgaggggccttgtcttgaccttcctactgggttacattttagctagtaaccagaaccctctgtggtaacaggcaactagaaacccaaatgtaagggttttgattgtggtttacttatatttgttttcattgctgttgctattttctaaatgtcttgtctacttctcattggttctgatgcactaagtctatccgttccgcctaattccctgtaatggcatctacattattcatttcttcccacagcatacagttggcatgtgggtaaatttgcaatacgggcatgcatgttaaggcttcttcagccaacagagcaagcctgctacctcaaggctaggacaaacctaccctcaaaagcattacctaagacaagcagccttctcccctccctcaagaatcatattaactccatgatgtttatcaaatactttcatctccttgctcatcaactgtagtagtcggtctgttgaagaagttaaaatcgaactatataattaccctctgagaattcgaacatgaacctaattcctaatatttgggctatgtagctctgatgattttgcccttaactatttaagaaagatgtatgaagactgaatcaagctgttgttttccttaacttttgaaataggacatgagagattaaacccacacacacacacacacacacacacacacacacaccagaagaaaaattctggtaaaacttatttgttcttaaacataaaaccagaggtgcaaaataacattagtgtatggttaatataggaaagataagcaatttcatcttctttgtaccccacttattggtactcaacaagttttgaataaattcgtgaaataaagaaaaaaaccaacaagttcatatctccaagtagtcttggtaatttaaacactttcaagtatcttcataccctgttagtacttctttctgctctgtgtcaacagaagtattctcaacactcttgtggttaatttggttaaaactcattacaaagaaccctaagttatccgtcacagctgctaaacccattagtacaggagactttaaggccataatgtgtccattttcaggatataattgaagagaggcaaatgatatatggttttccaaaaatattggaccaggcagcctcttcaagaaagaatccctgattcgggagttcttatactttttcaagaaataatatatagtaaaatccatatacatctataataaatatattccaatgtatatatattgtatatatatagttcttgttcttttgtatgaaaagtacatgcaaattttatatgtatatacatatatacgtatatatatgtatgtgtgtgtgtgtatatatatatatacacacacacaaaccatatatatagtttgacatgcattttccaaaagaaactatattgtatgtggtgaatgaacttccaggctggttcacaggagctattgttagttaatggtgcacagaaaccacagcttccttccctcttcccttcctttcttctttccttccttccttccctccttccttccttctttttctcttctttctttccttccttctttccttctttccttcattccctccctctctccttcctttttctcttctttctttccttcctttcttctttccctccttccctccttctctccttcccttcgatctatcatccttctccctccctccctgcttcctttcttccttccttttctcttttctttctttctttctttctttctttcttccttccttccttccttctttccttccctcccttcctcccttcgttcctccatcccttccttcttccttccgtcctttcttccttccttcttcccttccttctttcttccctcattcctttattctatttggatgagtgacaaggtctcagggatccttaaagtattaaagagaaaatgaagataattctatagaataacagatcaaataggaaagagtaatgaaaagaaagactcctggaatgacaaagaagcatgttcatgacaatttaatagaatttcccacatgccatatttgtatagctggttatattttaaaactttgtcaaaccctatatttataaaaccttgattttgattttagtaaattctatgaataaatgcatacataaagcagattactttgattcgacaaaaacatacaggcacctgtgagctttttttttttttatgtggtagtggaaacagcctcattaattaatggctatttcctatattctttttaaaattaataagcaacagtcagatatttcagcatttttaaggcatgaacaataccttggattctaatatattttagtctaaaatatctggtaacatcacagataattgtttcaaactctaccacccctcacacaatttatttttcaacaatttaaagtcttttagaataatgagataaccttaaaaatagacaacattactcatactggtgagctaggattgcttaaagatgaggcatagattgcattgtctcagaggaaaatatttctcagagggaccaagagaaataaaggtgagaatcttctacaaaggcagataaaagggttatgagtttagcgttggtaaagggtgcctagtttgatctttgtaaaagttgtctatttctccatacaagtacacaacattgcacaatattgatggacaagagagggtagaattttgtcacacatagatagtttcactataaacataggcggtaacaccttttttggaactagtactcaaattagaaaaaaaaagcttccaggagacctagagaaaatggacacctgtcccttaaacacatactttctacttacttaggtctcatgttaacgaatgtcttcactcctaaataaggagtacatccagacccatcataggtaactttataactttctttttttttttttttttttttgagacagagtctcgctctgtcacccaagctacagtgcaatggcacgatcttggctcactgcaacctccccctcccaggttcaagcaattctccggcctcagcctcctgtatagctgggattacaggcacacaccaccacacccagctagtttttgtatttttagtagagacaggatttcgccatgttggccaggctagtcttgaactactgacctcaggtgattcgcccacctcagcctcccaaagtgctgggattacaggcgtgagccaccacgcctggccaactttataactttcattgtacattttctatttttatttattatttatttatttatttatttatatttttagagatagggtcttgctctgtctcccaggctggagtacactggcgtaatcatagctcactgcagccctgaactcctgggctcaagtgatcctcccacctcagctggaaccacaggtacttgccatcaggcccggctaatttgtttttaatttttgtttctttgtggagttggggtctcactctattacccaggccagatgttatgagttgtttaatatagatttggtgaatgatgaggataagaaaaagaaaataatggaaaaccacatttttccttcttatattatatatatatatatatatatatatatatatatatatatttgcttttatctaatgtgttgcaatggctgagaaaaacattttcagcaaagactagttcctagttaatgtgttagcatatgcatacatgtatgtgtatacacccgctcatacacactgccattcttaccatgtagcttcagggcatgagggcatattgtctcacttaggaaaacagttaacaatgacatattttgtttgtgaaaacatgcatttacttttgtgagtttccccacctaacccattcacagagttatagtcacagagagtactgaagagtggaataagttaaaggcactcagttgcagcgagcttcttctgcccccatcccccatgcttttgagaccacagttccatgctgaacagctctgaccattggagtcacacggcatgcctcactgagttcttggacttgcccgtcccatactccagagccacatattggtggtgttgaaatactaaacatggaaaatggcaccgcatgcaacttcaccacagccatcatcacagaaccaaagaggccttttctgcactttacaaaaacaaaccacaattcaccatagctcttttatcagtgccaataacacttttagtaacctcagtcctttcttttttaaaggatccaaaaacttaccaagtaatgcaacttgaaacaacccaagttccttttcagcttatatgacaggctaagtttcactcctgaaaaaggtgcccttagcaaaatccgtgtcccctctccccaaccaaagcatacaaacaaccaaacaaaaacaaacagaaaatgagcctggatgaagggttgatgtgggagccggacagatgcccacagatgttaataaaatcacatgtctggggtgatggctttgagatccaagttttcatcatccaatcaggtaccagcctcttaaaaccaaaatgatcaccgatattaacaggtggagctaagaaagtcctgttgtaagccaaaaatagcactctgttactttgacaaaccatgatttctttatataatatacattttaaataaaacaacccaaacaaaattctgggccatttatccacatttccagagagcagtgaaagcctagatcgtttcattagcactatactgaaattaacatttctctctttgaaatgtattcctcaactaatgaggacctaaatgttcattgtacttcatctcctttctaaattatggaggattactcttttcctgtctcaaataaattcaataaaacctcatgatatggtttggctttgtccccaccaaacctcatcttggattgtagctcccataatccccacgtgtcgtggagggatgtggtgggaagtaattgaatcatgggggcagtttgccccatgctattcttatgatagtgagtaagttctcacaagatctgttgattttataaggggtttcccccttcactcggttctcattcctctccttcctgccatcatgtgaagaaggaagtatttgcttccccttccaccatgattgtaagtttcctgaggcctctccagccatgctgaactgtgagtcatttaaacctctttcctttacaaattacccagtcttgggtatgtcttttttagcagcctgagaatggattaatacacctcatctcactatatatataataataagatatatagtgtatttttatatacatgatgcagaccttactataatatgtattaccatatatatattatatagtaggatacatatcttactatatatagttttttatatacgtattttagtattgttggggttaggtctgttctccttcaggtaccatttctgggaagatgagagtgccttgggaagatgtggtgtatggaggtgttccgcacacacctgggacacgtgaactgaacacgagatgtctaaagtttgaaatctcagcccgaggtagatgggctgttttccaccaccaaccttccactcccgtaatgattttatgaggcttttatttacttattttttgtttaatgtaaccacctgcagagggaaagccttttcatctatacatttattcaaagcctataaatggcacaatgacaaactgctaggagctatcaccttcttttttttcttgttcatgtgtgctactgtgctccaagaaaaatgaggaagggcttcctacactgccgttcacttaacaaagaacagtggagcctttcaaagtccaaatgtaggttgtttagagaaaaatgacagaactggaaaatattcgttgagtgaatggtagtagagagcacagcagatgacctaattgcctcagcagcctgggcttcaattttgattctcacttcctctaattgactgtgcaaaagatgtatctttgatttaaaactggtagctcaggagtttaagaaatcagtggtggctattcaaatctgtctgaatatccattcacataattaaataggagacgaagtctctcctctgaaaaagtacagtactcagacaaaaacacacacaaaaagagcaacagatttaaactaaactgaacatatttccccatttgggaatagaatacatattgttaaaaggcagaaagcagtacagaaagaatacattctggtttacaaactaaaatcgtgtctcttacacttgacattcacatcttaagaccaactctcaccttatttggaatataagtatattttaaccagataagcctatctttagaaggaggatactaaaggacttaaaatatttgtatattgctacttcatttgaatgcaatgcattcgctcaacaagttgcattattggcaatattcaacagtattacaaaaggtttgaaatgtggcgtaccaattaaaaagaaagaatgttaaacggaggtcattccctcgtgcacttgaatgtttagttttttgagaaccttttggttgtggtctagaaataaaagcacagtattccaaatggcttttaaagagacccctgcacttccaaaagcaagtctctgttgcggagtcagtcaacactctcatctttgtggagagactataagctttccacaaattactacacacaaaacaatgaaatagccaagttcacaaattttaaaaaatctatatatttaccattaggctacattccaggccaacaactatgaactttcaaattctttcaagtctgcttgtaaatttcacagcatcaagataacttcattatctaccttatgcagccaccagtcccttatcaagtatctgttacattctcaggtttgggtaaaaatcagctaggttactggtttgagggccaactgtatactcggcattagtttatttaaataaaacgcaaagaaaagtagcaattcttccactggagaagaaaacatcaaagcatctttaaaactgcatccacgcacaggcattattatgaaaatgcaattattattctgatttcaaaaaaaaatgaagccttccattttaatctactgacttaaaactgatgaagtaattttccacttgctacaactggccctgattatgttcttacatgtcaaagaaaatactctttaaaatggccatatatatatatatatatatatatatatatatatacacacacacacacatatatgtagaaatgtagaatgcgtgtgtgtatgtctgtatacacacatacacacacacgcattctacatttcattgagtaataaaatactgaatttctaatctgagaaaatacatgcttgcagagttctccatgaaattcctgtattcttaattttaggatacacagaaattccatatttttttctggaaatacagggattaatgcaaccatgtgccattagccatccctcccccacttaacattttgctcatttccacaggaaaatctatgctgaggatttaatggattactgctaacatcttccccacagccaactaaaggtatgaaataattctccactctccaaatctgcccccacaaaacggcagatttctttgctatctgatttcaccccgctctgccatcccctaggaaaaggctcagtgcgtccattcaaaccatgcaggtctcttgcagtttctgccgctttgttctcatcaaagtcaggtgtttgcaccctggccatttaatttctagctggagaaggaagctaccccggatttcttaagcatgcacttctatgttgcccgcagaacgcccacacaaactggcaattctgcttcgtcaggataacgaggtctccctaaactttttcttttccttttttttctttctttttttcttttttttttttttttttttttttttttttttgcttttgccttcctcacatcaccggaagggctgattctgagatgggagctcacgcacaccaccccctttcaagaaaatataatgcaacgcgctccgatgtaaaccctacgggcaacggatgccttcaaaaagcataagataagagcaacaacaacaacaacaaaccaccgccccccccaaaaaaaatgaccaaatagaaataaaataaaataaaaataaaaagaagccatactaccaccttgtggatccagctcgcaagaacatcacctgcttagttccaaaacccccacccaacccccaccccaaatttcttaagttgggtccaaatgacagatcgggatcctctgtcctcactccccgcagactcgcccaagccctaggctgaattcgtgacgcgcgcgcccagcacccgggcgagttgcaagccccggcgcaccgcaggggccaaaaccccgccggaacctcctaggaccccttcacgctgcctcctgcaccccctcccccgccatccccgagatagcagcagcacatacacaaaaagaggctgacacctgccgtaggttcagaggaagaaggcagagaaaaagaaacccgcagtccggaaaaaaaaaaagccttctggggaaggggaggggtatgatgcggaggacgtcctccggctgcccctcgctctccatgcagaacatccgttcccagggtggcccgggccaggcctcgggggtgcaagggttggcctgacccccctgctcccgcccccgccgctccgggaagaaagggcgctgtgtctggcggcgagcaggcgccggaatcgtgcgctcgggcccagggttgcacggagcactgggcccggataccgggggcgcaaagcttcgggtgcggcccaggagaaccccgccgagggaccccagcctaccggttctcggaggggcgaaagagccaggtcaggttgagggacaggaggaggaaggggtgtccaggagactgactgaaggatgagagtgtcctccggggtagcgaccggcctcttggaaaaccagaggcggagggagcagccgcggagtggagggcgcaggccgggacctgggcctctcctcccacagcaagccccccacccacgcatcatctgcagccgagcggcacctacctccctctccctacctcatccccgctcgcgcttccgcaggtcaggccacgcgggtgccagcgcgggctgtgggcgccccagccgcggccttggggaggggtcaggactgaagttcactctctctctgcgtggtctcgaagcccctcgcccaccccgcactgtctcctccgccgccggctgcgcgcttggcggatcttctccatcagttctgcccactggagtgggaaggggctgagccgagccgcgcgggaattgggaggcggggaagcggggaggcgggggaagagacgagatgaaatcggcccgggacagcagagaggcttgggatgggatggaagggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcccccccgcgcccccctcaaaggttcagactacactcaaaggctccgaaagaagcaaaaccaccagctctaccctccttctgcggcttgcctcacccttcccacccgcctcgaaacccacacacacgggaaaggggtgcatggagcccgctccccggtttacagaagcagcccggagctaccgtcatttcatcttcacgcggggtctccagcgcgcctggatcgttccctagccaagccaagccaggtctaatcaatcacgtgcgttatttcgtgcatcacccaagccgtcatcttatccgaggcccggagatgaaggagggaaaaaaaatcgcttaaatgcgaccccaaccaagccggttttccctttttctttctggttaacagcacccccccaacccctcaaaaaagcaccccaggcggtggtagctgacagttttcttaaagaataaggggggggggtggggggggagagaaaaagaaaagaaaagcctcccatgcctcacagtttgcagaagtcttcctgccttcaccatctccagccctggccgcttctctccttcttctccctgtactgcagatacatatatatttttttcctcctctccccgccacagtcttctgtttatttgtgtggaaggcagcgctactttgtaaacacatcacacacggccccagagccgttcaaatagctgattgcagcaaaacgcttccaaacaacggtggtctggatttttctctttaagtgaaaataaaaccaaatatttctgtggagaggttgcatgtaaaaaccgtatgaaggtctacactcccacccacacctaagaaatgcagcgagacagatgggagaaagtcctgtccaaattttccaaaaataatattaataatcataaaaggaaaaaataaagatcagatgaagtgaagctcaagtatctgcagtgaggctttccatcctttgctgcaagtcaaaatgtttaaacggctttttaaaatgagaataatgtcccagagacaggtcttaaaactgcacctaccttagctttggaagagctgcatcggccgttaagagttctttttacacgtccagatttttctagggaacccgaaacgaggtatgattcaggaggatgtattgaaagcccaggagccttccccttct

SEQ ID NO: 1351 - DNA, 37714 bp, Homo sapiens
cacaatcaaaaagagatgattattactttattaagttagcacagattggacttttacaaattgtagaaatggtcaacaaatagaattgtcctattaggggctgatattcagaaaatatataatcaactgttggtgtgataacaggataaaattccaccctgtatatgagtaattccatttttatccatccatttacaataattacttctcacttttgtttacttagtcatatacagagtgatataagtgatcgtcaaaaaggatccattttcaatgatttctacaccatattatatgtattctccactggaaaatttatttttccttaggtctttgaagtgtgaaaatatatacatatgcctgatcttatttctaaaaatgcttaaatcaataactacaaataccacatgaccacatttatacactatactgtcagaaaaatattttagaatattttgagtcgtgaatagcttatgatttcagtggtgttggtgggtataattgattgcttttcactttcaagcacattcaaaatttattacaaaagaagaatggtgaaacaaaatatatgatctgctcttggtatttcaggatgctcagcagtcacacagaaacaaatgtttaatttcttgaggaagcagaacaacagcccttcagagaggggtgagcctctcatcctctgtcatgaaggcatcattaatatgccctcccttcatgtccaggggatcagaggggatgccattttcaattgtgatcatgttttcacacttatcttcagcgtcatccacttcagatggttctttgttctttctaaaagcacataaaaaagagtgattggcatctagaaggaccataaccatggttgcatatggtcttctgaacgaacatggagaacaggaaggggaataggaaccttagaacaatgaaataatttaatgatattgtgtaattttcaaacgaatttcaaagaccataaagagttggtgaggtgaaaagatactatcaagatgagaagtctgtatagatgacatatacatagtgatcaacacaagtggtcttattcagaatactaaaatcaatatagatgaatatgtatatgaatatgagtgtatatgcacatatatacacatagacactcacacacacaaattgcatgaagtaatgtgaagaaaatgcatagtaaattcgcaagtttaaaatccatctctaggagaacttaataacaattgaattgctaaaagtaataaattcctctcatgggatttgacaaattaatggtctgaaaatgttgagtgaaaatcaaatagaaatgagctatcagaaagaaaattaacattactttgtagaaagtaagtgctataaacttcaaatattgctgcttggctctactcattacaaaataattgtgttaatttgcaagtcacgattttggaactcagaatacattttccctaattactttacaacttgtagttataattccaggtcactccaaaaattccatatgacaggataaattcttgagtttctcatagtttcaccctttgtagaccttgctgaccccaaccgaagtaatatgcagatctgtaatatttctttggagtgtggaaaacagtagactcaaattcaaaggtttttcctgtcttttgtgaaagactaaaacaatgagacaattatgcttgatatcatgcagtaaaagaaaaaagagaggtgggtgcctctaggcaaccagaagaaggaggggtttccctaaggcttatcacaggttggatgttggagcaccactccatggtgacaccacggaggcatgatgttaggcatgaggctcctggacttgcaaaggattctcttgtcccacgaatttgtggaaatgccaaatagcagaaaagaatagatcatctggctgagatgttgggcactgcagtggtgaccaggtagagtcccaccactatgagagtcccttagaaccttggtgagtctctgacaggtgaggagatggtgaaggtgccccaatgatgaccgagatggaattcctattagtcctgcgtgagaatgtgctttaaaggatatggtgcacatgtaccctagaacttaaagtataataaaaaaaaattttttttaaatcatctttcccacccacatgattttcctgactccattcctgtcctctgtatcattttcccctatcagttttattgaggtataattgacaaataaaaattgtatatatttcaaaaaaagaatatggtggaagaaagtgaagaaaagagaaagctctttttttatagaagaatgccaacgaatatagaaagagtaataggaacagaaaatcaccatataataataattgattctgatgaggattatcaatggatactaaaccattatgtgagagacggttggagaacaggatattcacatggtttcaagatatcacccccataagcaaaatattaattataaaaggacacttgtattttgctaaaagagaaatctagtgaaaatttccaacaatgaaagaaactgacaagtctctcctgatgtgatacactgagtagatcacatatatgtttttcctgtgttccagccccgccccctccaatttgttttgacctgaatctcataataaggagcctaatcagaaaaatccaaatttaaaaatgttttgcaaaacagctgacctggactcagcacagagtaggcattcaactgtatgggtagatgaatcaatgaatgtagattaatggctgactggctggataataaatacatggatggacagaagatgggtgggtggctgaacaaatgatgaaaggtggatggacagatggataaaataatcaatgaatgtagttcaattgctggttggctagatgatatattaatggctggctggctgaatggatggatggatggatggatagatggacagaagatagatggtagattgaacaattagatgtatgtatgtatggactaatgttgtaggtaaagttactcaggcagtagccctaggtagaccttgaacgggctttaccacaagaaagaaggaaggaaggaaggaaggaaggaaggaaggaaggaaggaaggaaggaagggaattttacacacaagaaatttcttgtatctcttgtattttaggctttgctgatggtttattaaataatttcaaatagttgttcatttaaaacaaaggtaaagtagcattccaattctgtagatcccaatgtcatcatttgaaagtattttaccattgcatatgccaccatcaaatatcacaattaaacacaataggcaatcactgaattgcagatgccacattttaaacatttattaataaaacttctggcccaatgctgggttgaaagtcaggagttgtggtcctagagacctagggaaagataggctgctatatttttccatccttggagtgaagacaccacactggtcatggcaagcatcagcaatcagcaatcagcatgggttggggtggacatagattttaatgtgatgagaggatccttccaggtgaaattacccaccagaggattagaacactttggttcctcttcctatagataggtgtattgttcactttccacgtcctccagaaagcaaaggaaatcaacattctataaccatcaatcacatcacttccattcatagtatccaacattcactaacagctacattttgagcgtctactatgtgtatggaagagatacagtccttgtcctaaaatgaactcaatgaaagggaaaaatgccatatatactcatcctccctctccccattttaatgctttataagagagaggaatgtttcttctaaagatgaagctgtaagtagcaaatgtctatttataaatcatcatttaaaatggctatctcatgtaaattcccccaaaatcactcctcactgggcttggagtgaatgataattttccacaacaataaatagattgtggacagccaaattttaccctgatatttgtatatgttaagtatgaaacctgtattacaaacattttagtaaaggaagcattctgaagtaggtggcaatgcaatagcagtcttagaaataataattgccagggcctattttccagtttcttcagttaataaaaaaagtatttatggagttagaagaaaaataacaaagagctagacgtatgtgatgatcattacaaggaatctcgcttcccccttcccagcaacaaggaaaaatgattcatcaggcatcacgaaagaatggggaaaaactaaaaaggaagatgtaaacaaatgaggacaagtttttcttctttagaataagaataatatctcaaccaaaaagattccaaggggaattgctgtagaaatttatcaaactgagctgtgtcagtggcaaattaggtgcatattgttcttttacaaccatagatccagttgcagagtcctggcattgctgggcttcaccaattgcagtgtcaggaacttgctgcttggtggacatgataagcagctcaaaggctatctaacagtaatatatcactttgtcacatttcatagtgtttgctgtaataaattgattcactacctgtgcattgcttttactaagaataataaaacttaactatctttctggatcattctgatttgatgttctgctaaaaacatgagttctttttcctgaaaactaaaatcaagtgttaattacttctgctattcctgcaatgtcagggggttcaggaagaggatgaaaaaactgattaaaattcctggaacgagctcctagaagccttgagagtgaatatctctcatatacctcataaatatagagagaagaggggcaaaagaggggaggaaagaagtatcaggtgtggccctcagagctaggggatgttgaggaacggggtttgctctgttctaagataaagtaatggtgccaaaagcaggaagagcatttctgtcccccttcaaacaaaatagagctgactgccgggcgtggtggctcacgcctgtaatcccagcactttggaaggctgagacgggcggatcacctgaggtcaggagttcgaggccaggctggccaatatggtgaaaccccatctctactaaaaatataaaaattagccgggcgtggtggcgcatgcctgtagtcccagctactcgggaggctgaggcaacagaattgcttgaacccgggaggtggaggttgcagtgagcagagttcgcaccaatgcactccagccttggcaacggagtgagactccgtctcaaaataaataaataaataaatagagctaaagaggctgggtgtggtggctcgcgcctgtaatcccagcactttgggaggctgaggtgggcagatcacaaggtcaggagatcaagaccaccctggctgacatgatgaaactattaaaaatacaaaaaaattagccgggtgtggtggcgggcgcctgtagtcccagctactcgggaggccgaggcaggagaatggtgtgaacccgggaggcggagcttgcagtgagccaagatcttgccactgcactccagcctgggtgacagagcaagactctgtctcaaaaaaaaaaaaaaaaaaaaaaatagagctaaagagccaagacccaagaatagccagaaagacaataaaagacagacaaatatgattttcaaacagtacagaatcaattatcggggaattgagaccatcctcagaattgctctggatgattctgggggtaaatagggttactggaatgatttgagtgggcactgtagcacagtgagattgatggactttgaaatcaaacctacctggttttaaatcctgttactattactttctaaccatgtgactgtaggcaagttgctttacatgtgccatataatagcaatgataatgctaatgataatattaagtatttattacatggtagaaatcagactagatgttttgtatgcatcatctcacttaattcttactgcaatattatgcatattttattatcactgtttttcaaatccatcgttttaaccactcagccacgactacgtgcctcatctctgtttttcagatgaaggaattgacactcaaatacgtagagtaacttgtctttcagaatgaaacaagactggtgaaaggagttgacctagaactctatttactctccccaggctttactcaacacacttacattagatttttatcaggtatgtatatttaagaacagcaaagaaaaacatttgttatattcgctatgacattactcattttatttacacctctatttttaagactattcatttaattaagactttataagaatgtggtttcaggatataaaagtgttgactgagccacatccgcttgtgtgaaaaacaagatctgtggaaatccaaatgcatttttatttactattgaccttatgggaatataagtataactagaaacaaaccaagcaaatttactaatgactctactcagctgggagcattagctagggttctatgtcctaagtctttgacctggctttgttactataagattacaatctccttttaggcaaggaccatccatgttatttatgtttgtctcatccacaatacatactatagctcctatcacagaatggatggtcaataaaacaataaaatattcttacttatctgggctttggtttctggagggttggatttggatcattgttaaggtcccttcctaagacccagttgtgatcttagatacaactaaggtctaacattataacagtctatttatatactggattcaacatcaattctagtatatacatgtaaatctgaaattgtgctgtgtccatgactgtccttgtaaactacaaagttccaggttatataaaattagcactttataactgctttttatggtcatgctagtaacttaaattgatatagcactttctagcatgtaaaccactagatatattctctgattttgtcttctcatcattacactatttaagaaaatattatcatcattttccttatgtgacctgctcaaggacacagctaacaaatgccagagcctgagactggaacccaaaacaaagagtcttagtttagggctctttctattaaaacacacatcacattatcaacttcatcaccatcaccatcaccatcatcaccatcaccatcactatcaccatcatcattatcactaccatcataaaattgaccatacaactaacacacctacttctagcctgtggctagacactaaatctagtagagacattattgtgaagtatatgcagttcatcctggttgccttcccacttgttctgctccctaattgttgccccaaattttcaaaatcattctcagtaaactatcgcaagaacaaaaaatcaaacaccgcatattctcactcataggtgggaactgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaattataataataataaaaaataaataaataaataaataaataaaagaaaaaaaatcgcttttccaacttctttccttcaacaaatctctcattttcacaaactgctattctcatctagagggcaatagagaagcaacctcttctaggtatttcacaaagaggtggcagctgtaatggtgtgctagatctggctggtacaggttttcaagggctgattgctaaatattcagaatttttcagccttgatgggaaattggcaaatgctacaaattagggtatttattcagaatttttcagccttgatgggaaactggcaaatgctacaaatcagggtatttattcagaatttttcagccttgatgggaaactggcaaatgctacaaatcagggtattttttagagagctggttaaccaattcaccactattgtggtgaccagtagacctcatagaattatttgcatttttaaaaagtgtttattcagcatggtagtggcatcaaaacagacacatagacaaatggaacagaatagcaaggacagaaataaatccatgcacttatggtcaacagatcttcaacaaagatggcaagaacacacaatgaggaaagaacaatctcttcaataaaaggtgttaggaaaactggatatctcgatgcaaaagaatgaaactggattgttgtctcacaccaaatacaaaaatcaactcaaaatagattaaagacttaaacctaagacctgaaactataaaactactagaagaaaacataggagaaaagctccatgacattggtctgggcaatgaccccaaaagcacaaaaacaaattcaaaaatagacaaatgggatttacatcaaaatgaaacgtttctgcacagcaaaggagttaatatccaaaaatatataagaaactcaaacaactcaataacaagaaaacaaataacccaattttaaaatggggaaaggatgtcaatagaaaattttcaaaagaagacatacaaatgcccaacgggtacatgaaagaatgctcaacttcactaatcatcagggaaatgcaaatcaaaaccacaatgagataccacctcacgcctattagaatacctattatcaaaaagacgaaacatagcaagtgttggtgaggatgtggagaaaagggaaccctggtacactactgcaggaaatgtaaattagtacagccattatggaaaacagtatggaagttcctcaaaaaataaaaaataaacttccatatgatccagcaatcccactctgggtatatacccaaaagaattgaaaccattatgtcaaagagatttctgcacttttatgttcaacccagcactactcacaacagccaaggtatggaatcaacctaagtgtccatcaatgaatgaatggataaagaaaatgtggtacaatgaaatactattcagcctttaaaaagaaggaaatcctgacatttgtgacaataaggatcaacctgaagaacagtatgctaaatgaaataagccaggcacagaaagacaaatgccacataaataagttgaatttatatgttaattatttgatttagccatttcataatatatacatatatcaaaacatcaccttatatgccataaatatatacaacttttatttgttaacaacaccttaataaaataaaacaagcatttaataaaatcccaagcaatgagttggtgaattggagaagtttctacagtatgatggaaaataccaagatattttccacaatatcttggtggaaaagagatcctttcccagcacctcttaatcatagcaatggcttaagccgatcttggataatcataattactgtttatttagtgcacactatatcctaggtactttatacacatttatgtcagtcaatcctcatgaaagccctgtgaaacatcatctccctgttgcagatggagaaactgagatccctggaaatcaggtgactcaactaagattatacaggtaaagggcacagctggtatttgagtttacctagtttgggctccattggttgcatacttgccactcactgtccctgaataattaatataatggtgttattggcaaagataacagaattgttaaagctttgctgagaaatttcctcaatagtaagtttaaatatatatatgtgtgttagatgactctggcactcttctccatagaagcagaatggtgacttagataatcccatggtccctccaggtcttctaagtttaagattctgtaccacaaaaactatgttcattattatctaatgtatggattagattgttgaacattcctttgactgtcttcctcgaaactaaaggttttgggggcaactcctatcttttccatgattagaaagggctttcattgcaattttcagggctctccccacttcaaactgcaccctctcctcacatttgacgcaacattttgtccaggagaaacccatcacaaattgtgtcaaacttaaaacacaacaaacaatttatcttcagaaggttgtcataattttcctgactatatttgctaattattgatgctctcccggtttacacaagagatgtgtccatctgctttcccagtttgaacatgaaataaatttgtaaaggcaaggtggtgacaacagcttcacttctcccaggcaacaaattatgatgctacacacccaattattatattactgcagaatctgctcagaaggaaagagatagctgatcccaatacaaactagctgaaaggccagcaaatggcaagatcataaaataatagtaacagctaacacttattgagcactcactgtgtgccagataccactctaagcactctatgtattaactctttttatcccaccaagttaattatttccagtacacctcactgtcactctagaaaagttatctattcacaaacagtaaagataaacttaaccagcttgagtctagcaccacaaattatattctcctaagctcagtttccctgactcactgtgcttcctgatatccatacagttaatggattatatacaagggcagaatctaagagataaatatgttgagtctaagcaatctatctccagagtccattcttctaactcctacactatactgtactagtgaggaaattagaaaccaagtagatggagtgaattcactaatgttacagttgttagaacacagaatcaaagcatctcaagattaatacaaaacaaaagtattaaacacaggtattcaagcattgcatgagaatatttctcaatattttcaaaagaaaaaccaaaatgcacatcttgtaccaagtctctttgcattacatgccatgccaagatcatcaaaaaaatcaggtaagtgtaacttgatcctaaatctttgaatttaatttgaggactagacataaaccatatttatttcatagcattttacttatcatttgtgaataaaattacaaagcccaagatttaaaattattaccttctgttagttactagggtgaaacatatggaaagtagtaaacttcaagaggagcatttagtcaacacatacttacttagccaaacacatcccacatgtcccatgtaagaaccaacacttttaaaaaccatgtccctgttattttcaaatgcatgtcactgtaattaccacttaccagaattattcttccttagtatcagaaaggaaggtttacaagcattaaagtctagtgaaaagctgaggatttttccatcttcccccctgcattagaggtactggttaacaaaatcatgctgagaaatcctgtctcctcttcttctccactacctcagtaacttccccacaggtcttaaattccctcttgaagcagtatcaataacttagacatcgaagtttgcaaatgcctccagaatctaggtaaacgaactcaagaagtgaaactctacctataaattgttaaattgaaagctctcaaactcaatgaataaggatgacctgagtattcattaaaatgcatcccttcagagattctaatttagtgggtctgcaatagggccaaagaacctacatgttaaacaagtgttccaggtgatgtctgatgctgagagttgatttaaaggccacaagcaacacagctctattcaatatcataggcacacaagggatgagtgtccatcaaagggaaggaagtataaaacagtacaaaggcatctgggacaagatggtagcctgcatgcactggactaagaagaggtaagccaaagtagggaggcatgcaactatgaacctgctggcatttggatgtggatgactaccaaagattaactctgcctacccaaaaagtctgtttagctccttacatctagcttacaaaatcacaacacagatattaaaatcaagcctggatatgaaacatttatgtggtacagaatagagggaaaggtagtcgtggaaggagcctagttaagtaagggacgctggactctaaaatatatctaaagaaaagagcataagtgatatttttgaaaatcaccaattttttcaaagtttcaaatttaaggcattatcttcagccagaggaaaatcctctcctgatttgtccaagtcatgaggaaataagaaaatgctctttcaatcactccttttaaatatcttaccttctacgttgccagatccctgataaaatcagtagtgcaattgcaactatgatgatgcaaaatatcacaccaaatataataatccagatgggcacagatgggtccatgggtggtgcaagtgtggaagggatttttaaaaattccagagtttggtcatttagaaagaaggcattgttgatccggttcttgttcattctaaaatgcaatgataattaaaaataaacaaaataagacagaaaaaaaactattaagacaaagtacaaacctgtttctccatgattataaatatctctataaacaaagcatcctcctggcaggagacttcaagttgactaaaaagtttgctgagggcaatcatgccatagtttctcttaagttacaacactagctgccagagggatacccatgtatccactgctgcccccattgttgtgaatgtccagaagtcctgagctttgagctctgtccaccatgttttatttcctgagaggtagtaaggtagacggagggactcgtctctggaggcagggctctaaccctggaccaaactgaggactaactaaaacagagctagggggtggcggggaagcagctttccatcagacatgcccaccagtgtgccatgtcagtttaccattgccatggcaacacctgggagttaccacccctttccatagcaatgatgtgatgaccccaaagttattacccttccctagaaatttctgcataaactgctccttaatctacatgtaattaaaagtgggtataaatatgactgcaaaactgccctgagctgctagtctctgcctacagggtagtcctgctctgcaggagcagtcacagagcagtaacatcacaggagctataatactgcctcttcagtaaagttgttttcttctacttctggctctctcttgaatttttttcctgggcaaagcccagaatcctcatgggctaagcctcaatttgggtttcacctgtcctgtgtgagtagcatctagattagaatgacaaagctctatttaaggtggcttacataaatatcacagcccccaaaagtaaaattacatgtaaaatatgggtgatgaataggagaagtaaagaaaaccagaagcaaaaatgaaaacatgaaccaggagtggcttcaaattcaccaacttgatcttgatatttttttcattaattcaacaaacatttgccaaaaacttattaaatatcaaatactgtgctagatgctggagatacaacgtgaaattaaagtaccaaggagcttacggtctagaagggtgacagatcagtagatccacaaccacagtgtggtacaaaatgttctgtgaaagaggcaaatatgggcacagtgtgagcagagggaagggccaagtacaccattgtgagaagtcagagctgctttgctgtggaggccatttttgagctctgttttgagggacaagtaggagtttttagaccaaagtatgtggtgagcacaggaatggaaacaaggtaaagtaagacttgttcagcaaattgcaagtagttccataggactaaagacattaatgatttaggagttcaaaagcttagaaaaatgttacttttcctaggaaatatctgcatttttagtggtggtggcagttaaggagaggttggtagcaaagacttatttaattgaaaccaaataagtgaatttctaactgtaaactggagagtccttggagatattttatgacctttactgaattcatattatgcaagctgcctttgtctacctctagagcagccctggaaaacagaaatataatgtgagcttcgtgtgacttaaaattttctagtagctgcactaaaataaacagatgaaactaattttaataatgtattttttgtccaatatatccaagaaaatgtaatttcaacatgtaaacagtatcaagttgactttgcatgtttgtttgtttgtttgttttttgagacaggaacgatcatggttcattgcagcctcaaactcctgggctcaagcaatcctcctgcatcaacctcccaagtagctaggaccacaggtgtgtgccaccacacctggctgtgtgtgtgtgtgtgtgtgtgtgtgtgtgtgtgtgtgtgtaaacagggtcttgctatattgcccaggctggggctccacattttattttgtacaatgtctttgaaatttggcttatgttttacactgtgagcacacctgactttgaactagccacatttcaggtgcttaataaccacatttggctggtggctacggtaccggacagtccaagtctacagcctgatagtatggcttgagaatctctgcaggccagcaccaggctatcaggaaagaccccctttagtaaataaataactatgctgtggcatgattattcatggatgtgaaagtgaactctagccagataatctacaacaagggatttttatccaacaatggaatattttattttgtcataacctaatattgaacatctgagagcacaaacttttccacaaaataatgaaacccactgctaagatataactcagagaaaaatgagaagttgctctgcattctcattctatcttcctagttggttaaccctttgttacttgctcactctaggcttggaatgtattctatcatctcacagactgactggaagttctagctcaggtacatattaaatctgctccaccactggaatcaccaattggcatcaagcatcatgtatgtctttcagccaagagtggtattgaattaggccacgccctcacaaaagaactaaaacagacatcttggaattagttggtcactcctttacctcatactatgtatactctgtattggtaaaaagtccagtactcttttttgcccatttcaattattttacttgaaatgagaattttgtaattctcattctgttggctatccccacttcctaaatagtttatcctgctaggacctttgaaatagacattttgtgaacaaattcacgtgcttcctggaccttcaccctaagcactttgtgtaaaggaatgaccaaccaattctaagatgtctgtttcagttctttgtgtactctggtaaacaggaaaaatcactggatatggtggcaggatgcctaggttcaagtcctcactttctctttctagcatggtggccttaacaaatcaattaatctccctgagcctcagtttcttcatttataaaggagagataatagtaattactgaaaaattattggtgttggctgggtgcaatggctcatgcctgtaatcccagcactttgggagtctgaggcaggaggatcgcctgaggccagttcaagggcagcctgggcaacatagtaagaccctgtctctacaaaaaaaaaaaaaaatttaaattagccaggcatagtggcacatccctgtagtcccagctactcaggaggctgagacaagaggatcacttgaaccccaggagttcaaggctgcaatgagctattatcatgctactgtactatagcctgggcaacaaagccagactctgcctcttaaaaagaaaacaaaaaaaaactgttggtgtcattattaaatgccacagatgcataagaacattccttgtgaaccaaaaagtggtatgcaaatattaggtggaactagtattattttgcccaatcacttagattcttcagccttgaaattcctattatttgctctctaaacaccatctcctttttttcactctatccttcctttgttgtatagtttcctttattttcatccaatcctgatgtgccctactaattccctgacataaattctcattctattggctatccccacttcctaaatagattctcctgctaggacccttgaaaaagacattttgttgtgaacatattcatgtattaatacttcccagaccttcaccctaagcactcactcttcctcctcctatcaactgaaggactggtttaacccagtgccttcattttccctgtagccctcacagatcacaagacatgaataaaatcttttttcacatgaaatatgatatttataattcttactccctaagtggtgagagtcttaacagtattcttagtggccacagtgaagaagcaatttagttcaaactttcttgttagggcagattcaaccatttccaatcagtataaatcctcagtgcctttgcttcagcaaaagaaatagatgatgttcacaaaaacctttgacatttgattatatactcattatcttaagtgttaacattttacagagagctaatgagttattccagtaggtatttatccttggtaaaaagaataatatgtatttcagtaacttgtaaatcttgtgtggggagagctactttgctttgttctagtttatttcctgagctcattttttgagtatatctttgcccaacatcaatcacatgtggtatttgaagttttgacacataccaaaggcacagtaattgaaagaaatacaagttgcatcctcctaattcttgaaagtctcgaattcgtttcacttttgagtttcttacgatcataaggaggggaggagtacaactgtcgggaagtcgggaaaaattgtaaaatacttgaaatgggcaaaacagagtactggactttttcctgattgtcctgctgagagcacctttctaggcaatttccatctcttacggtctttgagctactttgcaaatccctaagttcttgaaaactaacataatgtaaatgattcttgtccatagaaaatcaaatgaactgtgtctagtggaacataattggttactgcccgaaaaatagactgatgcatccttctgtaaatgcattttgccattcctcactttctatatatgggtggttccttgaagtctccttgaaaaagaatttaacatcttactagtgccctcattaactaatgagataaaatttttgatagtaataatgattagtttgcatgagagtcatgattttacctttttttaaaaaaaattatctttttaaagtaaagactatatattgactgaaaaaggtaagctattgggtccctaacttctgcttactcaatgctggtggtaccaccaccccctccagctgtgacaataaaaatgtctccagacattgcgaaatgtctccagatattgccaaatgtctccttgaaggtaaaattgcccctggatgagaactactgatctatactcatctctaacagaaactaacaaaatgaaatctttgtcattttaataaataattcatgtatgaaacagataaaactcttcaatatctatttttaaaaacagttgaattaatcagcaagttgattgactaatagaaggcatatttaagggtgattaccttatggctgattgcacctcaacagcaggaagggtgtgattttttgaagggtctgtaaccacaaaccagaatgataccctctgggttacattgcaaagtaggacatgggaaattctgcagacagtggaaagaaaaaatacatgagaagaatatcataccaaatggcattaaaccgttcactctgatgctactactatcttaagagacatcttagctatgtttaaaaagtcatttctaccattatgaagaatgagctcagtaagaagaaaattatataggaaattcccattgtttcaaaatcatatacttggggatcattccttatagggaataacagggaatctgccaaaaaataataatagtcagtggagagcattagggatctcattctccatcaccggttggtgacagcccccgtttccccaatgcttggccctctctgaaccacagaaacctttggtattttctcattcaactctttttagtgccctgcccattcagtcttccacctctcagatccagagaggatctgctgccccctcatgattcaatacttgctctgtctgcatctactgtctctcttccaccccagcatcagggccaagacaaaaggcaccttctgtgtgtacttttgaagaaaaagttctcaaaaacaagtttcttttacatcgccttgaacaaacctccaacttaaacactataatcaattcaccagcagtctttgaactctttgttttgcagttacagacttttcaactgcaaattggaaatgtgactcactctcctctgtattacaagtgaaaggggagaaatgaaaatagtgttcagagagagacaatctatacatggatgtactcaggatggaaattataggaaagtccacataaaatcaacattgccaatgctaaaacaaaacctgatggctttcccagtttacttaagagcaaaattgcaaaaagcaacattaacatccatcctagaagaatctgatatgagtaaaggatttgtttagagcatccaagtgtattgtgatcattttcacactgatcaaagagagcacccttctgtcaacaggtatctgcagttttcaggacctggcagaaattcttctatgttctgtttttaaaggtcaggtacaaaagtagaggcagctgccaggcccctctgcccagagctgagtgtctgggaccatgagtgggaaggactgaggcttgagcctccttggtccgccagacagcatggggcgccacttgccccttctgcagctgcgcgccgcaaagctctggcctggccgtggcctcctgccccatgcaacacttggtggccagaccgtacccggcacatggcgcctcgtgcactttctgacattttgataccaaaggtcgctggtcactgagcccggacactatctctggccctgaccgcagatttcggaaacttctggcagcccagtgtctactggaaggcccaacccactgccctgctctcatgggcagctacctgagcggcttcctgggctggctctgggccagaaaaccgcgcacccacccccccgcccgacccccgcgccagaagcactgggccctactgtccaggcccttcctcagctcccaggtccaggagaactgcaaggtcacctacttccacgggaagcgctgggtctgcatccagcccctccccaccgctcctcccagctgggactacgcccgcatccgcatccggagagagatggtgcccgcccgcatccgcgtcctgagagagatggttcccgaggcctggaggtgctttcccaacaggctgccgctgctgagcaacatcaggcctgatttctctgaggctcgcctggcctacatgaagcggtggctttggaccgccgccacccccccaccagcctgtccgcagcctggtaaccatgaaaatcgccccgcccgagcgcagagggagcccgatgcccaggccatctgccttcgggtctgtgatgagaaacggagtggcccattcctttctgcccgggtctaggccgctgagcagagcccctactcccgggcagcgttgtctcaatccttcctggcggccgcctgccctgctgaggatatgtggccgccaggcgcccggtcgccgcaggagcgctaggcctgcgggtagcactgccctgacgcctcaggcttgcctgcacctggaaggagcttcgccaggtgggccatgagcctctgagcacacccagcctgctgcccggctccaagagtcaggcccctgccaccacctcctgagcctccagccctcagcaccttcaccctactgaccgcggttctacccccacaccagccaccggccccaccggggcacttcccactgctccagccgaccactcagcgagccccaggcccacctctcctctcccttaaagcccttcccttgcccttgcccattcgctcctgccttctccctggggacaggaggcatgcttctccccagtttccgcaataaaatatttgttgttaataataataggtgtctttattatcatagagattgtcatattctttctttcaaagacgacaccatggtttctccagcttggcactactacttgggccagatggttctttcttggtgggggggggaggggggaggggaagggggagggaggagcgggaagctgtcttgtgcattgcagggccttagcaacatccctggcctctcacttctaggtgccagcagcacactcacagtcctatcaaaaatggctccaggcgttgccaaatactccctgggagggtagagaggtcaaaagtcatactggtggagaaccactgaggaacagtgacctctactggcagaaacaggcaagcctagtcccccaaaatgtgcggttttctaatacatatcaaagacgtagggacaaaccaaatgaagtggcgcatgctggacagaaaacattttcaccagttttctagaatgcttggggtgtgaatgattcctgtggtctggtcttactagcaatcaggaaatgcaaaattgttacaaatgagctactattttaaacgtttcaaattggcaacaatttaaaagttaaataataccaagggctggtaaagacgcatggaattggaatcccaggtgacgctgtggaagcaaggagtccagccactctggaatggcatttggaagtgattcccagaacagaaaacgcagctaccagaaaccctgtggcacacatacacagacactggtgaggatgttctttgcggcactcgtcaccatagcagagaattggaacaacccaaatgtcaatcagtacgggactaaagtaaatatagtatatgctgtcgagggaatactgttccacagattaaaggaaagaaatagcccagggtttctcaacatcagtacgatcaggccagataattttatgttgtgaggataccatgtgctttccaggttgtttagcagcaaatctgagctctatctaccaggtatcaggactacctccagttgtgacaatcaaaaatggctacaggtgttcccaaatatcccctgaaggacaaaatcacccccctggtggcaaccattgagctagagctatataattttttaaataaaagaataaatcttggcctggcacggtagctcacgcctgtaatcccagcactttgggaggctgaggggggcagatcacgaggtcaggagtttgagaccagtctggccagcatggtgaaaccccatctctacgaaaaatacaaaaattagctaggcatggtgacgcacacgtgtaatcccagctactcaggaggctgaggcaggagaatcgcttgaacccgggaggtggaggttgcagtgagctgagatcgcgccactgcactgcagcctgggcaacaaacaagactccgtctcaaaaaaaaaaagaataaatctcaaaaatacaccatcaagtgaaaaagataagaggtaaaatattatgcgtagtacataacatttatataaattaaacaaataccaaatagaatttcaggcataaaaggccagaaatcatgtaaagagtcatttagttactttgcctgtattattttttccatataaagcctctttaaatactgttcaaacatgaatttcatggtattccccattacagagccatagaatacagctgtaaacaaagcaaaatcctttatctcatggagcttgctaaggaggtggagacaaaagataaacaagtaaataaatgcatacactgtggaggtgtgaagtaagtactataaagaaaaaaaaataaaaggaagggcatacaactccatcaacacaactatggccccaaatactttcctctgtccccatcactatggaactataccatgaattcaagttctttaaatttattcaagtttccaatgggtggcaactcatactttaacacattacctcagcaaataaaatgaaaatattttatctacttagaaataaagatttccaaaagattaaaatttttgctgaaaatagtaaaccttacattttcaatagagacagttattgttagatagaaaaagttcctggactgaaactctaaaaacaaagtttttattttgaaatttactacctgccaaatggtggtcttgagacaagtcatttcgctgtctatgagttactaggaagggcttgagctcttagtgtgtcaatgggggtgtgctgttggcattttgggtgggaatgttatgggtaactgtcttgagccattcaccacactgattatctctcttccccaccctttaaatgccacagcactctacagtcatagatataacccccatacagatcccatttccttatactccatgggcagggggcggtcagtaccaagtaagaaacacttctaaatcccttcaaaagtttcaaggtcatgaaaacaaaggaagacagagaaagtgtcatagagtggatcagactaaggagaaatagattcttaaacagaaaaaggacattagtagaaaaagtgaaccaacgtgaatttctttgtttggataagtctaccgtggttatttaacatgatatcataagggaattggggttagagcagggtttctcaatagcaccattaacattttagcctggataattctaggttgtcggggactgtctatgttttgtatgatatatagcagcatccctagcctctacatactagatgccagtagcacatccaattgtgaaaaccaaaatgtctccagaaattgccagatatccttgggagcaattgcagggaacccccccaccaagtgttgagaaccactggtacgtagggactctctatattaactttgtaactcttttgtaaatctttttaattaaatacacagacatatacatacatataagagcaaagcagttatttaaaaagttgcctgggcacagtaaaagtatctacacgaaaaataaaaactaggcaacgttttaatgcttttgactagcttcattgataaggagataacagatttaaaaaatttgtttgaaattaagaaagctgtattcaaatgcaagatactggtacccaccagcataaggatggtattaatagttacctgaattttttaaaaattctttgttatacattcagatgtaaaattatttattatgatgacttccatcgtactagtttcttaagcatcatttctctaagattgatataaagagaagaggtaaatagttttggctgtttgtggtcttcttcaacaggacaatgttgtgtccttcctacatgatgtttctgcccaaatatgtaactcgtctcaagattctaagcaaacaaaaaggtaacctaatgttcaacaaatgtcaccaacagatatataactctacagacgtgtttatattttgttcacatacaggcagttgaactaagaattaataagcccacttcccacagtagcaatgttgtgggaagggggccaggggaaagcctagccctgctctgaaggcagcaaaggctgtatatgaagatggagacacactctgggctgatacttcctacttgcttggatgatgctttcagaaactaactgatgtcttggcctccccaagagtaagaaaccgaggtccaacaagagctaatacccaggcaacagggaactgcttctactctggccattgtgtgccaaatccaccatgggagcatcctcctgtgggactgaggtgaaaaagagaaagaaattggggggatggggggacatggttttcttgtgtccactgcacctcaatagacaggcctctggtttaagagccaggatgttaaacatgcttcattcactcacaactatttactaagagctaaccttgattagccagtatggttagggatatggttaggaaaagagttcctactacagcggccttcagattccgtgccccatcccatgcaggaatttagtgatgctaagactcttgaaaaccaagaccagagtcttgagtccaccagagcattaaataccaaagtggaagccagtaacccccacggtggcagaatttgcacatagttccatgccctatgtgagaatagacccaggacatggggaggacaaagatcttctagatttcacatggcttgtctgcattctttgtcaggagggtctctaatccctgccctgatttgaacttcatgatctccaagcaaagagcacctgttttaatttgatcagttgcagggtcactagggagattatcaaatattttgtccatttgcagcagatttctcttgtgccctgggacatgaggacatgagtcccaagtctgtcctgtgctgtaagcccccatattcctgaagcttggcccacgtggattcagcaagtgattggggggaaaaatggatggatgaaagaaggttaacatctcagtgcttctgacattattcccagagagacaaactgaggaagtaaattggtccagggctgtaataacagaaaagagaggcagggagggaaggagattactttcccgaaactttatctactcacctacaaatactcagacaacaaaacaaaacacagaactctctggcaaaagaagaatcctgaatatactgtagatgaaagtagccaagaagaactgtaaatgtgaaggcagaaagttggtgctaaaaaggaagtaacatgaagaatgactgcacatagttctgtaatttatgtattaaggaaccaaaggatacaaatttcttccagttatagattatgtgcaactaatgtgacttctccatggcctttcttccaaatgtgactacattgaatgtcctccaagatttgtacagaatgaaaaattgatcaacaagcatttcttgagctaaacatgtctttttaaagcacgttttgatgtcataaagaaactgaaatgccattagcacaactaaataaaaatcctacattttcaagattttaaatatgaatgagtccaatggaattattttttgttgttgttagagcaactcagcgaaacaaaattctaatttattgttcatcatattgtttcacacatatgtcaaagaggccaaaaaaataaacagcaactttacagacaaaaaaaaaaaaaaggcagggaggggagtgagaaaccttttatctttggcctttttaaccatctcatacaaacttatagtaccgctaagttcatatacaaaaaagacactggaacactcggaataagattttgttgttgttgttgttgtttttgcttttcttcaaggtttgttttttctttgaactgtatcatgaacatggtcacaccacaagtaaagtcagaagtaagacagagaaagctctgaaggctggtttgatcatttgaaatcattaaaaatggctgacccctaacaatatgtacaaaaatatacaatgaaaataaaaaatattgccaggtacagtggctcacgcctgtaatcccaggactctcgaggctgaggcgggcagatcacctgaggtcaggagttcgagacagcctggccaacatggtgaaaccccgtctctactaaaaatacaaaaattagccaggcgttgtggcaggcacctgtaatccttgctactcgggaaactgaggcaggagaattgcgttaaccgaggagatggaagttgcagtgagccaagatggcgccactgcactccaccctgggtgacagagcgagactccatctcaaaaaaaaacaaataaataaacaatgtaaataaaaaatatgaacaaatttttttcttgaagtacttttaaggaaaaaagctgagctttggaagtttggggttttttttcctcccctgttgcaaattcttgtggtttgggttgggtgttgaagagtgcttgcccggcaggcctctctacttcaagatgactacacttagattctgaaacagggtgaagagtgaatggatcacggtggccttttctctttttttcttttttttaatttaacttttccttttttgctgtctagtcaacctcatcagtcttctgcttcttggtatcaacgttgtcatcctcagcatcttcaactgcccatttgcccatagcatcctcagctgccacatcttcatcttcatcctcttcctcaccatcaccttcttcctcctctttttcctccccatattcttcctattcttcttctacctcattgtcagcctcctgtttcccattttcctcattagcgttcccattaccaggaccatctcttcccttctctgcctcctccacaacttctttcttctcctttaagactttggtgatgatcttggagctggtgtccacagttgcatctgacatggtggggcacaccagtgaccaatgcagtggactaaaaagaaaccgagagtttggggactggcaataatgcagagtccgagaagggcaggtgtagctgcagcaagctggaagccaaacccaaaaacaatgcaaatatggcttttcagagcagccagtgggctggtggaattatttgaattcactttaataatcattttgaccaattgtttttaccaagaaattatattaattcatacataagtaacttctttcagcaaatcatgaaagagaggtaaaaatgtttactccttttcctcaagtgtggaaagccctggtctgaaggtttctctaagaattggatccactgccatttttcatcaatggcgccagacagggccaactgcctccaaagagtggtaagaatctggctcttgtttctggaaatcaaaaggactaaataggcgctgggctgctgttttacaagcacaagaccgttaatccccttaccgtggatacaacagcacgttgttcctttttagatcacaagacttatccttgaataattaggcagaggcagaaatccattatatattctacaccatttaactcagaaagagaaagccttgcctgagttagactttatctttcttgctaaaaatgataaattatctaaaagttgatgtttgagtaaactaggcatattaagtttccagttgacctgggaattagactaaactttggattagattatagcttccttagaaattcctttcaacattttaaaattcctgtgaaactgttttagtaaatctggcctaaatcatattttaaacagttgaaaacacttggttgccatcttcaatccaagttccaggaaaacctcaagtaacctcaactaatgaaaccagagctttcccttaacttcatttttccatctatctcccattctgctcctaaaaaaatacagcaatagcaaaaaaagcatttaatatcagaaattgtgaatgatgattttgaaagagttgtcttgttgctgtcacatttgatctatctttctacaatgtctaccagggctaggttcctgggtgtggacctggtgcagtgtgggacctggtcttagtcctcattcgaatctcagtgctcagcacgtagcaggctttcagtagaggtcacttaatcctgtggctccagccacagcagtgtagttccacgggctggcctcatggacagcagtgaaggaagaggttgatgttgctcacactgttccctttgggcactctgtcagctccttcttcctcgcctcttgacagcatctggggcagatggtgtggctttcctgtcacttccggctgctaaggcatccaggccagtctaaccaaaactgccttcctgcctctcacctacagctgctctccttccagcagttctggccagagcagggacctgagtggtgggctccagccatttcctccgggctccactccctactccctccctgcctgtgctcccctccaccatgcttcattctcctcgcttagggacaggaaagcaagatgatgggggcgtgagatagataaggaaaggccaaattattcttcctggacctgggtccttgtggttcccccgctttgagaggtcttctgtggtagtggacgtccagatgctctccactcagaatgctcctgtggggccttcaagggcccctccagggacctctgcactgcatcttcccctgacatgggtgacacgctgactgatttcctccacctcgcctcggctctgcctccggggtgtacacctccagcctcactctgctgccttgccttgctctgtctcacttagggacatgggcccaataggcagtaactctatcctgttcccttccaaagcctctgcttggccccaggaatatattcaagtgcagactgctcaaaaaactgctctctctctccccagtcacaggtactcaagccagccttccaccatgagacttctctggctaagaagtagccaccagtttctgttccagatacactctcagtggctagggacaccatcatattctctagagctccagctactgttactctagtggcaacttgacggagtcctgagaatgtctgcaagttggggagcatccctccagaaaatattatgccagtctcctttcttaaagacaactgtatcctctatgagcacttctctacctgacttcaggtaggtagggatgcaaacaagaatatcactccaacacatcatcactcgtaaggaatggggaccaactcatcagcatgaactcagttgtcaacaccctagctggccgcactggggaatctgcacaggaacccattcccagccctgttcaagtcctaggggagtggaaatgccacagccctctctgcaagcccacaccctcagcctctctgatccccttagggaatccctggtttctcttccactgcctgcctgcggtgatggtaactggactagatcagctctccaacaagacatcacttcctttttcatagccatgcaagcttctactgtaagtatatgccaattgtacgtttccaaataggaagaggcatgctcaggagacaatgagctctgtatcattggtggtgaccaaacttgatataagagatgttgtagatatcaccctgggtaaaaggtgggatgaaagtgagactattcattattctgttaattacttgaatatctttatttttaattcacgtgatttggtttatttttgtgctttacagttttctgcaatattagtagataaacaatggtgggcgggggggagacaataaacagccagtcccaaaacttggatcctgaagctatcctggaaaggaatatttgccacactccttcagtctgcccacattggcaccaaaagatttctggaaggcggctactggtatcttccatccacctgccacactggagagaagcagcctctccgcaaagctattttcaatccaatcttgcattatgtggtgccctttcccatagctcttcatgtaggggtgcagcttccaatatggcagtgcatgtggaatccaggccagcagctgaattgcatcttaaacacatctcgctcgccaattcatccccttgatagcagtattaccaggactcatactgcctgactctttacagaaaaatgtgtactgaccctcagtccagttttgcagttttgatttttacaactgacactggcaacaaaagcttctacttttcttgaaggtgccattacttgcaatggcaaaaaccacaattactatttcaccaacccgacatatatcctgtgtacccaatttttttttttttttgagacagagtctcactctgtcacccaggctggagtgcagtggcaccatcatagttcactacagcctcaaactcccaggctcaagtgatctcagcctcctgagtagctgggactattggtgtgtgccaccatgcccagctaatttttgcattttttgtagaaacgaggttttgccatgttgtccatgttgcccaggctggtctcgaactcctgggctcaagtgatctgcctgcctcggcctcccaaagttttgggattggaggcgtgagccactgcacccagccccagtgcccaactgtaagtcaaacaacctttcaaataaaccggatcagatattcatagactcctacaatgctccagattctgaaggaagatattttaaaggtaaactcccaaaaatcaatctgaaatgttatatacttaaattaaaatttcctaagaatggaaacacttaatttaacttagtcatgtactaggtgaaatgtgatcatttaaaggaactaatagtgccatgaacacagcaatgtataaaacttgcttacaagaagggctagaagaaaatacaaagagaatatttaagaggttaccattgtgagataaccagtggcttttcttcttattttttttttcctgttcaactttttgtaatgtaatcaccttatttttattgaaaaaagttattataaatagttgtgaaagaatgctgcagtttaatggcatgaaatacaatatatataattttaagatctataaaacaggagtagaacttagggcaaagttttgttttattatataccttcttttcattttttgaatcacgttaatatattattttaaaacatatatttaaaatatacatgtgtgtatacacaaatgtatatgtgttcattttgctccctcaaattccactcttctgtttcattctttatattcatatcccatgcatcagatattgtggatgtgagggagaccaattaatagtaatcatctatactgggccttgaattattatagaattaagacaaaaagattgtacagatgggagaccaaaataaaaggttaggttggaggatatgactttaatcagcaggcagaatttctccctaatttaaaaaaaatcctgaaatgaaatatattcacctccattgtctcaagtagagcataagtgaggcaggtattgtcctgtactggagtaatacacaagatatttaacccttcatataaaatggcacctactaaatgctcctcagctgcaaacagcaagtacaaccttagggtgtatgcacctgtgcatgcagggcctggttctgtacttagctagagagttgcatgagagacgtctgctatcatttggggatggctacctcacaaggagaaaggaacccatgcccaggttctccttccagctcaccaatcacataagtcattttacctctcaagggaggagtgaagaagggaatagagaaagaccaggaatgttaccctcatcacaaatagagaaagaaagaaacatcatagagaagattcctccagaagaacagacaaaaaatataaaactattaaaagtcatattaagtgcttttaagaaaataaacaaggtactatgataaataccaagagtggaaagaacttatacacacttaggttattttcaaaataagagtaaaattctttggtatctatctgcaagaaaattatatatatatatatatatatatacacacacacacacaatagaaatgtagaaagcttaggatatatagctgcaattttgagggatatttatcttcatattatctattaaacaaagagcattgttggaacatgatataaactgtaagatgagttagattataaaagttatttttaagtttaataaaagtgtgaatccctttgaaaaattagcttaataaattattttcaaaatcaaggtttgaaataatgcactatctcaaataatactgtaaataatcagttaagatttctcattatttgcttactctgttgcttctctgttgggaacttttctcatggagaaagctaccatcgctttgaagaggtattcttcattggtatcccaggcatactgaaaaagaaggaaaacaaagtgtatgggggaaaatatggtccattggttctacttgtacccacagtggctctccctctctctctctctccacacacacacacacacacacgcacacacacacacgtttctcatatattagatactggagaccacgataaattatatccccatgtttggggtagggtttcttggacattctaagtttggtgtgtctcctgttgcactatcttcctaagaacctgcagcatcagtacccagccaacaaatagggcatttggacatttcatcctggccatatatagtccattttcatttccttcctccctttctcttttccctcataaactccctcccagttgcctttattaacatcagtacaatttttaaaaaattttcttagccagaaactttagtgtgtgtgcgtgcatattatgggctgaatttttgtcctcaccagaaaaatttcatgttgaagtcctaacttgcaatacctcagaatttaactctatttggagacagggtctttgcagtgatgattaagtcaaaatgaagttgttggagtgggccctaatccactatgattggtgtccttagaagaggaaatctggacacagagggaagatgatatgaagacacagggagaagacagccatctacatacaggccaaagagagaggcctggaacagatccttccttcacagccctcagaaggaaccaaccctatgacatcttgacttccagaactgagagaaaataaatttccgttgtgtaaggcacccagtctgtgttactctgttatggcaaccctagcaaattaatatagtatatttgactcactctgctccttaatgcagtaaatgcaaaaagcctgaggcaaaaagaaactgagctgtttaaggaccaccaaggagggtagcaactaaagagaagcaggaagggagaaagtagcaaaagctgagcggaagaagttggtgagggtggggggttggtatatcacaaggacattgtcaggattggggtttcactctgggatggggaaacatattttaccgttactgcctttctcctctttggtggcagggaggatagtaagtaaaaataaatgactcctaaataacaacaacaaaaaatgtattactcagttaccttctctgggtaaggtttatgactgtgctgtactttttcctttctcctaaatattttcatagcatattctttttttggaagggaggagggatggggtcttgctgtgctgtccaggctggtctcaaatgtgtggccttaagtgatcctcctgccttggcctctgtaacatagaaccttaaactttcttcagttgcttcttccacttcaccattttctccttcagtcctaccttatgtaactctgctgtaagatgttaccataaagaacagaaaagggggacaggagtggtggctcaagcctgtaacactttgggaggccaagatgggtggatcacttgagcccaggagctcaagactagcctgggcaacatagtgaaaccccatctctaccaaaaaaaaaaaaaaaatcagccaggcgtggtggcatgcacctgtagtcccagctacccaggaggctaaggcaggaagattgcttgaacctgggaagtggaggttgccgtgagccaagatcatgccactgcactccagcctggatgacagagtgagaccctgtctccaacaacaacaacaacaacaacaacaacaacaacaacaaaagaatggaaatggaaaaatcacttttctcatatgcaaatgttaaatactgcattttaatgtcaactttagatcttatttgaagtgctccttcaatgttttgatgtgaacttttcatttgatattatactatgaaagtttaaaagtaactgattggtggcatagctctttgtttttgataatgcatttttttccaaaattaattttattcagaataagagtagctatgatctaacctaataataaatgaataaaacatgaagaagaaatgggtctgattaaaaatggtgcagaaacactattaagacagggaaggcttattaacagaatgcagacacaaggaataagcctgctcaagaacaaatgagaataataagctcagtgcagaaaatgaaaataaagatgttagccagctctccctgggacatgaatttcagttgcttttcagatcttggggacaacttgacctgatctcctgtccttccatttgttcatctcaaaaacaagagcataagctggctgggtaggagtccaattttggtcacagaacaaaggtccaagctacttagatcagaacagaactgatgcagttctagattgggttgggtatcctgccagtggaaccaacttatcttgggcaagtgtgaaaaggattgaaagcttgtgcattggacgtagtgtatttctcccagggcattcaaacacttcaaagagagagcctccgcttataaaaggaattgagcacatatattaatgagaaaatgtacaacttaagagaggataaggtaagagttactaaagctaaacatttgtatactttatgatccattaatctactccagggtaaatacccccaaaaaagaaggcatatgaaaaatacacatataagaatgtccatagcagcttaactacctgttgtgcgtatacttgacacataataggtgctcaatgtgaaattgaacacatctttatatgccacgtgtggcttcacagaccaaatggtacaaattaattgcatatatttatctatcagtttagattccttggttcctcatttcaataacatgtgccaggaccttaaatgccccagctcaccttgctttttgcacacatctaagaacactcaaaccatggctaaccccacattttaggtaagtaactggtataactagagacaattacagaacagggttagttggtttaactctaaattcatgatgacctacccccaaattgcctgggaatccctaaggtttcaccatcagttctctttctcatgggtcacataactatttcaaacctctctctagagagagaactgatggtcaatgctttttttttttaaccatttttcccaatggtttccctcaaacctcactctcactaaatggttttgcttcataatttatagatacatctcatcaatttcaactctcccaacctcctgacatcaagatacaacacttcctccatagacacgtcttagccgcctcctctcctgaagtgccagacagaactatgcctatcagaggccatttccgtcacttatattaggaatgcttctcctctgcccttctcagatctaaacaatatcagttcccctccattctgtgtatttagctctgaccggagtctgttcattgtcttttaaccaagctcaagactttctcattaaagccatagcaaagagctgttgttttgcaacagcaaaaacaaatcattttactcagtcttcctttcttctacctactgctatctctttcctgcccttcacagccaaaattctcccaggagttgtccacacatctgtttcaacatgttcaccactcatttattttttaactccccactatctgtcttccagctcctccaccccacgaaaagagctctttctaaaatcaccattgacctccatattgtccaacacaatgaacatttttcagtcgccttctggcttggcctctcaacggcatttgatgctcttgaaccctccctacatctcaaaatgaaactccctaacacagcccacatattccttggcctgcctgctcctctctctttaagctcatcacctgccatgttcctcctcactgccccaattccagatatttctgccctctttctaatctttactctcaccaagatccttcctgtgataagcctttgcacatgctgttccctctgcctttccttctttcatttcctgtaacacttcaactcatgcttcagacatcacagtaagtgccaggtattgtgggccttgacaaagccgaagtgcccttgtacttcttcccgtaatacttgtcaagattgcacatttgcatttggtttactgaatatttaatagatgaccaattctactactactataagctccacaagggtaaggacaagccttaatcaccattacatcccagcattcagcatcgtacctgctattagaggatactgggatggccaaccctgcacactagtagagacagtgtattctgcactcagactgcctgggctcaaatcttacttctgccacttgctgacttgaaatattgagcatgttacttaatttctttgaacctcagttttctcatccattcagtgggaatactaatacctgtactactatcttcctcaaagcattgttgtgagggctaaatgatttgataggagtaaggtgcttagaagagccccagctagaaagtaagataagttctcaataaatgctggctgttataacaatcattactcattgagtcaataataaaataccaaattgatgaactggcctgcaaacagaatacctctaagtttctttagcactcttttttctgtttctatgcctaaggcatcttaacgtcaccttctattggggaaaaaattttgcagaccacactaggaaactgaaactagaattagacaatactgtctttttaattcaatgatctttaccattcctatagccacatgggccctatgactattttttaaacttctatttcataagcatatatttcatatgttactttgataattgagaataattgaagaaacttcaggttcaaattggaaattttttgtgctatgaaagactttatgtgggtagaactatcccttattttcaatggtagaaaatcgaggctaacaaaattcaaatgaccacaacggtgaggagtagacccagtccagacctgaacgactgactcaggccacttggcttcactatcccgagttgagatgctggttttttaagttgttttgtgtggcacaaaacttcacatgttgcctagcatacactactgattaaatactttaggcaaacctactttattaaaaattcatattattctataatctatctttaagaaatcagatttgaggtctttagaaataatttattcaagattaaggtaactatgcagacaggcccattattagagaaagcacagtgttattagcaaacaaaatttaaaaagaacactcaggtgctccacttactgctttatctcccagagctgttctgatactaagtctcactttaaaagcattttctgcacctgccagaaaagaaaaaagaaagagcagtatatgatgattaggatctgccaaaacagagtctgaaaaatcctaatatgtaatgcaactcaaactaatggaacaaagaactacaattaaacagccccaaatactcctggaagtttaacctaaatcatcttagatggtttaatattttctttcaaactcattaaacactcactgccccaactttcaagccacaacatgtctgcagatttagaaaaataaagagttctttcagtcgatgacttgtcaaacatgtagaaaactgttcatctatttttaaatttcaaggctacatacctggttgacagagttcagcatgaatggcagtcaccagaaaaaagagcagccacaacattctttcagggtggaaaacacaaggcaaagtgagaaaaaaaaaatccacgctgcacttaaatctgccttagccattctgtgacccggattagaatatcagagaaacaagcgagccaccaccaaaaaggtttaatgattaacacccatcatttgggttaatacttccataaaaacagcccatctcctgtcagttatttatgaaaacctgtttggaaaacagattagttgttttccctactctgactctacctcaaaag

SEQ ID NO: 1352 - DNA, 64449 bp, Homo sapiens
gtgcctacactggtcccacaggttttcagctgtggagtttgggatctgagcttggagcccatttgtttctggcagttccgctcatattttccacttgaagacatcgcctcccttccttccaagctgggagaccagaagtcaacaacaggagggtggagaggccgggtctcacaatccgcttggctggggagtccactgaggttcttgcatcctgaagcaaaccatggagagctggtggggacttccctgtcttgcgttcctgtgttttctaatgcacgcccgaggtaagaggcattttgctttgagggagatctgcctgggcatggatttttctattcttgctttaagaaactctttccaaaggagttgctatgaagtgaatggggataatttgcccaatgggattagaaaggagactaagagcgatgggtggctgagaggggagggagaagacgggctgctcccatttggaatctgggaattagatccagaagggcaggatgttagctgataccatctagatattcgccatattttcctgttttgatccatgtgtcccaagcgtttaaaaaatgacctatttaactccatgattcaagcatgactgggtgtgtgtggaatgtcagtcatttctttctgattttaaaaattagttctgaccatttccatacagtaaaagtagagttgaaactacttcatcccgtggggcagattaccagagattcgtttgccggaagggttgcatttattcagatttttaaatcttttcctaaacactgtcattcattcttgcaaattaaaaccacctgaattgttcacatcaaaaacttcgatataaacttgcaggctggctgtcccagatccaagattagatttttcagttccgtacgaggacctctttaagaaactccaatgaactcataaagtacaggatttgaacaacggttgagtaagtttctttggtcattttcatgtggcgatttcagagaagggaacacctgggcgcatcttaagagagagaagtatttctgttaggagttaaaacacatcattcagatgtccctgtggcagcatttcctgtttatcctatttaaagacatggacgtcattaagattggagttggttgtttatgggcggaggcggtgtcgggatggatagatcctggtggacatagtctaggatctgcagtgagaattttttattattctgtgctgtcttcagatctcacctagtaagtggacaatgtggccatgcattcattagcttctgtttacagggagatgttcaacagtaaacccacctccccagaaaagtacttccaggagtttgtatcattcacagtaagagccaaaggttaaccatatccccttgggcaaatcaacttctacaaagtgcggatacagacagttcccaacttaccatggtttgacatgatggttcaatttaagatttttcaactttacaacggtgtaaaattggtatgcattcagtacaaacgaaaactgtactttgagtacccatacaacttttcttttttttttttgagatgtcgtgtcgtttcattctgttgcccaggctggagtgcagtgacacaatctgagctcactgcaacctccacctcctacgttcaagcaattctcctgcctcagcatctcaagtagctgggattataggtgcccaccaccacacccagctaatttttctatttttagtagagactgggtttcaccatgttggccaggctggtcttgaatcttgacctctggtgatccaccggcctcccaaagtgctgggattataaatgtgagccaccatgcccggccccatacagccattctgtttttcactttcagtacaatgttcaataaattatgtgaggtatgcaacacctcattataaagttgactgtgtgctagatgatttgtccatccgttggctgatgaaaagtgttctgagcactctgaaggcaggtaaggctaagctatggcgtttggtagggtagttgtattaaatgcacttacaacataaaatattttcttttttttaatgtgttttaatttttttgagggaggggcccactgtgtcacctagactggagtgcggtggttccatcatagctcactgcagtcttcaccccaggggttcgaacaaacctcccacctcagcctccagagtagctgggactacaggcatttgccgctgtgcctgactagtttttaaaactttttgtagagacgggatctcactatgttgtccaggctggacttgaacatctcagctcaaacgatcctcctgccttggcctccccaaatcttgagattacaggcatcagccaccataccctgtcctgcgctaaattctttgactgacggcagcacttcctatgcactaggcatggattaacttagttgattgtccctcagccctatgacgggagtgtcgtgcctgatgtcattttacagatggtgtattagtcagggttctctagagggacagaactaatgcaatagaaatatatatagagagaggagtttattaagtattaactcatatgatcacaaggtcccacaacaggccgtctgcaggctgaggagcaaggagagccagtccaggttccaaaactgaagaacttggagtctgatgttccagcatccaccatgggagaaagatgtaggccagaagactaggccagtgtctcttttcacatttttctgcctgcttatattctagccacagcggcagctgattagatggtgcccacccaaattgagggtgggtccgccccttccagtccactgactcaaatgttaatctcctttggcaacaccctcacagacacacccaggatcaatactttgtatccttcaatccaatcaagttgacattcagtattaaccgtcacagatatgggtaaactgaggcactgaggatttggacgggggcagccggcagcggaatctgagctgtcctgtagctctgtctgggaagactccagtgagcatcccgctctatcccaagccttgtcttctgaaaatcagaatcatccctcctccaagtgttacaggaaaggggtccggatccagacgccaagacggggttcttggatctcgctccataaagaattcagggctagtctgtaaactgaaaacaagtttattaggaaagtaaaggaataaaagaatggctattccgcagagcagctcttagagctactgcttgcccatttttatggttatttcttagtgatatgctaagcaaggcttggattattcatgcctcccctttttagaccatgcagagttcctgacattgccgtggtatttgtaattgtcatggtgctggtgggagggtaacactgaggacaaccagaggccactctcatcaccatctgggttttggtgggttctggccggcttctttactaccacctgttttatcagctaggtctttatgacctgtatcttgtgcagaccttcagtctcatcctgtgactcagaatgccttaatcatctgggaatgcagcccagtaggtttcagccttctattgcccagcccctattcaagatggagtcgctctggttccagtgcctctgacacaagtagcgccccttagggaggttacaggagggactggaaggaaagtgaggtctggatcagggcccttctgtgtaaataagatgatgtacatgcagcagctgggtatgtcctgggtaaaaattagttaaatgcacagacgaccctgtttcatccccagccatcaccagctggaaatggggcacattcccaagatcccaaaaacattctgcaaggctggtgcgatgattgctatgaagtacttaagaaaacagattattgttcaggatcaatagctaatgcatgtggggcttaatgcctctgtgacgggttgatgggtgcagcaaaccaccatggcacatgtttacctatgtaacaaacctgcacgtcctgcacacgtatcccggaacttaaaataaaataaagaagacagaatattgttaatggttaatatgctgtaaatcattatgatgattactaaattatcaatacaaaagaagataatagcaagacggccatattcctaatagaggttgacattttagcagccctacatttccactgtatttaattagtatttgccgtccaatccagaggggcatgaaggagcacgagacaaaatcaggtcttctaacagctgagaagaagctgagaaccagaagtggaaaccccaaagggcagtgtatgaaatgtcatttattgaggggaaaaaaaagaaaatgacagagttcgatagaagaaataagcactagtgtttacataatcagtagggtgactttagtttacaataatctattgtagacttcaaaatagaagagtcggaatggttctaatatgaaggaaagacaaatatttaaggtggatggatatcccaagtaggctgatttgatctttacaaattatataaatgtattaaattattacatgtaccctgaagctatgtacatctgttatgcatcaattaaaaataaattaaaagaaaaggatatatgtccaggatatacaccagctaagacagtctcttccaagtctattgtacattattcccttatcagatttgaaacctgagagttccctgacgccccctcacaggatgtgcaacaggggtgtgtttgatctgtttgaccgccacacactgaaacctcttatgggaggcagaacttgcagacgggcaggtgcagcagctagtgtgagtgtttttgagctctgggccccacggtagcatctagggatgggtgcctgcgacccccgaagccctagtgggcgttttacggtgctcttttagctctgccatccgcacgtggcttaagtgttagccagctcagtgccgtcttggtacccgggttcttgtccagcatccaggaagaatcaggtcacacgaaccagctgaaggatggtaaatgcagaagagtttgttgccagatggagatgactcttagcgggatggttggggagttggaaaggggatggagtgggcagatgatcttcccctggagtttggttgtcctgcggctaatctcttctccaaccatccccagctgaacacctctcagtgttcagatgttccttctcttctctccttctctgctgtgctgctctttggttcctcaccttttctgctcatctgtctgtctgcacatggggtctggggtttggggttatatgggtacaggacaggcaggcatggtgggtcaaaaggcaacatttgggcacaaaaataggaatgcctgtttccatttaggactacaggtttccaggcttgagggcggggcctttgctggggaactgccctcttgtatctagtatcttcaggcctcctgtccgtatcaacatgacttaaaatgtgtgtgcatttgtatagagctgtgtttctatgtaaagactaaaaaagacttatgaaaaagatcactcagagctctgaacagtagcaaatcatatttctgagtacttcctgttgagtaaaggtaagtgaggattgtgccaagtatttttcattacttgctgcattaggttgtcacaggctgtttagtttacttctaaaaattgggatatggggaagttgtgggccgggcacagtggctcatgtttgtaatcccagcagtttgggaggccgagttgggcagatcacttgaggtcaggagtttgagaccagcctggccaacatggcagaacgctgtttctactaaaaatacaaaaattagccaggcatggtggggggtgtctgtaatcccagctattcaggaggctgagacaggagaatcgcttgaacccaggaggcggaggttgcaatcagctgagatcataccactgcactccagcctgggtgacagagtaagactccatctcaaaaaaaaaaaaaaaaaaaaaaaaaggaaaaaaaagttatgatgatcgcctaaggtgagaagccataccacgccagcgtacagaaccccaaaccacgccagcctcatcctacgtctcagttatatttttcttgacttgcttccattctggtgccccctctctccctgccccctccttccctgcaaaggatctagcaaatttgtaggtgtggaaagggaaccacaaatgggtcatttccctgccattgtcacctggagcgtgtagccatttcgtgcagtgattctctgtctttgatgtgcaggtcatcaccttgaagggaggaggtattaaaagcgccacccagtccccacccactgaggtctttattcagcaggtgtgggtcaggcatttgggagctgggagacctgcattttaagaagcaccccaggtgatgcccaagcggagctatgtgcttcttttaagagatgatgactccgtgtgcaaccgtgtggttacctttgcgtggagtctcatggatcactgccacagtggggaggcagctctgtgctctccaattcggtgatgtgtcattcactctatgcaggcccaaggtgacacccccagatacaggtgctgccatccagccattctcaaccagggatcatgtttatccacagggacacttgtcgatatcttgaggctttgcgttgccacactgatagcagggatgctgctggcatctagtgggtggagcccagggatgctggtcaacaccctgcagtgcacaggacgccccacagaaaagaatgatccaacctcatatgtcagtaggactgaggctgaggaatcttgccttagcatgagagatcctgtctgtctgtctgcctatctctagatctatctatcgtctaccattatccatccacctatctgtctctattatatacacctatcatctacctaatctatctgtcaatgattttctgtcatctattatctatctatttatctatctttctacctacttctctatccaactctcatctctattacctatctatgtatctatgtatctatctatgtatctatctatccatccgtctatcaatctatctatttatctagcagtccatcatctatctgtgacattcttctgctacccagggataattgtgttcctcgagtaacacttggcaatgtctggaaacaattttggtagttgcactgggatgggtgttctcgcattcggtgggtggagacaaggcatgttgttcaacaccttacagtgcacaggacagcacccatgacagagagttacgcagccccaagtgtcattagtgctgtagtggagaacctgctgttagttataacttctaaccctgcgaaaggggacaggttggaaatgtcatgctcctgtacgctgtaggaggtatagttgtctggaggtatagttgtctggaggtatagttgtcctgtacagtataggaggtacggtatagttgtctgggcatttctaaatggatcttactgtcagaatgcacttgtaggatcttttccccatagggcatagagccatggcacatataacccagaagctgagcattccatagtttccttcttggagtaggaaggggctgtgcagaaaaagtctatggctgtttggcacctgagtgtgaagacatctggcaaatattggagccaattagcagacaagcacggagtccaagaaatgtctcccctttcttggataacaactgacccttcctgtgagggcccccctcattccagccattttcctctttctcattggcacacagggggtagaaaagtggggttctgcctgcaggtggggctctgccagacacggcaaagctcctggggattcccccgatggatcaggggccagaggcacctaaacctgtgagcgatgtgtgcagccacggtgctgaggctgggaaactctgctgtagtctgtgaatcccaacctctgggaatgcttcagaatcagattctgggctgatctggaatctgcatgtggctggattctggtctgatccaggcatggaggcgtgtgcctgtaatcccagctactcgggaggctgaggtgagagaactgcttgaacctgggaggcagaggttgcagtgagctgagattgtgccattgcactgcagtgagctgagattgcaccactgcactccagcctgggcaacagagcgagactctgtctcagaaaaaaaaaattaaggaagagtattattgagagcgtaggccaggcgcgtgatgttgctgagatgaaactgtctctctagattcccaaaccctggttatctccactgaaccaggctgtccaatggcatccccattgtaattgaccatgttccatggtttaaatctgttgtgagccaaattgtaccctcctcaattttacaaatggaagtcctaacctgcaggacctccaattgtgactgtgtttggagatggggtctttaaagaggtgattcaggctgggtgcggtggctcatgcctgtaatcccagcactttgggaggctgaggctggcagatcatgaggtcaggagatggagatcatcctggctaacacggtgaaaccccatctctactaaaaatacaaaaaaaaaaaaaaaattagctgggcgtgcctgtagtcccagctacttgggaggctgaggcaggagaatcgcttgaacctgggaggtggaggttgcagtgagccgagatcgcactactgcactccagcctgggcgacagagcgaggctctgtctcaaaaaaaaaaaaaaaaaaaaaagaggtgattcaggcaaaatgaggtcactaggttgggccctgatccaacaggactgcagaccttataaaaagacgagatgaagacacagacatgcacacagggacgatcctgtgaggacttagggaaaagatggcatccacaagccaaggagagaggtctcagtaggaaccagccctgcccacaccttgatctcagacttccagcttccaggcctgtgggagaatcaatgtccactgtttaaacagcctggtctgtgggactttgctatggcagcagccacagtggacaaacacatttgtattccaatgaatgagttacctctgtaagggttgaattgtgcgtctccaaaatttatatattgaaggcctaatccctaggacctcagaacatgactgtgtttggtgatggggtctttaaagaggtgagaagggtacaatgagctcaggaggttgtgccctgatccaataggactggggtccttataaaaagagtagataaggacacagacacacacagagggatgaccctgtaaagacacagggagaagagggtgtctacaagtcaagaagagaggcctcaggaggaaccagctctgcccatgccttgatctcagaattccagcctccaggactgtgggagaataaaagtctgtggtttgtaagccacccagcctatggtattctgtgatagcagcctgcaatggactaagacatctcataagaagagcagatgaggacacagacatgcacatagagggatgaccacgtggggacacagggagaagatggtgtctacaagcccaggacagaggcctcaggaggaaacagccttgcccatatcctgatctcaagacgtccagcctccagggctgtgggagaatcaatgtctgttgcttataagccacccagtctatggtatgctgtgacagcagcctgaaatggactaagacacctcataagaagaggagatgaggacacagacgcacacagagggatgaccacgtggggactcagggagaagacggcatctacaagcccaggagagaggactcaggaggaaccggccctgcccacaccttgatctcagacttccagcttccaggactgtgggagaatcaaggttgttgtttaagctgcccagtctttgggattgcattgtaacaactctgggaagccattaccaagtctctgtcctgcaaagtgagatccatggatctgcagccttgacatcccctgggagctgatgagaaacactgtgtcttgggcccagacagacctgctgaagcatagtctgtgtgtcacccatgtcctgagggatccgtgtgcatgccactctgggaagacgggtttataacacaccgtcaaccagtgcctcattgcatggtctgcggtattttcctcgagttttccttgcaccaaagatgtcttgctttttgtgatgaatgatcattccttcctcttcgacgacaaaatacttcgatctctgcagacaccgtctgttgtgttacagacagacactgaggcctgaattctcattaccaatgtctgctctaatagagcttcaatctgcaactgcataatatggtcactgggaagtcaagaacggggccagttggttgaccttctggggagaggctgggctgcttggatgctgagaccgtggagggttcatgggttccgaggagcagatcatgcaccagggcggcctgctcagctctggtgtctgcagccccggtgagcttgagcattagggagtccctggatattcatgttgaggtgtggaggaggagactccagctgtgtttgatttcctgtcctgctggaaatataaacttcttaaccaattagagaacagaatggatttcatcttatccatggggctaaagtagaattcagcccttggcaaacaagccccccgggaataagattccccattggggcagcagccttccttgtcactttctgttgcaacctacggtcctaacctagtcatatgatttaattttttttactctgtgaatcatgccgtcctgggagagagtgagatggagcaaggacaaccctcttaggggcctgccaggcactctccctagcatggaaataaaggaaaaccttgagttccttcaagggaaattccaggcacctcgctggccttgagaagtacatggagcagcttgataagcaagaaggtgattgtagtgtagaacaatagccaaggaagttagagcctcaatatgtttagtttcctgtaaagactaaagataacatccttttttgagatggagtcttgctctgtcacccaggttgcagtgtagtggtgcaatcttggctcagtgcaacctccagcacctcctgggttcaagtgattctcatgcatcagcctcccaagtagctgggactacaggtgcacaccaccacgcccacatttttgtatttttagtagacacagggcttccccatgttggccagtctggtctggaactcctgacctcaggtaatctgcctgccctggcctcccaaagtgctgggattgcgggtgtgagccaccatgcccagccaagataacatcttactatatggccctgagttgattttcaggaacccagacccccaccaaataaaaaatgccatctgctggctcatagacgttgggtaagagaaactgaggcctgaattctcattacaaatgtttgttctaaattccttccctggggcatgtggcggtgggaggggggtggaaggggggtgaggggacgtgctggaggaagtcacaccaatggccacaactaacattgatttctgctgaccccaaatgctcagacaaacttggcctccttaaccaatgacaaatcagagaaactttgaatccacattaagcccctgcttccaggtatcccgcctttttagatcaaagcaatgtatagcctgcatgtattatggctttgcctgtaacctctgcctccttgccattgaaaaccctcagctactggccacccaggaggttgggtcttgaggcatcaaggaggttgcttgatgccctctaaatagctcggaataaacgcctcacttcctcacgctgcaatcccaatggcggtgttcggctttactgcacagggccggtggacctaagttgagttagtgggaggtgttcgaaccagggcaactccaggttgagtaggggctgtgtaaaatgaggccgagagctgccgggctgcattcccggatggtcaaggcattctaaggcacaggatgagataggaggttgacacaagaaacaagtcataaagaccttgctgatgaaacagcttgccgtaaagaagtcggccaaattttaccaaatccaagatggcgatgagagtgacctcgggtggtcctcacttgtgtcttcccaccagcaccatgacagtttacaaatgccacggcaatgtcaggaagttaccctatatggtctaaaaagaggaggcatgaatgggccactccttgtttagcatatcctcaagaaagaaccatacaaatgggcaaccagtggccctcggggctgctccgtctatggaggagccattctttattcctctgcttttctaataaacttgctttcattttatggactcgccgcaaattctttcttgtgcaaggtccaagaaccctgtcctggggtctgattccagacctctttccggtcacaagttcagtcacaagaaccattatcatatgctttctatatatacacataggtattttttaattgctgaactggagtcaaagagaaaccttaggatttgcctgaaggaagtcaagatttgtccttctcggggtccctgtgccagctttgtaaaacctcggaactttcccctctgtgggcttcctcaagctgaggagggctctatgggcttagtacccactaagtggcttcatctgcagcagctgacccaagaaagttgatttaaatgaacccacacttcagaggaaaccagtacaatccgatgtaaagaaataaaaaataggccgggggcggtggctcatgcctgtaattacagcactttgggaggccgaggcgggtgaatcacttcatgccaggagttcaagaccatcctggccaacatggtgaaaccccgtcattactaaaaacacaaaaattacctgggcgtagtggcatgcacctgtagtcccagctactcaggagactgaggcactagaagcgctcgaaccagggaggcaggggttgtagtgagccgagagtgcgccattgcactgcagcctgggcaacatagtgagattctttatccaaaaaaaaaaaaaaaaaaaaaaaaggctaggcacggcggctcatgcctgtaatctccgcactttgggaggccaaggtgggtggatcacgaggtcaggagtttgagaccagcctggccaacatggtgaaaccccatctctactaaaaataaaaaaaattagttgggcatagtagggggcgcctgtaatcccagctactcaggaggctgaggcaggcgggagaatcaattgaacctggggggcagaggttgcagtgaacagagattgcgccattgcactgcagcctgggcaacatagtgaggttctgtatgagagaaagagagaaagagggagggagggaaggaaggaaggaaggaaggaaggaaggaaggaaggaaacaattgcttgaaagggctttgtttcaccagggcacgcagatcaaaggacattggattgaataatgaaacagaagagcctgtctgaatttactaatgtggttgcacgtcccgtaatgattgcagttggctctaattcagttccgtggtgtataaattctgctggcaatagctgtaattggggtcagggatttagatagtctctgtgtgttccttttcattttctgctcagagcctgctgggagctgattttcttctttaaagcgaggtaaataattcagtggggagcagaggttttgctgtgggtccattgctctcctgtgctgcgtggcagctgtgctggtggcagctaatattcagtgggcagtggcctcgacattgcattattattcgagcaatggtactgttctttgctttgcaaaattgctgtttgttatattgactttctggggtcgtggcccctgaagcattactgaaaatcatggacatgaagcagatttattaactggagaaaagacatacaaatgtatttaatgtgtatacacgggagcattcagaatgaagaccccaagttacaaggggagattgtctatatttatgctttggttcatccaagtctggacagctgtgtagaaatagggttggacaaaaagggcctgatccaatgctaatggcctgagtggggaaacccagccaggcctgtgtgtctagattcttcttggcctctctctctctctttttttttgagacggagtctcactctgttgccaggctggagtgcagtggcacagtcttggctcactgcaatctccacctcccaggttcaagcaattctcctgcctcagcctcctgagtagctgggattacaggcacgcaccaccacgctcagctaagttttgtatttttagtagagacggggtttcaccatgttggccaggatggtctcgatctcttgaccttgtgatctgccctcctcggcctcccaaagtgctgggattacaggcgtgagccaccgcacccggcctcttcttggcctctctgaacagtgctccttccttccgggtatggggctgggagcttctctgggatggggggtcttaggacgcccaaacaaggcaggtcagggaatttccttatggccacttttttttttttttttttttttttcaagacagattcttgctctgtcacccaggctggagtgtactggtgtgaactcggctcactgcaagctccgcctcccgggttcacgccattctcctgcctcagcctcccgagtagctgggactacaggcgcccgccaccacacccggctaatttttttgtatttttactagagacggggtttcaccgtgttagccaggatggtctcgatctcctgacctcgtgatccgcctgcctcggcctcccaaagtgctgggattacaggtgtgagccaccgcgcccagcctgtgccactctttatacagataggatagagggaaagttagattcctgtttttaggttttatggctggcttcggggggaaaggcgttcttgtttctgggacccgtcttggggaagagggattctagttccttcggtgccttaggggagaatgggactcagagacatgggggctggagaagttccgagagaaacttctgcttctgaggctgctgctgaggcctgcacttggcggtattgtttcgtaagcctgaaccacgtgcaggtctgaatcaacataaagaatttgggtgggaggcaggggaactccaataagaagcatctttgaatccggcaggggtggaatttgggtcccagaggggtttggtgactgcaggctacagaagaatgcttcaaagtgctgtatcacatggctttgctccgaagggtcccgagcacagctttaccgggggctcatgtgtaacgctcggcccacccatccaccaacaggagccacttaatcgacatctccaggatgccagcaaccgaggaccgttgtcatagtcccagcacaaaatgaggctgctttcttcttgggggtttagggatcccagaccacaaggatttgattaaaagccgctcagttcactaactataagcaaagcaaatcagaaatagatctcctgttcctgccccgtcttatgttcccagtggaaaataaaccccgtgaaagcaatggcgtcatgtgcaacccgaccttggagacagagaccccagagttagcgttgtctacctgggacatctcccagcccaggggtcttactccagacccgtgaggaccccaggcgtggctttgctgcaacttccctggagaggagagaggacagggggccctgcctgggagatagatttgctgcctggcatgcgggactggagactgtctcagtgcccaggccgtctgatgctggccggagtccgcctggtttatgtaacgaggtctggatgtgaccaacaacggcctcgtgtgtgtgagtcacgcgtgcagcaacttctggctgtagtgcaacccctgaaaccaagcaaagcctaaagcccccaggctccacttcctctgtgaccctccccacccccaattcctgtcatctctcagggtcatccggagcatctcaaagctgaaggagcctccgctgcaacctggcctcctgctgcaggatgagacgagctgtctgcagccctcccgtgccacctgcctgttttatgcaacagcatttcagagaggagggactgggaggggagagacaacaccgaggcctttggttatttagggcaacagcagggagtggccgggtgcacagattggaggagattaagtggttgctgaggggatgcctgggattgctgggatgggcggagacataacacagtgaaagatattggtcaacggcgaacacagattggaatgtaaattctcagggtgtgtgcatagccgggacgcttaactttggcgtcctggacaggtgtctcgactggaactgctggcagccttggaggggagatgttgcacagatccaagaggctgacacggttcctgtcccccagcccagtctgagcagcttggaccatgatgatcaagagcgctggaggaggccaggtgcggtggctcacgcctgtaatcccagcactttgggaggccaaggcaggtgggtcacttgaggtcaggagttcgagaccagcctggccaacatggtgaaaccctgtctctactgaaaatacaaaagttagctgggcgtgatggcatgcacctgtaatcccagttactcagacggctgaggcacaagaatcgtttgaacccaggaggtgggagttgcagtgggctgagattgtgccactgcactccagcctaggcgacagagagagacgccatctaaaaacaaaacaaacaaaaagaaaacaacaataaagaaaaaataagaagagagctggatggagcaaagatttgctgggttgttcttaaaggcgagcctgtagtgatcgctggtaacagagaacgtcatctgagagggacgtgggggctcccagagtttgagagaaacggccgtgtgggatttgacctgtgatggcaccgccagctcccagcctccagtctgggcccaggggcagctgctgtgtgcaccctgggctcagagttccccttccctccaaggtttgtgactttgtcctgacttagggattcctgtctggggatgcgtcttctgctccggagaggccctaattgcctccacaaggagcggcaaagcctgcccgggtggcatctgactggagccatgccacagcctatacgaatctatgttggagcccttgaaccttcccccagagcaagcgtcaccgaggcagaccgatttttgggagggagacagacatcagagcgggggagacccagtacctagggctcacctggttcccccaggcttagcctcctccagggcttagtgtttgagtgagagattgtcccccctggacaattctgtagattctgactctgctcctgccttgccctgaacttcccagaacctcagtttcttcctttgggaaatatgcatgctggtcataccaacatccttgggtgggcagatgagactcttgggtgcctggcattactgcaacagaactcaatgcatagtaagtgctgactcaatgtgctcctggctgcatcctctacttcctgataaattctctggtggtgttttctctacaaggctagtactggcaggggcaagtgaggaacaagatcaaggtgtgcatatatgtcagcaagagggacccttcaccctcacaaattctgcagtgtgtttttaatgatgtgtcccaaagatgtgaatgttctcttctctctgctgcagacacattcattagattaactgcttttggatcaggtaggaacctcagcttgtccacacaggttgcttcctgaccctgtatttgtcagtgtaggctagctgctataacaaacagcccccaaagaattaaaagtttatctcttgtttgtgttgcagccaggtgaggtggcaaaggtgtcctatgctccatatagtctctcaggcatccaggaccctcacattgttgtgcttcaccttcttctagggcagcccctctcaacctagactctgtgcgtgtgtggaggggtggggggggcgttggggggcggggatatgcctgtcctaagctgtgagtgggacagtccaggagagaagtctatgtgcttggagagaggcttccttcaaagtttcctggccatgagcaggaatgaagctctgacacaggttgcaacgtgaacgcaactcaagagcatcatgctcaatgaaagaagccaggcacaaaataccacatattgtagaattctatttataagaaatttgcagaacagacaattcatggagacagaaagtggatagtggttgtcaggggctggggaggcgggaggggaactaactgctgaatggggacaggggtcttcttttgggtgatgagtatgctctgggactaggtggaggtggtggttgcatctcccatgtagctcatggtcaggttagttttagtgctctgggcgaccctaggcttgcaggaggaggggagcagcatgaggtgaggaacaagggggattctggcctttccatcatggggtgacttatgccctgtttgctcccaataggtcaaagagactttgatttggcagatgcccttgatgaccctggtaagtgccgatatttcaaggggagccttcccttttcagcttggatctaacagcatcagctgtatagttactttggggttggattgggccagtgttgggaatttcttggtcttgagatctctgttctttgcaggagattgcagacaccttgagacaaacctttacacactctctaaaagtctcagactcatttcttggtaggtctgtgcttctaaacctgtggtttaggaatatgctagtattttattattttattttactttattttgttgagatgggagtctcgttctgatgcccagactggagtgcagtggtgcaatcatagcttaccacatagcctcgacttcctggctcaagtgatcctcccacctcagcctcccaagtagctggaacaacaggtgtgtgcccccatgccaagctaatttttttcttttttcttttttgtagaaacggattctcactatgttgcccaggctggtcttgaacccctgggctcaagaaatccttctaccttggtttctcaaaacactgggattacagacgtgcctcaacatgcctggcccagtttctgcttttcttacacttcagttcatatccctcattgtcccacaccccgatcccaatccatggcctccaatctccccagtttctgcttttcttacacttcagttcatatccctcattgtcccataccccgatcccaatccatggcctccaatctcccctcccagagcacacttcattccgttctcccctcaacttctctggttaccttcactgacggggctgtgagtttttcttctccagggcactgaggacctggaatcttcccattctgtgttttcatcagtccaagttcagctagaacctttctggctgaccagaatgctgaaaatatgtgtcctgggccctgcagaaagtcctgcttgaggcagatagtctgattgagattcaggtgtattcagaccgcggtgggtgggagaaagggaaagatttggtttctgatgcaggcacaatggaaccaaacatttattttgaaagaaaaataaacttttgtgtacacagaggaagaatccattgggctttagcattgggaacaactggttgaccagtgcagttacataatggtgtttgttggaggaagagagaatgataaccagatctgatcctaaaaagccaacaacaagatgataggaactcatctctctcccagttttctgcacacagtgatgtttttgctaataattatcctaaaaggcagatacaaaattgttgtcagtgcaacaggaaaatgtaatgactcaccccaacatggagatgccatttctcccatgaagttagaaaaggtgaaggttgaatcctaccctgtcaaggcagattgaggggtgggggttagaggcaggtgtgtggttgcaaccactttggaagcattgggggattatctccaaaattcagactgagtgtgttgcaccagcgtttggtctggataaagaatgaggcatatctgcaagagaaccctgtgcaatagtgaaggaggggctggctggtaggctcagatacagaacaagacatgttattgatctgaaagatcactgacatgtgacccaggagttccacttctagacagatacccaagagaattgggagcagggactcaaacagttatttgtgtacccatgtttgcagcagcaatattcacaataagccaaaggtggaaacaacccaactgtccatcaggggatgaatgaatgaacagaatgtggtccctccaggcaacagaatatgatttggctgtaaaaaggaagggggttctgatgcgtgctacatgagccttgaaactgtgctcagtgaaacaagccaggcacaaaaggccacagggtgtaggatcccattaatatgaaatgtccagaataggcaaattcagagagacagaaagtggattagcgattgttgggctggaagaggggacaaaagggagggactgctcgtggctatggggtctccttttggggggatgaaactgttctggaactagatacaggtggtgattgtacaatattgtgaatatatgaaacaccattgaattgcacactttaaaatgtcaaattttatatgtgagtttcacattaattttttaaaaatcacataaataaacttattttccactcacctgctactaccttttcattgctcacctagaaggctgccagtgcctgcaaacacatctttgaatgcatcgttttgctaccaagagccccccatgaatgggcaggcatgtgcctgttcatccacagcccttcctcatgggaaggaagccccagtgcagaggaaccacagtcacctgcatggcgactgtggggaattcacttttcactgtctatactgcctgggctttaagaaactctgtgagtgtatcactattttaaaaaatagttataattttacattttaaaaaggagacagagaaaggaaggatgggagagagggagggagggtgggaggaggaaggaagggaaaaggaagagaagaaagaaaagaaggaaacaatgaaaggacagaggaaaacagggagggagggaggaaaaaggatggaaacaaggagggaagaaaaggaagaagagagggaacgatggagggaaggaaggaagaagaaaggagaggagataagaaaagactgaggggaggaaggaagaaggagaggaatgaaggaggaagggaagaaaggaggggggaaggaaagaaagaaaaataggagaagaaaggaagaaagaaaaagaataagggaaggacggagggaaggaaggagagagggagaggagaaaggttggaggggaggaaggaagaaaggagggtggggaggaaggaaagaagaagggggaaaaggagagagggaaggaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagagaaggaaggaaggagcgaaggaaggaaggagagaaggaaggaaggagagaaggaaggaaggagagaaggaaggaaggagagaaggaaggaaggagagaaggaaggaaggagagaaggaaggaaggagcgaaggaaggaaggagcgaaggaaggaaggagagaaggaaggaaggagagaaggaaggaaggagagaaggaaggaaggagagaaggaaggaaggaagaagggagggcaggaagggagagggaggtggcaggaaggagaaaaggtgatgagaaaccttctattaaaatacaggacatgcgaaaccatatgccccgtttggaggttcaagctctccttcttgcagtctctgcatccccagtgaatgtccgcaccacacacaaacccgtgttccagccgcctcctaccaaggcaatgctaggctgttatgtaaaccatgctttcaaatacggtgtttcctctgtttggaagaagtctggccattgcacagccctgaagctccaattttcccagccatggccgactccacctcctttgagccatcttcctcaaacctcctcctgccctcgtctgcccatccacactgcacacccaggttcactaagcagggcagtcacaggctgcaccctgagcactcctgacctgatatccacatccatgcaatacatatttgctgaatgaataaatgaatgaatgaaagaaagtgagataagccatcattctggaagctgcaagtctttctccttcttttcttttgcctccccctgcctcaccctccaccgtccagccctgtggtggctctacgggcaggtggctcacttacttgtcttggatgttctcagctactttggccatcctgtgggcatcctcacagcctcaagggtggattgtttttgaatggattttaagggtgttttcttgtcttttttctcaattcaacatggaatttgtgtctatatcatttactttgtatggctttgtcactcccttttcacctttcatcagggcgttcatggcctttcttcatgcttccaatgaatcttcaatgcatattgcatttattttctctctttgttcacagaacccaccaagaagccaaactcaggtgagtgtctcttcagctgggaaaaactgaggcaacgtccttgaactgatgcttacggaggggatggttgaggatgttttacagaactgtggggtatatgaaagagatgcaacaactgtaccagatagcagatattgaaagcaaaatgtggtgattagggaaatgcaaatcacaaccacagtgaagcaccacttcgtccccactgagatggctaaaatctaaaatggaaaataacaagtgttggcaaggatgtgatgaaactggaatgtttgtacagtgctggtgggagtctaaaatggtacagccactgtgaacaaatgctttggtggatcctccaaaagttaaatacaggattactctatgaaccagcaattccactcctaggtatgtactcaaaataattgaaaacacgggttccaagaaaaatgtgtacacaaatgttcagagcagcactattcattatagctaaaagatagaaataactcacatgttaatcagtggaaggaatggataaacaaaatgtggtccattcacacaatggaatattatttagccttgaagaggaatgaagcactgaaaattgctacaaagtggttgagcctcaaaaacattttgcaaagagaaagaagccagacacaaatgatcacataatgtatatttttatgaagatgaaatttcaagaataggtgaatccctagaaccagaagcaatgtcgtgactgccaggggctggaggggaaagagagagtgactgcttgataaattccaggtttctttttgggggaacgaaagcattctggaagtacacagaggtgatggctgcacaacactgtgaatattctaagtgcccctgaattattcacttttaaatggttaattatatgtaaatttgacttcaatttatttatttattttcaattaaaaaggtaacctttggctgggggcggtggctcacacctgtaatcccagcgctttgaaaggccgaggtgggcagatcatctgaggtcaggggttcgagaccaacctggccaacatggtgaaacctggtctctactaaatataaaaaaattagctgggcatgatggcacatgtctgtaatcccagctactcgggaggctgaggcaagagaatcacttgaacccgggaggtggaggttgcagtgagccgagatcatgccactgcactccaacctgggtgacagagtgagattccgtctcaaaaaaaaaaaaaaaaagaaaagaaaagaaaagaaaaagaaataattcccggggccgggcgcagtggctcacgcctgtaatcccagcactttgggaggccaaggcgggtggatcacaaggtcaggagatcgagaccatcctggctaacacggtatgttgtacctgagcgagttagaaaaacgctttgagacaaattaagagtcctttataagccagcgaccgagagacggctaatgcttaatagtctctcggtcctgaggaaggggcttgattaacttttagatcttggtttaggaaggggagggctgggggtctagtgaaaaccattttacagaagtaaagtaggcaaaaagttaaaaggataaatggttgcaggaaagtaaacagttccaggtgcaggggctttaagactattacaaggtgatagacgcggggctttgggcgttactaatcagacgaattcccgggaactgcggatgtagctcgccacagtatcttatcagttaactgcattcttggatgtgctgggagtcagcctgcacgagttcagtccttgaggaaggggctgccagtgaaagagccaaggtggagtctggctggctctcttagctaagggagagtccattcaggtggaaagaaggctaggtgagtaaaggaaaagggagagtctaaaaacaggttagtaaaaaccaggttgggcattacaggtgaaaccccgtctctactaaaaaatacaaaaaaaatttgccaggcatggtggcgggcgcctgtagtctcagctacttgggaggctgaggcaggagaatggcgtgaacccgggaggcggagcttgcagtgagccgagatctcccactgcactccagcctgggcgacagagcgagactccgtctcaacaacaacaacaacaaaaagaaataactcccagacttccagcagactccttgactgccatgagagatgtcaggaagtcaatggacgggtgtttataggttgttcaggaaatgttcactatcaagcaagaattgaaaatgcagctaaattgctgttggagagtgatgatagcataaagatttccaacaagaagctctgcaaattttgctgaaaaatcttccaaatgatgctctgccataagaagaaattcacaccctgaatagcacagcaggatgcgaatagcaatgccagccaaagacattgcaaacaagccggtaaaactaagtgattgttagctgtttaaaaaaataataataactggtgttaacaacaaagtgaaacttaacttctgaagatgaggctaccttcacagagaggataagaaaggaagaactgagtaaaagtagttagatattgctggattttgacattttaaggttaagtgttcctgctaaaaataaaaattgaacatataactcctgaactagtggatgaaaatgaagaatgaagaataaaattaaatacaaaaaaaatgaagagtaaaattaaataccaaaattagccaagtgttgtggtgaatgcctgtagtcccagctactcaggaggctgaggtgggaggatcacttgagccccagaggtggaggttgcagtgagctgagattgcgccactgcacttccgcctgggtggcagagccaggctttgtctcaaaaataaaaaaaaataataaattaaaaacctgaatactaaatggaagttaagaaggaaggaattaaaaaagaagaaaagtaaaataaaatagtaggaatagtgaatccttagttatgttagatgttcagtgatttaataaatctgtaaaaagacggagatgagatgatgcaatttaaaatgtttcggctgggcgcagtggctcacgcctgtaatcccagcactgtaggaagccgaggcgggtggatcacgaggtcaggagatcgagaccatcctggctaacacggtgaaaccccatctctactaaaaatacaaataaaatgtttcatgctatttacgagagaagcatttgcaacaaaatgccaaagagaaggtgaaaatagctggaaaaaaaatgcgcaaagcaaataaccaatagaaagaaagccaagttgggctagcaaaatcagacaaaataaccttcgaggtgcaaacaactttgaggcccaaatagaggttcttcccactaaaagaatgattccctgaatgataatggaatcttgacccagcctgcacctcaggttaagttaaaagtggaaatttaaagatctaagtgtgagattttaaaaagcatttccccagaaataccaggatctgtagatggaaatgttattaagaataaagatgtggagctgggcgtggtggctcacgcctgtaatcccagaactttgggaggctgagactggctgatttcttgagcccaggagtttgagactagcctggacaacatagtgagaccccatctttacaaaaaaattaaaaaaaattagtggacatggtggcatgcacctctagtcccagttactcaggaggctgaggtgggaggatcacctgtgcccaggctgaggctgcagtgagccatgatcacgccactgcactccagcctgcgtgacagagcaagaccctgtctcaaaagaaaagaaaaaaaaagaagaaagaaatgaaaaccgtagctcagagacagagaaactgagcaatgcataggttcagaagggtttgaaacagactgaattgtgtcttggcatatgagagaggtcgcagctataaaacaatgagagaagaaaccaaattccacataggcaggactgagacaattggctgttcttgtggatgatacgtgatcaaatctcaacctcatgcgatacttttttttttttttttgagatggagtctcgctctgtcacccaggctgcagtgcagtggtgtgatctcacctccccgcaaacttctcctcccgggttcaagtaattctcgtgcctcagctgggactacaggcatgtgccaccacgcctggctaatttttgcatttttttagtagagacggggtttcaccaagttggccaggctggtctcgaactcctgacctcaggtgatctgtccacctcggtgtcccaaagtgctgggattacaggtgtgaaccaccacacccagcctcatgtaatacttaaaaatgaactacaggtggattacaaacctgaatataaaagaaaacttttttttttgaaaaatagagggaaatgtcttataacctcagagttaggaggtttttcttagatacaatacaaaaagcataaccacgcccatagtcccagctactcaggaggctgaggcataagaatcacttgagctcgagaggtggaggttgcagtgagccgagatcctgccattgcactccagctgaggctacagagtgagagtataaaaaaaaaaaaaaaaaagcataacctttaaaaatgggttagcctatgtctacatttaaataataataataataataatgttccaacttcaggctctgaaaaaagtcaaaagatgagctgtcaactagaagaggctccttactgctcataccaccagggaaagtttaatatgcaaaatgcagtcatccttcagaattcatgggggattagttttaagacgccttcttccccgcagacaccaaaatccacagctgctgaagtctctgatataaaacgtgcagtacttgcatataatgcaagtatatgttcctgtatatttttatttatttatttggagacagaatctcactctgttgcccaggctggagtgcagtggcgtgatcttggctcactgtaacctccacctcccgggttcaagagattctcctgactcaacctcccaagtagctgggattacaggtatgcgccaccacccccagctaatttttgtatttttggtagagacgggttttaaccatgttgtccaggctggtttcgaactcctgacctcacataatctgcccaccttggcctcccaaagtgctgggattacagggatgagccaccgtgtccagcctctggtatactttaaattatctctaggttactcataactcctgatacgctgtaaatgctatgcaaatagttgttatactatattattttttatttgtattactttttattggattgctatattttattttttgaaatattttcaatacaagactggttggatctatagatgcagaaattctggttatagagcacaaactgtgtatagatagctcctaccaaaacagacggatggtgaaaaaaagaaaagaaaagaaaagaaaaagaaaatggaggagagagactatgaggcgactaaaagaagagggatatgatcattccattcgctgacaagaaaaattcaaagaagagggaattatgcaattgaccagctgatgtgtgttagaaatgctcagggtcacacatattcattgaaagccaatttaagccactatttaaatttaaaccgatttaaacaattgggcttttttttttttttctaaaaaaaaaaaaaagtcaattaggccaggcgaggtggctcacacctgtcatcccggcactttgggaggccgaggtgggtggatcacaaggtcaggagtttgagaccagcctggccaacatggtgaaaccctgtttctactaaaaatacaaaagttagctgggcatggtggtgtgtgcctgaggctgtgagactgaggcaggagaatcacttgaacccaggaggcggaggttgcagggagcggagatcatgccactgcactccagcttgggcgacagaccaagactctgtctcaaaaaaaaaaaagaagaagtatattggttccgtctggaaaggtggagcacttgaagcaaaggcaggaagactggaagcagggagagggttttcaggtcacaaacaggtgagagacaaaacagttgccttcttttgagtttctgattagcctttccaaaggaggcgatcagatacgaatctgcctcagggagcagaggggggactttgaatagaatgggaggcaggttggccctaagcagttcccagctggacttttccctttagcttagtgacttgggggtcccgagatttatgttcccttcacagtgtatgagtgagagcacttggaaactgagagtggaagtgtcgcaggccaggtctcactaacacaggcccccacaacacctgtttcagtattgactgagtggttaaatattaaaagccagtgctgttatacaaaggctggaatgtaacaaaagcccaccgagagtttttcccaggactttcccgggccttaaagcatgacaaaataatgaatgaattcttaacaggacccatttaggattaaacaagttttactgggggtctgcagaaactccccaggcctccacaaacaagtttattggggctttgaaggaactctgcaaacctcctggatttagcaggagacaacatgagggtaatcaccccggcacctggacccattagattaagtcaatttactgaggctcctgaggaagatcctcaggactcagaccttagttatagattaaaagaagttaatcacttatgtctttagataaatgcacacacatatctccacatagcttggaaggtatataagctctggaaaactataattttgagttagtctggtgataatttccaggccttctccctgtaacaggttgcagaaataaaaactctcttcctccccagttcatcggtgtttcattattgggctgtgagaaatagcaacccagttgggtccgggaacagaaggtttggtgttatcttcatcacaggcactggactgtcggtaaatttattccatgacaattcttcctaggtttcttttttatattacttgcttccatcatggcagacagctacactggcttcttgccatgaaaacgaacttctagtaacaaaacggaaacctttttttttaagtttcaggtttcaaggttttacttctatctgcaaagtgatttttaaccagacaatggcaatctataaacacaccgtgggcagcaaatcagaacaaactgcaaggtcgatagtcacgctgatgagcttgtttctgcagcctgctcctaagggaaggacaattttcttttctaacagtgcaatgttgtttcctccacagatatctacccaaagccaaaaccaccttactacccacagcccgagaatcccgacagcggtggaagtaagaatccgcaggcctgaaactctttctcaatctggtttgatgatgtttgcctttttatttactagcaggtttagcctggttgcatttgaaatatgtgtgtaatagctcccttactgggaatgtagtttctttcctcactggggggagcaagaaagtccaacggacagaaacaatcttattttccctttgctttgacatctagaaaccactaaggtgtacttgtaaccacccaactggttcactttgttggctgcctagacagagctgatttatcaagataggggaactgcaatggagaaagagtaattcacgcagagccggctctaagggaggctagagttttattattaatcattcagtctctggaacatctggggatcagggttgttaaggataagttggcaggtaggggcttgggaagtggggagtgctgaccggtcaggttggaaagggaaccatagggggttgaagtgaggttttcttgctgttttctgttcctgggtggatggcggacctggttgagccagattaccgggctgagtggtgtcagctgatccatccagtgcagaggctgcaaaatatctcaagcaccgatcttaggttttacaatagtgatgttacccccaggagaaacttggggaggttcagactcttgcagccagaggctgcacgagccctaaagtgtaatttctaatcttgtagctaattttttggtcctgcaaaggcagactggttcccaggcaagaagggggtctttttgggaaaggggcattcttaattttgtttcagagtgaaaccacgaactgaattcgttcccaaggctagtttggctcacacccaggaaagaacaaggacagcttaaaggttagaagcaagatggagttggttaggtctgacctctttcactgtcatcatttcctcagtcataatttttgcaaaggccgtttgatactcaaaggacactttgcattatcatcacagaaagctaatcaggctgagagacaagtcctttctctcacttgttttcagtgctccaaatacctttggcttaaccattcccaaacccccacgtgtgctgtgcactttatgtgttttagagttggtttctccattttttctaacatttggcagacagtttttttccacagatttattacactcatcattgaaaaatatgcaattcaaaaaagaaagagagtgaacgagagagagaagagtggggaggggggtgggcatggagagagaaagagaaagagaaaagaaaggggaaagaagaaaggaaaagatagattctggccattaaagttatcagcagttcaacaaccttaaaaacttaaatgtttgccaggcagagcagcgtgaagctggctaaatcaagaggggttctggaagcttcctggtagtttgctctggctttaaactttcacagcttaacagcgtgtccattcattgcagacacgcacatccagatggacagaaattatctcctcttacaaggaatcattaaaaacagagaccaagacccaagggaggtgacacccacttgaaaaactacacctcaggccgggcgtgggggctcacgcctggaatcccagcactttgggaggccgaggcgggcagatcacctgaagtcaggagctcgagaccagcctggccaacatggcgaaaccctgtctctaccaaaaatacaaaaattagctgggcatggtggcatgcgcctataatcccagctacttgggaggctaagacacgagaattacttgaatccaggagaggaaggttacagtgagccaagattgtgccactgcactccagccggggaacagaatgagattctgtctcgaaaaaccaaaccaaaccaaaccaaaccaaacaaaacaaaaccccaaaacaccacctcacccttaactgcattagttaagccagctagtctttcttttttccccctctttcatgatgaaaatcccaaataccacccacctttttctcctgctatttcctcctagtcttttaaaaaccattgtcctgcggatcatggctatgttgcaaggcactcatgggaattccacagggaacgtgtttcttgctgaaacatacttgggaaacgcccagttaaacagactgccgtgggcttccctcccagagaattcatcaggacttaaaatgtgtggctgggcatggtgggtcacgtctgtaatcccagtactttggtagaccgaggctggtggatcacctgaggtcaggagttcaaggccagcctggccaacatggtgaaaccccatctctactaaaaatacaaaaattagtcgtggcctgtagtcccagcaactcgagaggctgaggcataagaatcgcttgaacctgggaggcagaggttgtagcaagctgagatggcgccactgcactccaggctgggcaacagagcgagactccgtctcaaaaaaaaaaaaaaaaagaataagaaaaaaaaaacttaaaatgcgagatcctttaagatgggccatcttcagagtgtgaacactcagcccctcccacagcaaagtgattcatgaaccccaataggaggaggagtgggggaagagaggctcaggctggggaggtgaccccccatgactcaagcctcaatctcctgatgcttgtcccaacaaagaggaggcttcctttccgactttggtttttcatgttgtgcttaaatccagccacactgatgcctttaacatggcagtcctgaattattaatcaatactgtgtgaatccaaaatatctgagacaggtctcaatcagtttacaaagtttattttgccaaggttaaggacgtgcccgtgacacagcctcaggaggtcctgatgacaagtgctcaaagttgtcaggacacagcttggttttacacattttagggagacaggagatatcaatcaatatgtataagaagtacattggtttgatctggaaatgcgggacaactggaagcaggggcttccaggtcacaggaagatacgagacaactagttgcattcttctaagtccttgatcggccttttactgaaaactcaatttacatgtgagacagggcaaaggaatagtacttatgcctcagtctggcccagtgaatctgcatttttcatcaacaatagggcagaggaagcaatcagacatgcatttgtctcaggggagcagaggggatgactttctgtcccacacctgtgaagatgagctgttggtgtacattgccagggtgaaattccacagaactgttttagggtaaacaaaacagtttactttcctcagattgtgaggacagtatgtagcttttaaaaaacttaaaaaaatttttttgtagctatcttatttagaaagaaaatgggaggcagatctgactaactttttttttccagcttgacttttcccttggcttaatgattttggggtcccaagatttattttcctttcacaattgaacatcagaacatggagtatttaacacaggaaatgagcaaatttaacgtacacacccaaggaaaaggaaaaatgaagctggttggaagttaattatggatagtgtggtatatgagcagaaattccccttaaccagtgttcttgcccaggctagcccaaatgagcccaggctagcctagattcccaagtgtgtatcttgagaacgaggaagagccctagaaaacaatgtgtaacgtccctccaagatggggtgttctggaacaatccctcagacaacgaaggcaattgttgatgggcaacattgggaagaccccagagatggaatgtcctaggcctttccatgttctctttctcattctccctccattgacttgataggtggctgggggatttataagtatttaccacacaccagccagctttctccggatggctccaggcatgcttggagcccagtggtctctttcccttagaatttgatctggaggaacccaaaattctctctgtgtcctttgaaattcagcacatttttcttggcttccatgagctcctgtggcatttctcaggccaactgttgactctgcttcctatgtctgtgcttgtccctttgagagatgtcagcgttgctcaccgattcttttctctgaccccagcagctcctatccatgttgtctttttttttttttttttcagacagagtctcactgtattgctcaggctggagtgcaatggcacgatggcatgatcttggctcactgcaacctccgcctcctgggttcaagcaattctcctgccttagcctcccgagtaactgggattacaggcgtgcaacaccacacctggctaatttttgtacttttagcagagacagggtttcaccatgttggccaggctggtctcaaactcctgacctcaggtgatctgcccaccttggcctcccaaaatgctgggattacaggtgtgagccactgtgcctgtcctcatgttgtcttgaaagtaacaagacaggcacggattctttttgatgcaagctgttatgggatgaattatgtctccccgcaaattcataggatgaagtcctaacccccagtttcctcagaatgtgactgtctttggagatggggcctttaagaaggagattaatgtaaaatgaggtcactagggtgggtccggatccaataggactagtatcctaataagaagagatgaggacttagacacacacagaggaaagattatatgaagacacagggagaagacggcatctacaagcccaggagagaggccttaggaggaaccagcccagaccatatcttgatctcacactcccagcctccaggactgtgggagaatcaatgtctgttgtttataagccacccagtctatggtgttctgtgacagcaacctgaaatggactaagacacctcataagaaggggagatgaggacgcagacacacacagagggacaatcctgtgaggacacagggagaagatggcatctgcaagcccaggagagaggcctcaggaggaatcagcccagcccacacctggatctcagacttccagcctccaggactgtgggagaatcaatgtctgttgtttataagccacccagtctttggtattctgtgatagcagcctgaaatggactaagacatctcataagaagaggagatgaggacacagacacacacagagggacgaccctgtgaggacacagggagaagatggtgtctacaagccaaggagagaggcctcaggagtaagcccaggaatcaatgcagttggaggttctgtgtgtgaatggaggagggaagctcacagatgaaggcgttttgagggaggactgaccttacagtgaggtacccagagacttcctgaaccaagccacgaatatgcagctcgtgctccgggcagtgccttctggcctggaaaccaaagctcccttgtgtccagtccccactcctctgtttggcccccaagtttccataatcccccacagttgtatcattttagagacctcaaaagagagtctaggctgggcgtggtggctcatgcctgtaatcccagccctttcagaggccgacgtgggtggatcacctgaagtcaggatttcaagaccagcctggccaacatggtgaaaccctgtctctactaaaaatacaaaaattagctgggcatggtggtgtatacctgtaatcccagctacttgggaggctggggccagagaatcgcttgaacccaggaggcggaggttgcagggagccgagattgtgccactgcactccagcctgggcaacaacagcaaaactccttctcaaaaaaaaaaaaaaaaaaagagagtctaggcagggcatggtggtccatgcctgtagtcctagctatactcaggaggctgaggtaggaggatcacttgagcccaggaggtggaggctgcagtgagctatgattcaccactgcactccagcctgggcaacagagcaacaccctgtctcaagagagagagaaagggaaagagagagagactattttgagaagtgaaaaaccagtcattctcagcccagatttccagtgttctgagacgtctgtcctgaggaaggactttgagaacagcatccttgccttttttgtgaattaaagtaatttcactcttgagccaatgtggataagcacttgacaggtactggcagtgccaggtaccaggaatatagaatgggtacagaaaataaagtttctagtccagcgacaaaaaggtgctgaagatacagactcatgtcgtgcaaagagcttgcactgattatttcatttcggcttcttgaatagggtcaaaggacatttaagctgagacaggagggacgagctaattaatgcttttccagatgacaaatggattcttcaaatatttagggagagtgtaaagtgatggacagggaacaggaggggtcatgacagaaggaatgccacctgcaaaagtcctggggcagggctgggcacggtggctcatgcgtgtaatcccaacactttgggaggccaaggtgggcagatcacctgaggtcagaagttcgagaccagcctgggcaacatagtgaaatcccatctctactaaaaatacaaaaattggccaggcgtggtggcacacacctgtaatctcagctactcgggaggctgaggcaggagaattgtttgaacccaggaggcagaggttgccgtgagctgagatcacaccactgcactccagcctgggcgacaaaagcgaaactccgtcttaaaaaaaaaagtcctagggcagaaagctcatggtaaacttgaggaacatgcaaaagtcattgcaaaaagttttaagaaattcaaatgaagccaggctcagtgtggctaatgcctatgatgattccagctctttgggaaggcaagacaggacgattgcttaagaacaggaatttgagaccaacctgggcaacatagcaagaccttgtctctacacaaattttaaaaattagccaactatggtggtatgcacctgtagactgagctacatgggtggctgaggtgggaggattgtttgagcctaggaactcgaggctgcggggagctatgattgcaccactgcactgcagcctgggcaacagagcaagactctgtctcaaaacaacaacaacacaaattcaaatgaaacggtgtaactcaagcaagatggaaatacaacacactatcaaaaggtcagatgtttcatcctaacatttatagaagtgactgacttctgtaaatggtgctggcatctgtagtagccctaaacagggaaaggtcaacaacgcactttctgccctgttaatttcagagagccctggacttcttgcgaaagcaccagtggtgtaagtttttgttttttcattgtaagctctgaggtggtattatgaatattgtctacatgattaataagctccgtaaaagcaatgggcagtaacatcttttctgtactttggcattcttatttatagatggtatctacctgaaagatgtcattatttttctgaaatcatactgttgttttccaacagatatctacccaaggccaaagccacgccctcaaccccagcctggcaattccggcaacagtggaggtaatgagtatttatttatttatttttattttattttattttattttattttactattttatttgattctatgttattttactttattttaccattttatttgattctatgttattttactttattttatttgattctatgttattttactattttattttattatttattttggagacagggtctcgctctgttgccctggccagagtgaagtgatgtaattgcagccttgaactcctgggctcaagcaatcttcctccctcagcctttcaagtagttaggactacagatgtgtaccacctacattgcaccacctatatttcaccacctatattggctatatttcaaattttttgcagagacaggatcttgctgtgttgttcaggctattcttgaactcccggcctcaagcaatcctctgcctcagcctcccaaaatgctgggattacaggcaccagctattgtggcccagcctgataatcagtattaaagtccattttagaagtgtttggggccaggcacagtggctcatgcctgtaatcccagcactttgggaagccgaggtgggcggatcacttgaggtcaggagtttgacaccagcctgagcaatatgatgaaaccctgtctctactaaaaatacaaaaattcgccgggcgtggtggtacatgcctgtaatccagctactcaggaggatgaagcaggagaatcgcttgaacccgcaaagcggaggctgctgtgagttgagatcacgccacagcactccagcctgggagacagagcgagcccctgtctcaaaaggaaaaaaaaaaaaaaaaagaagtgcttcacgcctgtaatcccagcactttgggaggccgaggtctcctcaggcagatcacctgaggtcaggagtttgaaaccagcggccaacatggtgaacccctgtttctactaaaaatacaaaattagctgggcagagtgacgcgtgcctgtaatcccagctactggggaggctgaggcaggagaatcgcttgaacccaggaggcggaggttgccttgagccaagattgtgccaatgcacaatctatctaggtgatagagtgagactctgtctcaaaaaaaggcgggggggtggttggatacaagtattatttaatgacttaaaaattctcatctccatggtgaaagaccaattgcttttgaaatgcacagacattgttttgcgaggagttcagttctactatccaccagcacctggggattacatttagttgatagtaaataaatttaaatgtttttgatgacattgactgaaaaataccatgcacactaagacatttcaagttatgatggaggaaggcaattttttcttgtttttttttttgttggtctgtgttctactcacttattcttccctctgcaagagttatctgcggccactttgcctgtgttcctacagcacttcccatctccgccttggcaattgtgtctcacgaacgtgagacactcaggaaagagatgctggtctgtaaagttggaagagtctcagcgattccattggtggggcaaatgtgtgcagattgaggaagctaagatacactgggtgtcttcctctctccacctgctttaaccattgggagttcccctgattgtgattgtttcaggacgttgcttggatgttgtcatattcctagggttcaaggcactccgtgaaatccaaggaaacaagctttgggtatgtcccagtgccttttcccttgggtcttgcaactgaagaattgtgtttcttccctagaaaaacgaacacacttttgcccactcacccacctcctgcaagtctccaaaaccacagcgttgtatcctagactatgttcccccaggaggtggttcctccctctgcattcccgtactccatactgcttgatatgttcttacatgcaacaccgtgcaattgtgtttagttgattcctgtgaattagaatgagaactctacatgggcatggatttttgcctttcattcactgctgcattccctagtctggaaagctgtgcctggcacacaatgagtcctaggtgaaggtcagtgaagtcattaatgcttgagtcccaacaggcaaacagctggattcatgaatgaaagacttaccgctacatcccttcatcagggtgtatagcttcaactccatttcctggaaagctctacaatagttcttcctcctcaaaaggctctggtcttgtgattcatagcattcgtccaccaagacatgaacaagggatctttatgtcagaggttccctgttcaaagctgttttagaggccaggcgtggtggctcattcaggtaatcccagcactttgggaggccgaagtgggaagaccacttgaggtcaggagttcgagaccagcctggccaacatggtgaaaccccatctccattaaaatacaaaaattagccaggcatggtggcatgtacctgtaatcacaactacttgagaggctgaggcaggagaatcacttgaacctgggaggcggagttcagttggagttgcagtgagccgagatcatgccattgcactccagcctgggtgacagaacgagactccatctcaaaaacagtaaaaataaaaaagctgttttaggaaacatcccttttttattattttttctttgagtcagggacttgcttggttgcctaggctgaaatgcagtggcgggatcacagctcactgcagcctccacctcctgggctcaagcaatcctccgactttagcctcctgaatagctgggactacagacacacagcactccacctggctaattttttcttttttctttttctttttctttctttttctttttctttgtgtgtgtgtgtgtgtgtgtgtgtatgtgtgtgtgttgggacagggtttccctctgttgcccaggctggtcacaaactcctggccttaagtgaccctcctgccttgacctctcaaagtgctgggattacagatgtgagccactgagcccagccctaggaaacagcctcttaagccaagtgcaatgactcttgaactccccagagcctctgtgcatgctacctcgacttcagcttcacagatgtatgcaactgcgggatcaggttaggggcactcacttaccggcagtcccaaagctctggagagtctgtgctgagggaatggtccatgttaaagcaaagcagaacaaccactctgccttttgtattttatacttgttttttttttgaaacagggtctctctgtgtcactcaggctggaatgcagtggtgtgatcatagctaactgcagcctccagttcctgggctcaagtgatcctcctggcagatgggactacaggcgcacaccaccaagcccagataattttttgtatttttttgtagagacagggggtctcactatgttgcccagactggtctccaactcctggcctcaagcaatcctcccgcctccacctcccaaagtgctgggttgcacccggcttgcatttcacacgtttaataaactcaatcagcatgtttcctaccccctagagtgacaatggtgcacattagcatggatttcttatagatcgagaccaaagacctaattacttatctatagaccaatcttggagaggaaaggcagactccaagggttaattcggggtccaggaaccacagaaggaaggtctccttggatctcgtttgagcctgaagtagctcagtctatgacagacaccatcagagggcagaggcacaggtgaacgcagcagtcggaactttgtcagagcagcaaaggacatcttaggaaatgaggcttgcaaagcagccttgggttattgagaaagctctctcagcgtggattctcagggctctgggatcttctctgccttgcaggtgcctctttgttttttgggaggaagcaggtgggtctcatgtgtcagggcagtaaggagcaggaatgaatggatgaaacaaatctgttggggtgggtagcggctgtgctctggggagccaagagagagacagggggatggtgctggtttcagacaagatagttgagcaggaacttgaaagagaaaaggagagtggatcgtggggacctgagaagctggaattctccctggggaatcggccactgccaacgtgagggctggggttaggagcatgcctatggtgatggagaagcctgggggaggtgcctggttgatggggcaagaggagccatctggagagaaggaaaagcctggagtctccttccgggcttgcttaaggactagggaggggcaggacatgagatgatgttggaggattctgagcaggggatgggcctaggtgggaggtggggcagaaggagagctggacgaggacatggtgagaggtgatgttggctcatccaggaaggacggccaggaggaagcagagggaaaggggcatgcaaaggtccagaggcaggagcaacggggaacatccagggaaggagggaagggcaggggatttggagatggggcaccctgagagagggatccaggcagcaggcagacacgacagcctgagcttcaccccagctcacggttggccctgggagggctttgagcagaagaggggcaaacatcagcaatatgaggccacactgcagacgttctgggccctgcacacgcctccttgcaggcaaggcggccagcccacaaggtaatttaattcctggtgcctgtgggcgtcctgcaaagagccagttggcgtcggaacgctcttctccaaaacctgtgccagtgcccccagcgcagacctggtgtgaaggggacctttggagaggtctcatgagcaatgccgcgtgctctgccccacaggttacttcaatgatgtggaccgtgatgacggacgctacccgcccaggcccaggccacggccgcctgcaggtaggtgccgagcctccccagatgcgacacattgaatttgcacagagagggtgggatgagaggcctgaagttggggatgagagagctgaggttggggcagagttggtgacgagcagacgataagctggtgcaggggatgacagagaaggccccatggccgcatcagtggggtttgcggtctgggcatctgtccgcctctccaggctgggggactggatggaaacaaaatgaacaggcagaactggagggtccactgaaacacttgcggtcatttctgtttagacttgtatatgtgtaagtgtgggtgtacatgtccagacacacctttatatatctgcatgcttatcaatcttcatttgtgtgtatatagatgtttatgtatctttatatttgtgtgtatatatgcttttaaatatatataaatgcatctacatatgtaggtatatggtttttttcatgtgtgtatatacatgcttttgtatatatacagtacgtggatacctttctctgtttttatatatgtatatcctgactttatatatatccttatatatatctttacataggtacatgttttatatgtgtatatatatctttatatttatatgcagatatatgctttttatatatatttatgtatatgtatatcgtttaatatatctttttaaaaatatatcttcatgtatatctttaaatacatatacattttatatacattttaatattttatgtgtatgttatataaatatatatctttacatatataattaaatatatgcctttatttatatacatctttatatatgtacatatatacctttacatgtatgtgcctttatttatatatgtatatatttatatatacacttttatatatacatatgtgtatatctttatatgtgtgtataaatgcctttatatacgtacacatatacctttatgtgtatatacttttatatgtgttatgtatgtacacacaactttatatatacatgtgtatatatctttatataggtatataaatgtctttaaatatgtatatacatatcttttgtatttatttatttttttttgagacggagtctcgctctgtcgcccaggctggagagcagtggcacaattttggctcactgcaacctctgcctcccgggttcaagtgatgttctgcctcagcctcctgagtagctgggattacaggcgcctgccagcacgcctggctaacttttgtatttttagtagagacggggtttcaccattttggccaggctggtcctgaactcctgacctcgtgatccacctgcctcagcctctcaaagcgttgggattacaggcgtgagccactgtacctggtctatatgtatatcttctaatgtatctttatatatatctttaatatatctttatatacatgtacattttatatacatttttatattttatgtatgttatataaatatatacatttatacatatataattatatacctttatttatatatctttatatgtacatatatacctatatatgcttttatatatgtatgtgtacatttatatatacacttttatatatgcatatgtatatgtctttatgtgtataaatatcttcataaatatatttatatatctatacataacctttatatatgtataaatatcttatataaatatatattttatgtgtatatatgcattatttgtataaacacatatttgtaaatgtctttccatatatatgcatatatagcttacatatgtttctatactgttatatataggtgtatacctttacatatgtatgcatactgttttatatatgtgtatataggtcccttcatgtatatatgtatatacatttaggtatatgtgtgtgtgtgtgtgtgtgtatatatatatacacctttatatatgtacatttatctttatacacacagacatatataaacacttctaatataaagttttctctgtaattggaggtgaatgtctatcaataatctttcatatagaaatacaagtacagactataggagacagagatgcatacaacattgggctgaagagtgtgatgtttgaggctttattttcaagcatgtgaggtttctggcctgtttagttctgcaattttattttagaagacataaaggacttgtcccagatattttgcaaagctggacctgcatctttcggacaaccagattgcatccagtcatcttttctgccgtgtttacttgcaataaataaagagcgctgtcttaggatttattacaataacaatcaggaataaactaaaaattactagttatttttgaaaggagaagctgagaacatttacgattgagaccatctgctggaaggtcctcctaatccggcgtcggcgtggctgatctcatatcagtttctcggcaggaagcgggtgcgcctgcgtgaatttggagtccccagggtaaatgttagtcccgtgacggcaaagtgtttttgatagctagagctcagtgttggcatgagttttcccacggggaagaggaagctttggtggggccacccttgactctcccctgctggtcactctttggagctctcttggcagtgacacgttcacacgacttgttgccattcccaatgagctggacagaccaacacctgcaggaaaccccacgctcagacacctgaacatccctcaactctaccttctctgtctaacaggaggtggcggcggtggctactccagttatggcaactccgacaacacgcacggtacccctacatctgggcatgcgatggtgggtggagggtgggaggggtcatctttctagggctcccgcttgcactctgccctgggccttctacctggagtctttggtgagtagggtgctgtgtgctggtgcctggtcttctgagaacctgtctgtgctgggctgttctgcttctgttccccaggagggtgggtgcagccacacatacacacacgcatacacacatgcacacacacacacacacacacacccctttaggtaaaagtaaacagagcaaagaactatacaactaattagagaaagagagcatccaacaaactggagagcatccaacaaattctttaggggcgcagctcgcttacttcaagcagaatagaaaacactttcaatggctgggcgcggtggctcatgcctgtaatcccagcactttgggaggctgaggtgggaggattgcttgagcccaggagtttgagaccagcctggacaacatggaaaaaccctgtctctacaaaaaatacatatatgcaaaaattagccaggcgtggtggcatgtgcctgtagttccagctactcaggaggcagaggtaggaggatcacttgagcccaggaggtcgaggcttcagtgagcagacagagataagatcgtgccactgcactccagcttgggtgacagactgagatcctgtctcaaagaaaaagaaaagaaaagaaaagaaaaaaagcaagagaactcttttggtcggtgcttatgcccagagtgaaagccgtgttctacagaagccataaacaggctcttggcttggttgagtttttctcatggagaccaggggaccttgaaaccctcagatcctctccggtttggaaaacgactgaagcaaaatgtcatcactgagaaagaaaacaataacaaaacactctgtaggttgattttaaaccatcatctccgttttaacattttccctttgttaagagttttgtacaccttcaatgaattgagtaaccatcttttcttttttttttttttttttttgagacagagtttcacttgttgcccaggctggagtgcagtggtgtgatctctgctcactgcaaccttggcctcccgggttcaagtgattctcctgcctcagcctcccaagtagctgggattacaagcatgtgccactacacagggctaatttttgtttttttagtagagacagggtttcaccatgttggtcagattggtcttgaactcttgacctcaggtgatccatctgcctcagcctcccaaagtgctgggattacaggcatgagccactacacctggctaatttttgtatttttagtacagatggggtttcaccttgttggtcaggctggtcttgaactcctgacctcaggtgatccgccctcttcagcctcccatagtgctgggattacagacgtgagccaccatgcccggccttgagtaaccatctttttggttaaaactaatatgtgccaagagctctggtaatgtgggaagtacttttttttctttttctttctttttttttttttaagatatggtctcattaggctttgtgagagccaaggctgttggccccctaagttttctctgaatcactgacatgaggcagcttaattaacaggagaaaaagcgtataaatttattgagtggatatacacgcaaaccttcagaaccaagactcaaccaccaatgggatgcaaaagcttatagaccatcttttttaactttgatgttaggttcaggggtccttgtgtagggttgttacataggtaaattgtttgtcaccggggtttggtgtacacattatgtcatcacccaggcaataagcatagtacctgataggtagtttttccatcctcactctactcccaccctctgccctcaagtaggccctggtgtctggtgttcccttctttgtgtccatgttgtcaatcgagaaaaatgacgagacgagcgtaaaagatttatttgccaaagttaaggttaagggcgcgccccaggagacaggtctgtggccttctccgaagatgattttgaaggctgcaaatttaaaggggaaagggtgggggtagggaaaaagagttattcatgcttttgtctggctcagtgaatctgtgtttttttacataagatggcatagacaaatggggcagagggaaaatgcagggaatctgcatgttgcataagataatctggacaaaatggggcaggggagcaatcacatatgatttgtgtctgctgggcgggggtgactgcaaagctgtcgatttgcatattgtcatggtgaaatcttcacagctcactaggattttccttgtgggcaaaatatgggggagacgtgtagcttttcatcttgtagccattttatttaggaaccaaaagggggaggcaggtttgtgtgacccagttcccagcttgacttttccctttgactaaatgagttcaggatcacaaaatttaatttcctttcacaatgcgtactccgtgtttagctcccacttgtaaatgagaacacatggtatttggttttctgttcctgcattagtttgctcaggagaatggccaccagctcgatccatgttgctgcaaaggacatgatcttgttcttttttatggctgtgtatatgggccacattgtatatgggccacatttcccttatccagtctaccattgatgggaacctaggctgattccatgtctttactatttgagtttgctatttgttgttctttgcaggaagaatgtgggctcagagcatggccccaaataggtgacgttggtaaagcaggtttaacgggtggcaagccaggtgatgagagggagacaggaagaggcctgcttagcaagggggtccttgttatgcagatgaaggttcccaggtagcagcgctcagagacgaccatggtaaatgtttcttttcagacctgtaaaggtgtcagagtctccgtttctctctcctacatccaggaaaagcttagaaagggaaggcctggctgcaacagcaaagatcctctacagatgccaatttccccacctcagtctgctggccctggagcggcaatttcaaaataaggcaaagcaatatattttggagtaaaatattttgatgtccgtcatcttcgttacctcggaagcgagtgttgtcatcagatccatttaacaaaatgaaagcaatgcatgacgctcgactgtccacttcaaaggagcaatagctgtggccctataggtagcccatcctcagaactcactccctatgacacagacaagcttcaggatgggagggggctcatgacaaagtgctcattacctggggtcaagaactgtctacttttggccgggcatggtggcccacgcctgtaatcccagcactttaggaggccaaggtgggtggatcccttgagttcaggagttcaagaccagcctgggcaaaatagtgaaaccctgtctctacaagaaaatacaaaaattagctgggcatggaagtgtgcgcctgtggtcccagctactcgggaggtgtaagtgaccctggaagtttgaggctgcagtgaaccgtgatagcaccactaccttccagcctgggccatggagtgagaccctgtctcaaaaaaaaaaaaaaaaaaaaaaaggacactaaaaaagaattgaccaccttcaactcaacgtactatgagatgagttccttccaccatctttctggaactagctaaggggttccccttacctactacctaggtagacctgatttattaagacgggaatcgcaatagagaaagagtttaattcacacagagctgactgaacgggagcatgtgaagcagctatgctgtctggggtacatacctggggttcattgttgcacgctgagaaagaattcaggacacagacacatgtggttgggttaaggagttgaaagtttaatagaagaaaggagagaggagagcagctccttgcaagagagagagggagagagagaaagagagagagagaaagagaagcatctgaaaaagttgggaggttgtggaccgcagcagcttttgtaggcaggctggaggaggtggtgtctgatttacatagggcttacagactggttcgatcaggtatgacttctacatagtgcgtggggaaggctggtggccccaccctaattttgttatgtaaatgggctttccagttggtcagtgccatcttgtctgctacttactgtacatggggctgacaaagaggagggaagatgaagctgccatcttgaacgtgtctaggccctagttcctgccggcattcacccatgtaagctcctagctggcttgtctatgtctgcagctcaactttattttttattttttatttttttttgagacggagtctcgctctgtcgcccaggctggagtgcagtggcgtcatctcggctcactgcaagctccgcctcccgggttcacgccattctcctgcctcagcctcccgagtagctgggactacaggcgcccgccaccacgcctggcaattttttctatttttagtagagacggggtttcaccgtgttagccaggatgatctcgatctcctgacctcgtgatccgcccgcctcggcctcccaaagtgctgggattacaggcgtgagccaccgcgcccggccacagctcaactttacaggctgctctttgttagaaaatgatttggggctgcttttcattaaaaagaaaagccttaccaaggactcccatacccttgctatgtgcctaagtaattaactaattccttcttaactcctatatcaactggaggttttgcttttttttctttaaacagggtttcattttgttacccaggctggactgcagtggtgaaatcatagctcactgcagcctcaacctcttgggctcaagcgatcctcccgcctcagcctcctgtgtagctaggaccacaggtgtatgccaccacacctgcctaatttttaaaaaatttttgtagagatggggtctcactatattgctcaggctggtcttcaactcctggcctcaagtgtttctccgacctcagcctcccaaagagctgggattacgggcatgagccactgcacctagccaagactggagttttatgactcaaatcagcttcccccaaaatttggacactgggctttttaacgtgtaatttggctggtaggagacccgggcgtggggagtgctgagtggttggttggaggtggaatgacagaggacggacatgggttctttttgttgtcttctgttcttgtgtgggacggcagagctcgctgagccgcattaccagtctgggtggcgccggctggtgcatctcaatgaagggtttaaaaaatgtctcaacttcaaccttaggttttacaatagtgatgccatccctaggagcaactgaagaggtttggaatcttgtggcctccggctgcatggctcctaacctattaatataatttctaatcttgtgactaatttgttagtctttcaaaggcagtctgatccccggggaagaagggagtttgtttcagaaaagggctgttatctttgtttgaatgttaagctggaacttcctcctatggttatctgagtctgtgttcaggaatgaactagggctgttcgagggctacaggcacgatgcagtcggttaggtcagatctctttcactgtcgtaattttctcactgttataatttttgcaaaggcggtttcaatttaactgaaaatgtcaggcaaagaccaaatttaatatttttacagaaagccactgggagtagttttttattgttttattatttatttatttagagacagagtctcactctgttgcccaggctggagtgcagtggtgcaatcatagctcactgcagcctcaaactcctgggctcaagcgatcctcccacctcagcctcccgaggagctggggctacaggcacacaccatcatacccagctaaatttttaagaaattttttgtagagatggggtctcaccgttgtaactgcccaatgggtttaccttgccccctgcctaaacagggccgatttatcaagacagaggaattgtaatggagaaagagtaattcatgcagagccagctgtgcccgagaccagagttttattattactcaaatcagtctccccaggcattcagggtccagagtttttaaagataatttggcgggtaggggcttgggaagtggggagggctgattggtcaggttgcagagggaaccataggggggtgaagtgaggttttcttgctgttttctgttcctgggtggatggcggaactggttgagccagattaccgggctggctggtgtcagctgatccatccagtgcagaggctgcaaaatgtctcaaacaccgcgcttacgttttacaatagtgatgttacccccaggagcaatttgcagaggttcagactcttgagccagaggctgcacgacccctaaaccataatttttcttttcttttcttctttttttgtttttttcgagacagagtatcactctgttgcccaggcttgagtgcagtggtgtgatctcggctcactgcatcctctgcctccctggttcaagcaattctcctgcctcagcctccccagtaactgggactacgggcacatgtcaccatgcccggctaattttcatatttttaccagagacggggtttcaccatattgttccggccggtctcgaactcctgacctgaggcgatccaccctcatcggcctcccaaagtgctgggattataggcttgagccactgcgcccagccctaaactataatttttaatcttgtagctaatttgttagtcctacaaagtccaactggtccccaggcaagaaggaggtgttttcaggaaaaggctgtgatcagttttgtttcagagtgaaaccatgaactgaattccttcccaaagttagttgggcctatgcccaggaatgaacaaggacagcttaagggttagaagcaagatagagtcggttaggtctggcctctttcactgtcatcatttcctcagttacaatttttgcaaaggtggtttcgccacgttgcccaggctggtcttgaactgggctcaagcgatcctcctaccttggcctccataagtgctgggattacaggcctgcaccaccacatccggcccaccttggagcgtgttatataaagcgagccgtccccacacccctacagcctacgaatgagccttttcaccccatgcacgattctctgaaactgctctctgtaaggagctattcgggacacgttcttttgttctctggcatactcatcaggtagaaagaagtgattcagcaagcggctcccctgagagccctgatcgtttcctgttttcctgtgaagttagtctcgggaggtctgcgctgtgccatttttgggggaccattatctggctcccgaatggatcaaagcttactggtcagggggctgctgtatccctggggcaaaactgccagaaaatagcaggtagccctgtggtccttggcagggccagggcccggtggaagcagcagctgggccaagaacatcaggcgtgcatgaggcacagcccagttttgggagcatgacgcttgttttcgaggatgcctgtgctccccttcctgcctggacccctgctctccagccccggcagagcgaggctgtgagtcagcgctcggattagcatcagcatggaggtgccggctgggatgcaagccgccgccatgggatgagtcacgcggcttctccccgaatccccaaaggaggcagagcgtgttaggcttgttctggcttcatgcagagcactgaggggtgagggctgaccgtggctggccgcggagggaagcccaaagtctggcctccctgcggagactggggagaaaatgttgcgctcgtcgtttttaaatactgggggacaagtttcccttgtctgctaaggctgccattgtaaattacaagagtcaggagggctgaagcaaaagggatttcttctcccacagtcctggaggctggaagtctgagatcaaggtgtgagcagggctggttcctcctgaagcctctctccttggctcgtcgacatcatcatctccctgtgtcctcacagggtcgtccctctgtgtgtgtctgtgttccaatctcctctccttatgaggtgtcttagtccatttcaggctgctatcacagaatactatagactgggtggcttagaaacagcagacattgattctctcaccgtcctagaggctggaggtccaagatcaaggtgtgagcagggctggttcctcctgaggcctccctccttggcttgtagacaccatcttctccctgtgtcctcacagggtcgtccctctgtgtgtgtctgtgtcctcatctcctcttcttataaggtctgtagtcctattggattagggcccaccctagtgatctcgttttattttaatcacctctctaaggacgttgtgttcaaatacagtcacagtctgatgccctgggggttaggactgcgacctgtgaatttggagggggatatagttcagcccatagaacccactatccacataagtcattccacttcaaaatcagcacaaagcattagttttaaaaatctcaaatctgtatttttaaaaattgctcttaacacattagaaaaatatagaaaaactttttttgctgtttttctgagacaaaatctcactctgtagcccagcctggagtgcagggacgtgatcatagatcattgcagcctccacctcctgggctcaagcaatcttttgcctcagtcgtctcccaagtagtagctgagactacaggtgcacatcaccacacccagctattttttttttttaagtagaaacggggtctcactatgtttctcaggctgggctccaaatgagctcaagtggtcttaccgccttagcctcccaaagtggtaggattacaggtgggagccaccacacccaacctggaggaactctttttttttaaaattttaaataaattactatttgtggcctgcgttttcatcctattctctttttttttaaccaacatttgctggcatttttttttatgccgaagaaaacacctttgcccatctatgtcaggcctccagaccctcagggatgtacatctaatgcaccttcagccaccggtgtaaacagtaaacaggggccagatggcgcctgtgcaccttccctggccttgggagagcattggaatctctgcagcttttaagagcatcttgcttcaggtttgctgacctgcttgcttctgtaagatcatgcagacttcctgagcaatatctagcatttcatggtctcttttctatcctgcaggaagagggggctatagactcaactctcgttatggaaatacttatggtaaaggaattatgtcttacagaatatgtgaggcaaaactgtccatttgcaaataactaacacactgtctgcactgatgggaagctgatgctttcatccagtgcacaaccaactggccgttcgagtctctcatttgcattttccttggtcatccatgctggggggagatgttgtgcatgccctgaggacttcatttcttcaaaggaactatggcccacttacaggtgttactgggtgcatgtgtgtgcacgtgtgtgtgtatacatatgtgttcacacacaggtatgcttgtgtgtattgtgtgtgcatgcatgtgtacatgtgcatgtggattttgtaatcatgtgcataagtgcatgtggatttcatgtgcatgtgtgcaagtgtctgtgcacacatgtggattgagcacatgcatgtttgtgtatgtgcacagatgtgttggcatgtacttgtggattttgcatgtgtgcatgcttgtgcttgggttgcatgtgcattgcatgtttcccatgtgtgtccattcacatgcatacatttaggggtgtgcaagcacatgtgtgcatgtggatagatgcaggagtgtgcatctgggtgtgctcgtgtggtatgtgcatactgcacgaatatatcatgtgcatctgtgcatgtggattgtgtgtatacatgcgtgtgtacaggcatgcacacacacacatgaatgtgtttgtgtgtgcatatttgtgtgtacatgcatgtgtttatgcatacaggtgtaaacatgtgcacacatcggtgtgtgcatgtgcacacatgtgtacatgtgtatgtttaggcgaattgtgctttatatgtgcttttgttgcctgtgtgtgtggtatgtgcatgtgtgtgtatgtggggatgtgtgggatgtgcatgtgtgtggatgtgcacattgcattgtgcttctgtgttgcatttgtatttacatgttgcacatgtgtgtaaatgcatgtgtgtgtgcacgtgtgtatgcgtgcttgtctgcctgtgtgttgcacgtttgttgcatgctgcatgtgtgtatgcatgtgcacacacatttgtgcatgtcagtgtgtgttgcatgtgcttgtgtatgaatggcgtgcgtgtgtgcatgtgtgtccatggggttgtcagcctgtgtgtgttttgcatgcgcatgtatgtagactctccaatcctgaaattaaagctgcatctccctctccctggtattatccccattctgctaatgaccattagacatggcatacacattcacattcctcctccttatgctgcttggctgtccccctccccccacaagaatgtaaattccctgaaaacagggatctgtgtgctgtgttcacagtcgcatcctcaacagtgcccggcaatataaggccctccataagctctgctgaataaacacgaacatccttttccgcttacaggtggagatcaccattcaacgtatggcaatccagaaggtaactgattgactcacccggtcccaacctttaataagagcacactctcctagatcagtgctgggaggagctgtgtgggcttctgtttcccaacctcatgactttcacggagcactcatactttgtatgtatataaagtagctcctgaataaaaatatctgaccttcagcacaggaccaatcagagttcagagaaaggagaggcaagcattggttttcactgcagaagatgccccttagctctcaaagcaaggctgtgaatgagtgctgagactattacatttctcccagtaccaccattactcccctttctttgaccagcactaacttgaaacccaagaaggacaggagaaaggaaggtatgaacactctgcccaaagaagccatcagagtgcactgtcaatcccgtctcaggtcaaaggagggagaacttgaagcccagaaggctgactttgtgtcctgtattgttgggagaacaggttccccattccctaagggtcatattcttagagatttgggctgacacctgcttgagtttaagttgagagtaaacgcactcaaccccaaggctcttgtgagttttcaattatgggggaggagaaagtgattgaaggtgacctctacctttcaatgatcatgcagagtactagtatcaatatttttggggtatgttggcatccttagaaaaatttatggtttcacctttttccctctgtggtgtaaagtgaggtccagagatggaaagggcaaggcaaataaacaagtaattgcagtcaaatctgatgaataatttcctggaacatatgggatcctgtagcaaggcagaagggatactcctagactaggttaggtgagggaggtagggtttcctggagagaacaatatccaagccaatcccccaaaatatgggtgggaggtgcccaggagaagagtgaggtgtcagggaagatggtgcactaggtagagctggatacacacgtggggacaccggaaattgtgtagccaggatgtggaatgcaacgggaaccagggaaggatgcaatggtgaccaggaaagacctccaggttagcagaggtggagtctgcacttcatagaaccttcatgggaaggagcctgcccctgttgatatgtaggtgaagaatggacctgagggggctcactaagacccagggagacaccctttcagaccagttcagtactccctggaaatgatgacaggctgaattaaagcctgggcaaaggaggcaaagagaagcagtcagcttggatgaccacttggtaatgacaattgattgtacttgattgatttgtaagagatgagagagaggaaaaggtatgtatcagtcagctatgctgtgtcacaaaaaaccccaaaacttagtagctggaaataacaaccatttattatgttcgtgattatgtgagtcagcaatttgggctgacaccattctagtggtcctcctggtctcttctgaactccctctcttgtgtgcagtcaactgtaggtgtggccagcgctttgaccatgtttcctgggtcttcttatgtatctgggactttaggtggaatggctcatctcagcttcatgtgggctctcacatccctccaggaagccaggccaggcttcatcacatggtgaccagacagggtaccaagagcatgaagagaagcgtgcctgggcttagagccaccatgccttcacttgtgtgacattctgttggctaaagcctggattttcagaatgaagatgcagctccacctctggatggggaacactgtgaaatcatactgtggagcgtgttcatgtagggaggggaagaatagagggctgtctctcccaggaggcagggtgtggcgggcggcagcatcagccgtagagcaggttcttgcgttcagtgacaacactcttccccccagcatggcagcctcattcgtggagcagtcttgtgtccctcacctatgccatgccatgtattggcccaggtgttcaaccctgtctgaagaaagccatgcatggaaagggtggctatttcaaatggaaacggtgatttcttccttttttccctttggaagtgttgatttttgtcacatcaagctccttcttgttctttgtgcaggagtgccaaagctctggagcaatttgccatcgaggcattgaggatgcttgtgtctagtgtgtgcttgggtctagagttccagcatgcctttgaaagcaagcctatctggcagtttttagtggaacaatatttttgcatgagtgggcattctacatctaaaaaggcacaaaatagttttgacatgtgcctgtcatcccaactactcaggaggcggaggcaggaggatcacttgagcccaggagttcaggacgagcttaggcggcatagtgagaccccatctctaaaaaaataaatcaggccaggcgcggtggctcccctctgtaatcccaacactttgggaggctgaggcgagtggatcacctgaggtcaagagttcgagaccagcctggccaacatggtgaaaccccatctctactaaaaatgcaaaaattagttgggcatggtggcatacacctgtagtcccagctattcgggaggctgaggcaggagaatcgcttgaacccgggagaaggaggttgcagtgaactgagatcacgccactgtattccagactgggcgacagagcaacattccgtctcaaaaaataataagaaataaataaataaataaataaataaaattaattaaaaggcatacatgaattgacttcaacaaacaaacaaaaatgccaagtgcctcgtctgtgcaaatcctggccttggatgtcttcagtggtaaaatgtggttgacaagcttggctctttgtgaaaacagaattacttcctaaggtttttttttctttttttttaaattaagtttctcttttttttctgtgaatacaagggtgggaagggacgtgatggagaagttactagatagatgcaaaagttattgcagtttttgtcattactttcaatggcaaaaaccgcaataacttttggaccaacctaatatttaagcagttttcctgcagccatgtttttttctcggatgagcttgctttttctccactcctgcaggcaatatggtagcaaaaatcgtgtctcccatcgtatccgtggtggtggtgacactgctgggagcagcagccagttatttcaaactaaacaataggagaaattgtttcaggacccatggtaagtttggctctaaacattgttttgcttgttactaagcctgatttaaaaaaaaaaattactttcagatgtctgtcactagcaaggttatttctggttaagttcaatatacataacttgcctaataatgtgattttttaaaatttatttttattctttttgagacagagttacactgtgttgcccaggctggactgcagtggcaggacctcggctcactgcaacctctacctcctgggttcaagagattctcttgcctcagcctcccgaacagctgggactacaggcatgcaccaccacgcctggctaatttttgtatttttagtagagatggggtttcaccatgttggccaggctggtcttgaactcctgacctcaagtgagctgcccgccttggcctcccaaagttctgagattacaggcgtgagccaccgtgcctggccaacaattgggttttcatggtcaggtgtgagctgtaccttcctctaaaccttgttacaatgaggctggcacattatctgtctaatgtaaaagaggaggagaaaaaaaggaaagaaaaagaaacaaacaaacaaaaattaccaacctacattgcaagactataagcatgacggttggtttaactacctgttctgttttgtattcagtgaaattttcgtcacaggcgagtcaggaaaaatacctgggttgaatgtgaatgttttgcccagaaccccacccgcaaagaaaactaccgaaacactgaattataagcctctctgaaattccgaaggtgcgctcagaccataggggagaggaaagatctgctgtggcttcctggttcaatgccggctccacactcctgggtttgaagaatcacttgggatttgagagcagaggatgccctaaagaaatctctgaaacaacagtcagggattgttttatagcctaaagagtgactcagatctttaactgggtgtctctggaggcttggtttaaacctcaggccacccacgtcagaatctgtctggagtttgcccagggccctctaactcataccttctttgtgtccccgaaggaaaccagaaaggggtgcccattcctacggtgtttgctttaggatttgcatttggcctcaaaaatcctaaaaccttcccatgcgctccctctgctggtgaatgggcagtatcaaccgttagctaatgaacctccgtttggggtgagcctccgtctacattacgccccgtcctgaaattttaggaggaaactgagtttctgaaaaactgccttattttcctggcaacctgagagcagattcttgggttcagtgacaacactctttcacccaacatggcagccatcattaacgaacaccacgtgttaacttcagtagcttttgtggcagtgatttgtaagcctttgttaaccaagggctgaaactgagtaagcagagagaggcacccatctccacaagcacaaaatgtaagggcggggtacaggggtcccccacaaactcaataatcaaggcaaatatattttagtgcaatattttagaaggaaaatcattggaatgggggccagttgagtttctgaaataggtgtagttttaaaaacgtggatgatgcctgccccatttatctgaggtggaaggaagcacgtttttgctaaagaggtataatgtcttgaagctctttcatgccttttggctgcctggtaagtatttttgtctactttctccattgtacttcgatgataccctcaccaggtattcccaagcaccaagtttatcttcccctcccttaaagttcctgagatcagaaaggaggatgtagacagagtgagctgatgttagggagatctcttcaagggtgagcagtgacatttatgtggatcctgggcctatatcacctcgctggctgtaaagcctttatactatctaggaaatatgtgcatgacagcaaatacgtatgggtttggtatcaaatggggctcagagctctgcgaacttgactctaaagttccaggctgctgctaatggtacccagctgtccacctctccttagttaggtcattaattttctctgtctcctaaaggatgacgtacatggtatactaaccatatccatggtgatgtggtgcagtgcacaacctgtggaactgtgtacctgctgaggccatacactgaagcttgcacactttgtagagaaagagttgtagtaacagagctacacagatagaagcagatgtctgtcacttgatgtggacttttaagaatcatactttgcttttattttataaagtggagcaaatgacaacatcacttcagaagttataaagaccaacaaggccatattcgaaaaaagaagttcctacaaatattagttttaaccaaaaaggaagttactcaattcatttaagatcatcaaaatccttaacaaatggcaaaatgtcaaaaacaatgttttcaaaacgaatatttgtttccagatatgattttaacagtttttaaatattttctatttttaatttttcctgctttattgaggtatagttgacaaataaacattgtatatatttaagatgtacaacttcatttctgcatcatttatttgttctaatctatctccttctgccgaatgtaaagcaggtgtcatgtagacagcacatagtctgatcttggttttcttttttttaaaatagatttttcattcttctagctttattaaagtatgatagacaaacattgtatatatttaagatgtgcaacttcatttctgcttcatttttttctgttctaatcttccttctcctaaatctagagcaagagtctcttgtaacagcatagaattggatcttggttttctttttctctgtttaataagacttttttttttgcccccacaatgacatttgtttctaatcttcctttcagaaccagaaaatgtctgaagatgttaagatcccctgattactttgagaaaaacaactaaaacaagaaccgtgtttatcactgttgtggagatttccttttattcttgacacaatttgatgacctaaagtgtgttttcttctgtgtaaagtacatgagctgcctcactaagcattcccaactcattgaatgtgatgtggttataaagataagttaggcagctagaccctgcgttctaaaaaaggattgcttgcaatgttggtttggctattcatttgcacaaagagactgtggctctctgttgtgagatcttcagctacctcatggtgcaataacacacacacgcttaaccatgttgatggcacaaagcggtgagcagtagggaggtagaatatcttggtggggaggggatgttatcagcttctgggagatgaagaatattgttgaggttccaaagatgctggacctgtgctaaattcttcagtgatatgaaaaaatcattgagcattcattattgcgaatgaagtggggatgcattatttctgacacccacaagcagggtttgatcatcctttcagctttgagatatctgcacataaaattattattacctgaagaaaataaggctgcattttgaaatgttaagtgcaaaatgactgatgttaaaaccatctgggggaaatcttgggatgctttttcctaggaaatcatatggttgtgatatgttttggcgcataggagacagaaatagtgattatcaggcgttgagcctttttgtagtatttttagtctttgatactctgtaagtgctagttcctaaggcaccaacattgcattccttggtttatactttttctattcatcagggtaggaagtcttaaatccttaggcatccaagaagtatactagctttttgcttctcttttagaaatacttgtggggagagaaaaaaggatggtttgggcatattggtatagtttgagtaaactaaggttaatgttcatataacatttagactttgccataaatatcagaaccaaagatcaagacattcatgtacagtctggaatgtatatatggggcccataaaaattcccagtatgcatgttttatgctcaccattatgaattggggtcttcaaagagagaaggttgaaagtggaaagcacttgaaagggctccccggtttgtaaaatatctttaatcattcacattaggtacctcggagttgcgggtctcaaatgtggattcatgcatcatttgtgcagtttgaagatagtccatatttcctatttcagtattaggtcctgcaacacttttcaattcttgtagaaggtttttttcaggagtggtgatgtctgatgctcaattactattttccctataagagtttcagcatgagcttaattaaattcttgtgaaaaaacctgtgtttttagttacacacacacacacacacacacctacttaaatggaatctaaacatttttagcctttaatccattccattttctaaaactgtcataaactatttttaatcattttaaataaatgtaaaagaaaaataactggatttgattattgaatagtttttttctatatttcacaaataaattgtatgaaatgactgtagaagtggccccaaaattatgaaccttcgtagctgtgaatatgatgccataaatctcttttaaagctcaagatagactatgaacatatgaaatacatagttacctaatcatgagactaaattcacctgggtgacaaggctaacgttcaagctacttaagatgaaaatatttgaatcatgattgcttgggggaacctctctttgaggggtcatgaggaccacctgctgggcattctgttttcatgctgagaaggtgagaattgaacagatgagaaaagccttgataaaacgtcatctccatgtaatttagagaaggataaccttgactgtacagctgacccttgaacaacacagggctgaactgcacatgtccacctgtatgtgagtttgcttctggctctgccattactgagacagcaggaccaaccctccatctactcaatgggaagatgataaggatgaagacctttatggtgatccgcttccacttaataaatagtaaattcattaa

SEQ ID NO: 1353 - DNA, 64449 bp, Homo sapiens; identical to SEQ ID NO: 1352

SEQ ID NO: 1354 - DNA, 64449 bp, Homo sapiens; identical to SEQ ID NO: 1352

SEQ ID NO: 1355 - DNA, 33661 bp, Homo sapiens
ccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtgagtgcagcgggaaccgggagggagcgggcaggcggccgggccaccccgcgacccctctgggacccgcggcactgcaactccgcagaagtgtccggggagcgggtctcgtcgagccggggggctgcccgcggacataggggcaacaaggctggggtgggattcttacctgtcctggaggcccggaccccttacctacggggcggcgtatggatgtgtggatgatgtggcctgcggggtcacccatgtgcaaagcaactttttcctgcaaggttctgggtgggtgctctcatacacccccaccttcacgcttctggagcgggagttccgatcccccttctgcctcagctctctctcccattaacgcccgaggcagcgctcttccccgtagatgcgcttgccctacctcagtgtctctacttgaggactggccagcccgaagggaagcggtatactggcagtccccacgtggggggtctcccacatcagcagagtgggaggacctccagtcctgaggcatttctcccagcattgtgccagccccttgacccccagctgccaccttgggtttgcttttacagcagagtcctgcctggattaggggcacggctgtatgtagtgtgtaggtgagcttggagagcctgcggtcaatccctagtttgaaccaggggtcccagtggtgaagtgggcaggggacagcgggggcttggcggggttgcccccagcagatgggacaggagggtatcaaagttggcctaggaatgaggcagtgctggcgggagttggctggagctggggctgggggccccactggataaataactcctaatttttgagatagctgtgttttgccaccagaacattactgcttgggagaggtaagggagacgccaaccaaagacaccagtatgtccaccctgaagctgggccaggttggggacctctgtcctcctgaattcacccagatagtctcccagtagttatcctagttgcagagaagggaaaactgcacccaggggttgggagccccatctcagcccagggagttggatggagctgaggcctcttcccaggctacccaaggggtgtgccaggaccccgtagggtatagtgtctaggcaggcggggggcacaggcatgcctactcctgctgctcccccttcagctccgaaggagccaggcccggaagtggggaggtgggggccggagagaaagcaggggccagagagaaggcggcagcccacccagcctcagcccctcgctgctcagcataccttggggggaggatggagccaggctcaggtgaccttgactgggaaaccctggccacaaaaggggggtttcagtcccagctatgctggggtggctctgcttcctggtccttgaggtgttgggggatggggaagctgaggagccaagaaggagacagagctcttgttgaagtgggggagggaatctgaggggctgggtagcgggtggggtgctgttgataatctccccatgttcccctacggcccctgttcctgcctcccttccatccaggcagtcctcagctcggaggagccaacctcccttcctggagacaggctgtccacccccacccccaactccaagcctgggcggtctggatccggctgtacagtttggccacctggccccctgtcccatcccaggtgcctccggactccttcctctggccgcctcttccctgcaccccttgccagccccggctcctcgtttctttgttcaagcgtctctcctccgtccctccctctctcctccctctctcctcctccctcccgcctgcctccctcccttgctccctcccaccagccttccttccctccttctctgctttcttcctggtgggctcccaggtggcggtggctgttcttcctctgtccactgacctgggcttggtgtgacttgggggcttttctggggctggggctgggtgacaggcatctcgggactggcagaggggaaggcactgtgggtttgccctttctttccctctctgtccttcttctccttttcttccttccctctccttctttcccccacctgccaggctgtccaagaggggacctggacttgagactgaggccccagcaaacttgagcccctccccattcacctctttaaaaggccaaagcatttggatgggaagtccctgtagggacccagtagaaagactccccacctctctggacacattgggtgactccaaccctgtccttggtgacactgactttgtcaccatgaacatggatgaaggaaaaaatgaggtcatggggaggggggaggcgggaggcaggttgacaggagcccccgttacatagtatcgaagctctctgagggactcagacggcatcttgcgccaggacagtatctcccagctcccctgagccccaccccactagcaggtcaagttcttgagcaaactcatgcttgtaaggacgtgtgtgggcctgcaagtgtgaacgtgtgcatatccacagctgttatcaggggcctcccaggtgcaccttgagggtgacggtggctgcacagccatttctcccacctgcccccacttctcagagcctgccattcagtcagcactagctttgtgcctcccagacctgaggaggggctggttctgattcccccatcccccagctagcctccccaggaggcagcatctatgacaggggatctggaaggaccatgagcggtgtgccaggccctcgggagagaacattcacacagagggtaccgcgtaaggagtgggccaagaggctgaagctgcacttcctgtctgaggagccatgagtggtttgccttggcaggagaggccagggctgggggaggtgggtctagggatgtcatcagggtctaatgagtggggcctaagagtcagactggagcctgggctttgcctcagcattgagcagctatggcaggggagtcccaggccatagtactgccaactcccatcccagcatcctagagatgggcctggggtcctgcctgccacggaagaagggagtacacagggcagatctgggggatggggctcacattttcagtctcgatgcccccacccgcagtgcatccggttgggggtggtggtaggagttggcgctggtttgtgccgggagggagcaatatgttctgacaactggtgctgggctgcgtttacccaacagccagcctgcctggggagacaatatttgaaaaacacagtattgaaacttggacctgctggggctatgggggattctgaaggtggcaatgccgctggcccagatccagccccaggcccactggccatcctagcttcccttctttgccctctagaggcggagctggaagttttccctggcaggaagtccttctgcctgtctgacctgggtctctcctgctttgattttagtacaagtggactctgccattctctgcctttccttttctgactggtgctccctctcttccatcttgggctgtctgcatgtgtctcattcccccactctctcctgtgcctcccctctaccgtaataatcaggtccaggtttctctgtactgggagaagacctgtggctggagcaggcagggatgcaccctatctgttccccattcctccaggtgggagggagaaggagtaacccactttattggccacagatgcaggggagaaaggagaaagcatgctgggagctggaaagagccctaagatcacctggttggtctgggccctgtgaatggaattcagcatgccatgaggggtagggtttgagtctccagcagcccccatcagttctggtgaccccaggctggggcctattggtactatctccccagacaaaggcaggccaaagaacgcacatgaggtgtgcacacaggggcattcatggccccaggctgggggtggaagcgtggaggtacccatcaacctctttgttcaccttgggtagaaattgaactcccccatctgcctcacacattccaatcttggttccccttcccaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaaggtaagaagctgttttgttcttccccagaaatcatcctctctttacaatagcgctcggctcctctgcacacgagagaaagggtgggtcaggacaaaaccaggacaaattgtacagccacataggttgtgggggagaagggagaccggggaggtggtggcttgctgggaaaggctggagaactgacccatttagacacttagcaaaagagtccagagtctgggcatcttccagagtcagactgtgggttcctgggctgggtggcctgaggtctgtagggcatgtctttctgtatgataattggagaggtggcaatgtcactccttccaaacttatgtctgctgcggcccctccttgccactgctatgcatctggtcctgccctgagcagcccctggggtggaaggtcaggcagttgggcagacactggaacctctggacactggaagagcaggacctgctctcttggggtgtgggtgctcgaggagccttcctatggtctccaagtgggaagggttcctagaatccaggaggggactgttggctgtgactggcagggaggccgccggtgggttcaggcagagcacgtgctgctgtgagggcctgagctcctgagctccagtgagcactttgatgagaagtcactgggaggtttcagtgatgggctggggtctgcagagtgagaggctggtcgcccgctccatcaccattgcacttaacccactggacaggtgcacgcacacggtacacacatgggtgtacaaatggctcactcgagagccacttcctcaagggtgtgtgtggtctgaagagtctcccctgggcccagggtgaggggcagtggccatgctggggcctgggggacctggggtcattgggagttctcagccttggccctcctctggccagaggtaacttcatccagccgcctgccctgggtggggtcgactcagccctggctggccagatttccgggcagccatactggggtgaaaggctggggtgacctttccttcctcgggcttggcggaggcccagccctcacctcaccatgtcccccagcagggcccctcccctggcctcgtcccaccctgccccttgatgggaggagtaggggagtaagctgcttatcatcactcttcccagtcacccggctcctggaatttctgaggctgtgcctggaaggagtcccctgcagggcctgagaaatgggctgagaagagttaatttgtttgggctggaaagcaccccccttccccgggccccaggaaggtgagatatttattctgctgatacctccacccttccctggtggaattcttcagagcagattaataaatcttgaaggggccagttcccccaaacccctccccagcccagggtctggcagcgagagtagagtgtctcctcccccgatagtggaagggaggggtggcttggtctccacacccctgggaccttgcgtccgctctgggtgttgtttttgtcatcatgcatgcaagtaagcaggaggggcaaaacagagaggggtcttccgtgtgctccttctaagcctccctggacctccaggggcaaagagttttgttcctgttttccagagagagaaactgaggctcaggcaagggcagggtcaaggtcaggcaagaggcagaggcaaagccagaaatagaaccctggtgtcctggccttgccggcgcccacatcgcgtcaggtcgattccctctcaattagctctgaagccgacacccgcagtgactaaaagctgagctcactggcagccagcctgggtgttgccggttgtggcggcctggggtggggctgcagcgcacctggggccacccatcccagggctcctgtgcctttgcacaggcaggttcccctgccctgaatgaccttccctgttccgacctggtctcgtgtcctaattttgtgcttagacttcacttactactgtatgacaggccccgtgctgagtgctggggactctgtggtgaacaagatagggtgctcacagtcaagctggtggaaaaagcaatggatatccagttggtcagggccatctgggagcccagcacctgctgtgtaccaggccctgtgtatccccctacactgggtggtctcagcctggttatgcacacatgaagtggccctcagtgaggagcaggcgcccaccaagtgtgtgtggagtgagaatggagaccaacacttcaagaaactgggctcccaccatcttcctcccagagtacacgtgggtggcacagagaaggttactctcagaagcactgctggtcactgtggctccatgtcatagttttttcatctgtgccttggatggacacagcagttgacaccccaggcctcaggggctcaggctgggcactccctgccctgccctgccctgggtcctgctgtagtggggaggtgccggttcctgcctgggtagggctggaccctccaagctagaggtgctggcataaggggccacactgcccagggtagataaaggaacaaaggcaggaactgggccaggcttgggtttgctgcccgcccatccgcctgggcaccccagccaggtctagagccagaagggtgtgagggtcaagcagcccagggttccctcagattaggggggctcctatggcccagcttctgggcttcagcagcacagccaaaatcaggcagaagtgagggtcaaatggagatttccaggagcaggtgaggtgtttgttcattccttgctcttgagagagtggagcctgggctggaagcctggacagaccctccttccttcacccatccatgcctgggcctggagtcccctacactgcagaatcactgccaaatctcagagaaaaagctcttccttcccccaccttgagatgacccaggctctggggcaccacctccctccgtggcagcagcagggaggtgtgagggccctgccaggccctttgttcagcctggggagtgtttactttttcccaggaagctaccccacgacacactgctgctgcctgggctgggtttggccagggattggggccaagagatgtttggtggggtagaaggaccctgtgatgacatgagacagttgtgctgctagggaagctgaggcagaagtagggagagggagcagaaggtcaccctgccaggggaggtcaggaaagatgaacataatcgaaatagtagtaggagcccatgaggataaccaagcaatggtccctccaagacctaaagagggtctgcctaggtttcctgtgaggaaggaggcttacgggggctgagcggcttcccaggtcactcaggagcaggactgagatggagcctgcatccgcctgatgcctgaggctgtcccaggactgagagtggagggcagggatggtggtggtgctggaggcacagacccttcacatgagctaggaacaaggaagattccagcattctgcagtgctggtttaggcttcctagcctcgtttcccaaagaaagggctggggtcgcactgggcaggctccccatgccctctgtctgccgaagcaacggaattggggtttgcttatttccaggctataaatccggccctccatcactctggcccttccactgagcagggtccctaggaaggcctctcatgtcagagatgggaacatcagggcctaagagaggaaagggctcctgttccagagcagcctggagtttgagccctccaggccaatagcccagaacagtgccaccgctcacatcatttgcatgtggcatcagaggaccaaggttgccaggtttggagatgatgaggttagaggttaggaagggtcacagcccgttgacttcccctcaggagttgatgtgagttgaggtgcctctagcaagccttgatggggccttagccctcaggcctggtgcaggagtaggggtggggctggagagctagaggacatgctcttgccccccaggggctccttggccagccagagcaaggcatggggctttggtgggggaggagggggaggaggcccaggagctttgaggccagtgtggcaccagggagctgggcaagggtcaggtggctctggcagctacagtgggggttggagctcacaagccagggagggtaggtgttccaggatacgccaggatgagggaggaaggaagacccaaagcatgaacttgagcccagatcccttgaggccagatctggagtttcagttttctggaaatgggagctgccttactcctgagagacttggaagtggccgctttggagttgggaggtcctggaagctgcacatcccccaactggctaggaattggtctttggagagaatggagacagggtccttgtgcttgctggagaacctgcctgacgcccagcctgggtcagccaggccaggggctggggctttcagctgtggccttccaggtcaagtggagcttcagatgggacctccactgtctgggcctccgcagcacaggccttgtctctggttccctggcatgatgcccgcccctccttccctggctccagcttcccttggcactaagtgaggagctggtgcatgctcaaggagtaaatcatgttccttggcagcccccactgcttcgtaatcgtaaagaatttaaagagaaaccgccaagataaaaatctcaccagcccataaaggcatctttcaccctgcagcttgggagacagtgagcctcagagtgggctcttggctgtctgcacctgtgtgtatgcacctccggccccttgactcctccagaggtggtaatagctcagaaggtggctttagggccatgggtacctggtccttgactcctgggagacctccatctcctcactcaggagagtggggtgcttaaatttggtgtaatgcagaagtggtgatggtggtggctgagctagctggtcccaaaggcaaaacccagttctaccagtgttagctgtgtgagttcagccaagtggcttagcctctctgagccctggtttctcctgtgtaaggtgggaatggcagtggccctgtggaagcagcatcatgagggctcagactgtcttgcttgcatcctggccatgggtggatcttgcttggtgaacatcattctgtgttcccactgccttttctggaaaatgggagtaagaacaatactggcctcgttgtgttgtcaggaggattaactgtgtgagtatggtcactgtggaagaaatctcagtcaccaggagcgatcctgaggctggtgtgcaggtgagggcaggtccaggggcatgccccaaggagtcccagactgcctcaccccttcctccagaattctaacttttggtaagggagatggtatttggaaaggactccaggaaggaccctgagtcctgtggggtgggtggagtagggtcaggaggaggaaaattcctaccatgggtatctgggcaggcttcatggaggaggctgcatcttgagcaggggaggggaggttgtaggggagggaagagctggagcacagggagggtgcatgtggtgcagcacctggggaagaggacagatgctagatgcagtcttgcttttgggacaaggatgtagagttctactttctgtttctggtttttaagctctttttcctcatggcagaggtactaaatatgtattatggaaaaattccagtgatacggatgcatttggcgggagtgatgccttggaagtagctccctagagactggctccaaggcctggttgggacgcacagttggctgcaataactccttctgtgaatgctgctccagctcctgccgtgtgtcctaggggtgaccagacctgggctgctcactcaggcatctgcagggctgggcagaaagcatgtttgcctggcttggcctggtgctatcctgggaatctgagccccgcctcaagaagccctgggagctttggagaagcagagaggattcctgctgcatttttcttagaaatagcaagagggcctttgccagaggcctggatgccagaaggctatggtctgaatccaaagcctagctcacgtgggtgccagagcttggcaggcctacagccccccacccagcctgctgggcagccccagggagagggtggaggcctcctgggctccagtccctgaccactggtcctgacccagcaacgaatggggtctgggcagtggctgctggcctaggattggggggctagcctgttggggagggagtggggctcatcgggctgacgggctgggctgacttctggcactctcactgggccgaggggagcactggctatctggtgcatctctgcagggcaaagacagacccaaagcaaccggcccctccagggatcaggaagcctcagctccggatcccccttcccccactcttcttccttccttcctccccctactcccccttgcctccacccctccctttgccacccctcttggcttcctacccggacatgctctttcctcggacgtctctgtacccagccaagagccttgttccttcccacttggggctcggtgctgatgccctcatttcccccggccagagtccactgcctcgtgtgtctgctgttcagccagcacggttgccttctaagggtcatacactacaattggcagagcggctagaatttgggagccctttgggctcctacagctccaaggctgagtggctagcactccagggggcctctcccagggctgcctgtattgccatttttatcagcgccttcctggctgggcctggggcctgtgcggagtgctcactgcctgcccttgactggctacctgctgagtcctgctgaggtcctaacccagcctcactgcatcctccaaggctgaccccaagcatgcacctgtctgccctgtgcctcggtttctccatcagaatgttggggaggggctaagactgtctggaacatcccgggaatctctgggtgggtgttgtgaaggggctgcagggaccgcaggaatccgaggaaggccgcagagatgggggctgggcccaggggagggggagggttttgacacccaccagcctgttggtcccatcttggcctgtctgtctgggtgatttatcagagtaaatgagccatggagagtttgttgtcttttgcagtcatggggaggaggaggtggtggaggaaggagtgaggggtttccgggccaggtctggaatgtgggaggaggaggtgggtcccccgggggcctctgaaactggaggcactcactgaatggccttttcactctccccacctgagaaatgaatcagtgcagccctccccttcagaacaatcccctctttccatccccttcatacttcttggggcacattcctgtgtgatctgcttgtctggtcatcttctcccaccccctgctcaggaccaggtctcttgaccacagtgtccttccaaagctgagccggagccctgacttgcccagctggtgaatgcccaaatgtgttctcacaggcaaccatgcacactgttaagttccaagtgggacgtctaggcctctggaactaccagcccaggcctaggatggtcaggtgcatggaccatggggaaggcaggggtcagtggaggtgccgaggccggagagaccccatctgctgggacagaaggtccgaagtcattgggtgtccttcggggatgaggcatggatcccctggttcccggctggcgagtcagggagtgatcctgctgctccgtcacttctggcttttcctggtttgaggctgagctgtgccctcagcctatcctgtcctgggcggagtaggtgagcactggggcggaacgggcgtgggaacagcatgcctggacctgctggccccagccccctgccccctgcccccagcctttagtcactgaaatgggagggaagtgtacagtggcgttttggcccagctgggctctttacccctgtacggtgtttactgaacagctgggatgtttacagtagcccttgcaaaggggcccctcgttgcaggggatttcccatcttgagggtcccactggggctcttctgacctcaccaattccctgcacccctgggatagatgtgtcagggatacagagaccataaccatctccaccttaccagagccagtggtgcctgtccccttggcctctggccttcggttcctctgctctggaggagccaacatttcccaccacatttcctagagtggcagctctaggtggtgaaatacggtaactgggtccccagttcagacatttaaattaaattcaatcagagcggttattgaataaaaacacgcggagtcatttacatgttaattatgttgaatggactactagaccataattagttgctaattgggtgagagtggctgtaattggttttgttggcaccaacctggctcacctacctggggggaagcgggggttggtgtggatggctcctagggaggccctctgggtctccaatctggaaggcctggctagagatgctatgcgggggcagatctccaggggcttagggtcagaggaacctggaacctctccccagggagggtgcagctggggtctggcttctagggttcccatccagagcatagggggaaaagggggaactggaggagctaccccagatcagcagtgatagtctcccctgcccagccccatgtgggacctgggcttgaacaaatggtaagtgcccaagagtgggtctgtgggagcccaaggcaggcgtcactcaggtgtgtctctgcacatactgggccctgggttggcctgatcagggtggcgttggggtgtaagtgggtgtgccaagcaggaggaaggtacgtacaaaggcatctgggcctccctgcccccccgcttagcttggctggggttcccggggttgtaggtctgtggccatgggctgaggccttccggctggccgctcattaaaagaggattaggctgagagccagggggccagcccagtccccaggccttcctctggggctcctcacagctttgggggagtgataaaagggccggggccaccccttcctggatcctgtgggggtatccggtagggaccacctgggccctgccatgcctcttgccgccactgctactatagccttggctacctcagtttccctcctcagaaggtcaggaggtctgtctttccggtgggtgaaacactgacaaagacccaggctggtgcctccccttgtcccccagtcccatctctcttcagctcagggattagggctgcactggctcactagaggtcagaggtctgagctaggctgcagggatctgtctatcatccccagtccccatcactgctgggggaggtgacgctgtcagtcagggcctgctgctttgtggggctataaccaagggggcgggctgcccacctctgctccaagactcctctttttgcggcagcccacacctcactgcacgcagacctgatgtcctggagaccagcagcaaggggtaggggctgcccacttggggtcttcgggtgagggctgtggacacgcctcctcagtgcctgtcctcacctgcccgcacctttaaagtaaggtatcaccagctgcttcccagatatgagggaccgggggcccccaggacccagccccgtgtgccttgagaaggtcctgcctctggacctgtgccaggccgctttgggctgggaccccaagtgcttgatggccatgagagagtcctggaggccaggaatggctgcggaaatgaggtgtctgatgccagaaaaggctcttccttcccgatgatgggaaaatccttcccggatgtcacccctcccaacctgtgcccagcctgggtgagagtatgggggtggggagcccttcccaggagacagcacccaggcacaccacccttcctccccctaaggtcaaagcttatctgggctggagtcctgatccccacagaacccttgattgtgcccagcccctccctcaacattgccatggcattcgaggaggcatggcgctcctgctgccagagccgggcgtgggacaagtggagcagatgtggggattggccttaggacatgaccaggctgggtctgcatcagccctggcccccactgatgccacctcaggtcccaggttcctttgttccttctgtcccaagtccctgtcccttaagggagctggggcctggtaggatctggcacctgctgatggcaggttttggaggaggatacccagggctacttgcccaccccctgctctgactcaggctgcttggaggagtgaaggctcccagttcctttgcctcatggtggagtggggagcaggggacaggacaccctgtgacctgggttgagtaccactctcctttgggcctcagtcttcctgtctgcagctgggggtgcagggctgtcacagggctccttgtttcccttttcacctacagtctggcatgagtggggtcagaagtccagctgtgggttgagaaggctggaaccttacaccttctttgctctgggacccggggaagttcccacccctctccaccttggttcccctctggtaggctgggtttggatgaatggtttgggatttagctctattcctgtgggttggggatggggtaaggacacactggagttgggaaggctggagctgagtccacaggttgcctcttcctgccttatagccctctctgctccccaatctagcactaggaaatggagtagctggggtgggaatggggatggatgccctacaagagatagcgacacgtggaagcctgcttccttggggaaggacttgggacctcattccactctcctttccctgaaaggcagagacacccatgaaggatgggttgggggaagacctgaggaatgccaggccgtgagcctctctctgagatcagaacggggtcactgatcctcagggtcactttgaatatcagtaccaggagggcctgagagatggtctagactagagaatgaggctcagagagcgagagtgcccccaactcaggtcatgaagctcacccagaaactcaagccatagccaaggatccctgatcctgggtcccaccccttccccaccatgcgcgacctcctggggctccccctccccccacactgtttccacagtgaccaaagcgtcacgtcctgtgacaccagagccattgacgccatatcccgtggccactgggaggggtcccgcaggtcctgagtcatgtgccctgtccacggggagcgagtcaccttccggccctggccctcctggcaggcagtctctaccaccaggactggcttcccctgggcctccccctccttcagccatggacctaggtgggaatcccacccccatgcactctggcatgtcacatcccttccctgtgccctgtgcccttggtattgtgagcacagggctttgtgcacagcgggtgttcgataactgagcaaggggctccctccacccccacctccacccaggggcagactgggggcagcaggcagagagggtcgaggccaatcctctgcccctaagctgggactcagtttcctcatcctctgagtgttctctacggcctttctcacagagggagctggagtttgggagtgctggggctttgcaagagggtaggggactcggacttgggcctcgggctctgggagtcttggtgcagggttgatattatagaggcccaaggctgcgcagggttggagcttggggattatggctgattgggttcctgggggcttaatggctgaagcttccccttacccggagtgcccgtgtctgaaggcgcccacttaagcctctagcccctccccctgccattgcccccaaagtgccccctagcccaggggatgggtaagggcatgaccgagccatgcccccagccagggtataaataacccctggcgggctgtcccagcctgggggggctccactggcagccccacttcctctctggccacttcccagccctgggggtgggggaatgtttactttcctgttgtcactgtgggtgagcagccaggcgggtgagcggccaggcgggggactccgagtggcccaacaacaggtgcgggacaggtgcctgggccgccctgcccaggacttcagaggcgccgctggacaggcgggtgaggccatcgccaggcaggatcggccctttgatccctcggcgtccctgcgtcccagcggttggccaaggtcatcacctgcattcccttgtcaccgcatagtcagggccaggcagggcaagacctttccttacccactagtttctcagagtgaggtcctgggaccagacatgggctctgggtcagctggtggaaccccctgaccccagcccacctctgccccaccttcaggctgtgtctagggcctcggatcccagctgttctccccctccaggtgccttggggcctggcccaggcctctcccttgactgccccacctgtgaaatgggttaccagctggggaggggagatgagacatgtgtgacccccttggtgagtgcctcatgtgtggtaggacatgtgtgcgccatgtgcatgcctgtgccacgtgtatacatgcatgcactcttctgtgtgctgctatcttaagccccctgtgtgtgtgaatattcatcatcctcattacagtgttccctcttttgctgagctaaagatagctgggggtgggtggagagggggcttgccaaggggacccctcggctctccctccccttggaggcaggttcccaagcttctaggagtcctttgtctgtcattgtctgagccccctcctgtccttcatccttaggaaggacttttccccagcatcctggagttggaggggccaaggctgctggactcatgcaaaagggaaactagaggacccagttgaaccctgcctttagccccagggttgtagctccagggagagagcctctttcccagaaatgactgtcctggctcattcaaggtggcctgagagttccaccattagcagccttatagggtctgggggaagctggggtccgtagggcagtgtgtccagcagggctttctggtctcctggctaacctgcttcagaccaagtgaggaccttgctgtgcaccagctgtgccctctgcctggtgggcagccagggtaagaacagggcatccaggctccatgccagagtctgccggctgtcccagatatacccggtcacacccctatctgctcattaacccttttaagcccctgtgtgaagctggccccaccctgagcgtgggagcattaacccccacctgagcaaaaactctttgatgctgttgcgtaccctggcccgcacctaccgccctttcattgggacccagagactagctagggctgtctatgaatcaggggtttagctttgggtgtggcgccttccctggcctgcctacctgtgccactttgtcctctcagtctgtcagggactggagagggagctgagaaggatccaggaaggggagctggaggtttaagaccactgtgtgggctgggcacagtggctcatgcctgtaatcccagcactttgggaggctgagacaggtggatcacgaggtcaggagttcgagaccagcctgaccaacatggagaaaccccatctctactaaaaatacaaaaattagctaggcgtggtggcgggcgcctgtgatcccaactactcaggaggctggggcagcagaatcgcttgaacccgggaggcgaaggttgcagtgagccaagatcgcgccattgcactccagcctgggtgacagagtgagactccatctcaaaaaacaaacaaacaaaaaataagctgggtgtggtggctgacgcctgtaatcccagctagtcaggaggctgagacaggagaatcgcttgaacccagcagatggaggttgcagtgagccgcaatctcgctactgtactgcagcctgggcaacagagtgagacttgatctcgtaaaaagaaaaaaagaaagaaagaaaaaagaccactctgtggtgggggtcctgaggggaacctcagggcctcagtctcccctttatcagagggggtatggctggatggtttcctgaaggtcctaattggtgccctgccctccacccacagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattgtaagggctggccctgatgtgggacgtggggtgggcacggagccccagggctcagggcatgtccagaaggctgcaccttctgacccccctctctgcagatacactgggcagcctccccacagcgcatcgaggaatgcgtgctctcaggcaaggatgtcaacgtgagtttggtgggatccacaggtgggaagggggaatccacaggtgggaaggtactgcccccagtgagggggcaggcctggccagggcacctatgcagccttccctgtggccccagggcgagtgtgggaacttcgtcaggctcatccagccctggaaccgaacacacctgtatgtgtgcgggacaggtgcctacaaccccatgtgcacctatgtgaaccgcggacgccgcgcccaggtaagccccagccaccctggccctgtgctgcccccgctggtggctgcatcccagggtcctgatgggaggaggggcttcagccccagccctgccacttccgagccttttgaccttgggtgagtgacttctttcacctcgctgagcctcagtttcttcacttgaaaatggggctaaccgctgcctttctcacaggtcggtgtgaggaggaggcagtgagctaaagctcccaaagctcctagcactgtgcctggcacatagtaagcacttgctccatatgtggcaacagctctcttggctatgcctgtggaccgtgccccgacggccgagccagagggcctggtgggggccttgcaataggaggctggacccctgggtcagcttctaccatgtggcctgggggagagctgccttccacccccagggccagggttgtggggagctgccccttccccagctctgccccttcctgcctgcttccacccttttccatttccatgtgggcatgtgtgtgagctggcgtgaacttgtagggcatgtgtgagaatgactggatctgaggggcacctgtgtgtgcaggtgtgtgccaagcctgtgtgtatgtatgtacacacgcatagacgtgctctggggggcccacgtgttcacgtgtgttcctggcctgtgtggtgttagaggctggcagcccgagcccgctcccccagcccctgccacccccagctctaacccctgttcctcgtcttctcaggccacaccatggacccagactcaggcggtcagaggccgcggcagcagagccacggatggtgccctccgcccgatgcccacagccccacgccaggtgggcctcatccctccaggcctttgccaggcagcactgcctctgagcggaactcaccctgggcctgcacctgaggccagcctccccagggcctcccctctacctctgtgcccacaccctgtccccaccccttcccctgaagagccctcaggctcagaaggcatgcccagctggactcatgtcagcctcagtgtgacccctgcaggcaagaaataatgaagccgccaggtggggaagacaggagccctggggacagccatgccttagccctcagaaagcatgtgtgtagacacacaagagcacacaccggtgtggatgtgggccttcctcactcagcacccagagtggaaagtggcacatgagtgcagtctgacaccttactcccaggtgttcgtgccccatgcctcccatgagtcatctgtggacacaggtgtcctgcacactcatgtgcttggggcgctcttctcccgtgtggtatctgtccactagtgatgacctgggtctgggctgggagagctggggctgggcaggggcgggcaggggggcaggggctgccggtgaatgacagagcatgtttgtggtggggagtgcagaaatgcaggatcgtgtggattctgtgtgtgtgtgtccatggtgtgagcaggcggttccgtgtgctggcggtgatatgttcagagctgtgtgtgcacccttgtgtgtgcaggaagtcacgtgtgcagtgtgtagctggaagtaggcctgtgtgcaccttcccatcgccatcctgccacctgctgccacctcctcctgcctctgttcctctctccttgcccctttccttccctctgcctggctttctcttgtggcctctgtgctcacccctgtcccagtgccttttccagccttcctagcatcttgcaggctgggctgggaggcacagggggctttgtgaattccatgtggtctgggctggactccttgactcctggctccctggggagatgtggagcctgggggctgtgctgagggacaggagaaaggtcatggcccattggtccatcctgaggaccacaggtaggacacaaagcctgaggatacagtaaccttagagctctctggcctggctagacctgatggcaaaggacaggaccccaggcccttaaccagtcactcctgccctggccaggtctgcagcgctttcttgacccaagacaggcagccacagcaaagagctgtgcctctgtagcccagggggccttggccagtgtctttatgagccagttggcatggaggggcttcagcccctacaagcccactccatgtccatctcatagcccacaaggcagggccccttgagacttggtccccaggtcttccctaagacctgggactaggaagcaccccccttggagcccacagcatggccctgccctgggagacctggctggatggagtttaaggccaaggaatgctggggagtgtagggggtgggctcggggtatgcctgggggctcattctcaccctgggagcctggtgacccttacacttcctggctgggggactggcctggacgatgctgagccccgctctgccttacaggattacatcttctacctggagcctgagcgactcgagtcagggaagggcaagtgtccgtacgatcccaagctggacacagcatcggccctcatcagtgagtgccccccaaccccgctctacagtctcaatgtgtggcctctgcccctggagatggggcatggcaccaacacttacccaagggcagagaccatgactaggctgtccctgaactccccaaaaggccccacctggcaagggggagagggtgcaggccagaccccactgtgagctgaggtcagagactgggtggtagaagcctccgcctggcccctttggatgggggaccaaggaagccaggtcctaccctgaaacacacaatgtggtccatgcaaagtccagaaccctcctgaccataggcttcctagaagagaagataagccgagtgcgtatcggggctggtctgaggggcagtcccatagcatgttcttggtgtgtctgagaggctgggagagccctgtagcgaaggaccaatggagagttccggccctgtgaccagacggggagagcatgttcctggtctgggtaggtgtctgggagggttgggggctgttctctgagtaggggtcctgccggggtctcaggagcagctgctgcccctaactgcaggttgggtgaacccatcactgaccctggctcatgcacgctgcctgttttctgattgttcaacacagtctgcctctcagagcagctgttgggcactgtgccacctccaagcctgggaaaggccctggggtcaaggggcagacattatcctccccctcttggcaagtgagaaggtcccagcctgatggcacagcccaaatcactctgatgaggaaagacagggcctgccctgggggagcctcagatgtggtatgttagaggcaagtacattattaaattttcaggaattttttgagccagttgttaaagacaactattattaaaagttaaggccaggctcagtggctcacacctataatcccagcactttgggaggctgaggggagtgtatcatttgaggtcaggagtttgagaccagcctggacaacatggtgaaaccctgtctctactaaaaaataaaaaataaaaaacattttttaaattatataagtttacgattaaacattaaaacaaaggtaacaacaataaaaagtaacaaacactcaaaactagccgggtgcggtggctcacacctataattccagcactttgggagacggaggcgggcggatcacctgagatcaggagctcgagaccaccctggccaacatggtgaaaccttgtctctactaaaaatacaaaaattagccaggcgtggtggcaggtgcctgtaatcccagctactagggaggctgaggcaggagaatcacttgaacctgggaggtggaggttgcagtgagctgagatcgtgccactgcactccagcctgggcaacagagtgagactccatttcaaaaaaaaagaaaagacttgaaaattgaaattgatctatgggctgcagaatggatgttgtgttagcaggcatgaaaacaacatttgtctccttgcacacctccatcagagctctgatggagaccaagaccaataagcagtaatattttgaaaggaatctttttttctgagcagtgggtttaaaatattcagaaaaccggccaggcacagtggctcatgcctgtaatcctaggactttgggaggctgaggcgggtggatcacttgaggtcaggagttcgagaccaggctggccaacatgggtgaaactctgtctctactaaaaatacaaaaattagccaggtgtggtggtgtgcacctgtaatcccagctacttgggaggctaaggcagaagaatagcttgaacctgggaggtggaagttgcagtgagctgagatcgcaccactgcactccagcctgggcaactgagcgagactctggctcaaaaaaaaaaaaaatcggtaaaccatgctgtaagcagatgtgctgtcattcaggctttgttgttatttatagagctcaggcagagtagattttgcaaaattctttttcttttttttttttttttttttgagatggagtctcgctctgtcgcccaggctggagtgcagtggtgtgatttcagctcactgcaagttccgcctcccgggttcacgccactctcctgcctcagcctcctgagtagctgggactacaggcacccgccaccatacccagctaatttttagtagagaccggggtttcaccgtgttagccaggatggtctcgatctcctgacctcgtgatccacctgtcttggcctcccaaagtgctgggattacaggcgtgagccaccacgcccacccctatttcacataattcttaagggccctagggttcttggaatggtaaatgagcactggcttcaacttaaagtaaccagctgcattagcccctaataagagagtctgactgtcgttcgaagctttgaagccaggaattgatttctccttgatagccgtgaaaatcctagatggcatgttcttccacgagaaggctgtttctttctttctttttttttttttttgagatggagtcttgccgtatttcccaggctggagtgcagtggcaccatcttggcttaccacaacccctgcctcctgggttcaagcgattctcctgcctcagcctcccaagtagctgggattacaggcgcatgccaccatgcccggctaatttttgtattattagtagagaaagcgtctcgccatgttgaccaggctggtcttgaactcctgacctaaagtgttcctcccacctccgcctcccaaaatgctgggataagaggtgtaagccactggccctggccagaaggctgttttatctgcattgaaaatcgtgtttagtgtagctcccttcatccatgatcttatctaaatcttctggaaaacttgctgcagcttctccatcagcacttgctacttcaccttgcatgtttatgttttggagatggctgctttccttaaacctcatgaaccagcctccgctggtttcaaacctttcttctccagcttcctctcttctctcagccttcatagaattgaagacagttagggctttgctctggattagactttggcttaaaggaatgttgtggctggtttgatcttccacgtaaaccagtaaaactttcaccatatcagtgataaggctgtttcactttcttatcatttgtgtgtttactggaatagcccttctaatttccttcaagaacttttcctttgcattcacaacttggctaactagtgctagcagcctagtttgggacctatctcagctttcaacatgctttccgtactaagcttaatcatttctagcttttttgtttttttttatttgtttgtttattttttgacagagttacactctgtcccccaggctagagtgaagtggcatgatcttggctcactgcaacctccaccccccgactccctgctccccggttcaagtgattttcctgccgcagcctcccaagtagctgggatcataggcgcccaccaccacctctggctaatttttatatttttagtagaagtgggttatgccatgttggccaggctggtctcctgacctcaagtgatcccctgcctcagcctcccaaagtgctaggattacaggcatgagccactgcacctggcccatttctagcttttgacttaaagtgagagataatatgactcttcctttcacttgaacacttagaggccattgtgggattattaattgatctaattttaatattgctgtgtcccagagaatggagaggcccaagaagagggagagagatgggagaatggccagtaagtggagcagtcagaacacacacagcatttatcgattaagttcactgttttatatgggtgaggttcacggtgccccgaaataattgcaatagtaacatcaaagatcactgatcacagatcaccataacagacagtttgaaatattgcaagaatcaccaaaatgtaggcaaggcgcggtggctcatgcctgtaatcccagccctttgggaggccgaggcaggtggatcacctgaggtcaggagttcgagaccagcctggccaacatggtgaaaccccgtctctactaaaaatacaaaaattagccagatgtagtggtgggcacctgtagtcccagctacttgggaggctgaggcaagagagttgcttgagcctgggaggtggaggttgtagtgagctgagatggtgccactgcactctagcctgggtgacagagcaagactccatctcaaaaaaaaaaaaaaagaagaattaccaaactgtgacacagacacagagacacaaagtaagcatatgctgttgaaaaaatggtgctaacagacttgcttgacacagggttgccacaaaccttccttctgtaaaaaatgcagtatttgcagtgcacaaagcccagtaaactgaggtgtgcatatgcttcctaattctttcactacactttattgttagctatgctctttttttgtttttttgtgttttttttttttatttttgttcctgctttttgagacggttgtctcactgtgtcaccaggctggagtgcagtggtgcgatctcggctcactacaacttccgcctcccaggtttaagggatcttcctgcctcagcctcctgagtagctgggactacatgcgtgcaccaccacgctcagctaatttttttgtatttttagtagaaacagggtttcaccacattggccaggatggtctcgatctcttgacctcatgatctgccagccttggcctcccaaagtgctgggattacaggaggcataagccaccatgcccggcctctttttttttttttaagatggagccttgctctgttgcccaggctggagtgcagtggcatgatctcgctcactgcaacctccgcctccctggttcaagcaattctcctgcctcagcctcccgtgtagctgggattacaggcacctgccaccatgcccagaaaatttctgtattttagtataggtagggtttcaccatcttggccaggctggcttccagctcctgccctcaaatgatccacccacctgggcctcccaaagtgctgggattataggcatgagccactgcagctggtctattagctatgctcttgaggtgatttacatttgttgtgtctgtggggtagaaatactgtacagtggtgttggcagctcttcctgattttgctttcagtgacctcaggttggtagcttgaaattagttgtggcaggagtattcacaccacagaaatgggctattgctactaatcagagctgatagttactaatcccaaccctcccagagccagtggtgaaacactgaccagcactccactggagataggatcatgccccagggagcctgagcggggagataaggccctgccctggaagtcatctgagctgtgccctggccctagcaaacagcagccccccaactgacccactggcctacccacagatgaggagctctatgctggtgtgtacatcgattttatgggcactgatgcagccatcttccgcacacttggaaagcagacagccatgcgcacggatcagtacaactcccggtggctgaacggtaagcgcagccccaggagcccttccgtggccatgtgtctgggatgcggcaaggaggtcgtaaagaagcacatgtgggggaagtggggacatgtttagcctatgactacctggggcaggggtagtttcttatctggagaggagttgggggtgttcttgcacctggctggggattctgttggagaacatcaggggcaccatcagagtaggggctcacccagctgacccctgccacctgcagacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctggtatgcattggcagagccaccaggctgccccttccaccagttctggcttcatcagccctgctccagccagggcttggggtcaagagctgatctgacccggcctcttgccccaccccccagaacgatgacggtggtcactgttgcctggtcaacaagtggagcacattcctgaaggcgcggctcgtctgctctgtcccgggcgaggatggcattgagactcactttgatgagctccgtgagtgcccagcaggcaggcagggtgctctggctacagcaagagggatagaggcgggatgggcgatcagggtgcctttggtgggccccctcccctgtgcaggagtgggtggggcccaggggctcccgcccatggcaccctccaacaccttctccctctgtccccagaggacgtgtttgtccagcagacccaggacgtgaggaaccctgtcatttacgctgtctttacctcctctgggtgaggctggggtcagggccagcagtggcagggagtggccccgttgggggattgtaactcgtggagaaccccagcccggtggcgagctgtggggagggggcagtttggggaggggccctaggtggagggtctgtcctgctcagcagcgcctgccatgcccacagctccgtgttccgaggctctgccgtgtgtgtctactccatggctgatattcgcatggtcttcaacgggccctttgcccacaaagaggggcccaactaccagtggatgcccttctcagggaagatgccctacccacggccgggcacggtaaggaccccactcatcctgcctctcccctttctcttcttctaagaggcctctgggtcaggctctttgcaacatgggccccaccatcatggccctcccagccagcggaggcggtgagctgtaatgcacacacagacgggccttcacacacagtgtcaagctgtggaggagcccagatgggattctgggacaaagatggtgggttgggcgtggtcggctgctcctcagagggtcctctgtggggctgtttgggagctgaaggttggggggaagcgtcttccctgcaggtgctggaggcaggctggaggttggctcagctgaggaacaggaggcaaagagctggggaggggcagggccaggcctcaggcagggtctcagaggtcacagaggcatgtcactttatcttgatgtgacaccggctgatgtgggagcctaagcaggagagcagcggatctggtccaatgcagttctgactccatgtagtcaggactgggctggagaagctggtctcagtgggggacaggggaagcttccctccagaggtaacctggagtcagaaggatgggccagaggtaagctggccatgacggggggcaggctgagcccaggttcaggggacagcttcaggaaggaggagagtgagcctggtgtgtgacaaggacgtcggggcctgcagtccagctgtgcaggagggagacgggtgagaccctaggaacaaccagagaggaaggagatgacaggggtggggagggggacatggaagggagtggtccgcttggccaaatgctgccacgaggtcatggcacctgaggccagggaggtggctgtggcatttggccacctgggaccttggccagagcaggacctgtagaggtcaggtgcagggcagaaacttggagagcgggtttggggagaggagcaggttgaggtagtggggacagacagtgcagcggcctcttctgaagctaatggctccagcctgccctgcccaggcagcctgggactgacactcgccacctgtccacagtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggatgcagccgacgggcgctatgaggtgcttttcctgggcacaggtacccactgctgctcccggcctctcccacgctgggcccaccgggtgcggggtgcagatccttggggctggggcttgccctgctagggcttgctgcaagctcatcagagtcacttcttcatcctcatcctttggtgccttctccctattgatgggataacagaggctaggggtgagaaaaccccattcccacttccatccccaggggcccaggagaacagggacactgggcatctggggacttatgtatgtatggcaggaaaggggtggagacagatggtaggcacctccaggatacagaggccatacacatgctcgtgtgtgcacacacatgccacagtgcaccccctacagttccagcagcccaaacacaggagaatgcatgccccagtgtcctgttctcagcagggcccaaaatcagggtctgggttggtgggggcagaccatggccatgaccccctatgtcctgggccagtcccctttgacctggggaaactcttccaccttggcacaaagctccagctccaatgccctaggggggtttgggccctggtgggggaaggggctgaggctggtaccccttccccagcatccccagccccactgaggccctgcccggcccgttccagaccgcgggacagtgcagaaggtcattgtgctgcccaaggatgaccaggagttggaggagctcatgctggaggaggtggaggtcttcaaggtgggtgtgacaccacccagtcctgacctccccacctttaccctccccccagtcccagcctctgacctgagacctctaggtcagggcagggagggggtccctggcatcccaagctgatctttatctttttctaggatccagcacccgtcaagaccatgaccatctcttctaagagggtaagcctttggcgaggtgagccaaggttggggacagggcctgcatcccctcagggtcatgcccttggcacagggatgggtaaactgaggcatggaacaggggagaggagcccagcctagctggctgttggtggggctggctatgggacaggaactgacaaggccctaccctttgccccagcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggtgtggacccctagacacctagaattttagcaaccagtcccagggccctatcctaggggattgggggtgcatgtgatattacccggggtgcatgtgatattaccctaggggagtcttatgggtaagacatcactgccctggggaaaaagggccctgccctggagtcagggagatacagggacctgggggggcaagcttcctgggagcactccttcaggggctatcctcatccaggcggagccgccggcaggacgtccggcacggaaaccccatcaggcagtgccgtgggttcaactccaatggtgagtatgctgggcctcactgtggggtgctgctcacactgcagaagtccacgcagcccacgaagctgctcacagggcccccactgtaagggtgctctgatggctaatggagggtgggggctaatggagatgggatgtccctagttgccccatcaacacagagcactacattggtgagtgggtgcccctcggtgcctgccccgaagcagtcagcaggctgcccggaggtgatgctgcttttgctcaacccctctcactctaaagccaacaagaatgccgtggagtctgtgcagtatggcgtggccggcagcgcagccttccttgagtgccagccccgctcgccccaagccactgttaagtggctgttccagcgagatcctggtgaccggcgccgagaggtgagttcctgcgcccggtgctgcaccgtggatgtgagtccttgcacagtggtgaaatgtagtagaggagtgatctggagcaactctcatgctgtgaaaccccttccaagctcccttccctacatgcaaatcctttgagtgaaaacagttacatggaaactccctgggattggcctcattctatggaaagtgtttctgggtatgcctgttcacatgaaaattccatatgcataccacattgggggtgtaccttctacaaaaacatcatgtgagtgagctccagtatgtggaaattctatggggccctcattttatgaaaatgccctacaggtgtccctgtttatgtggaaattctatgtggttatcccaattggatattctcgttaaatggaaattctggctggacgtggtggctcacacctgtaaccccaacactttgggaagccaagacaggcaaattgcttgaggtcaggggttcgagaccagcctgggcaacatggtgaaaccctctctctaccaaaaatacaaaaattagctgggcatagtcatgcatgtggtcccagctacttgggaggctaaggtgggaggatggcttgagcctgggaggcagaggttgcagtaaaccgagatcattcaactgcattctagcctaggcgacagagccagaccttgtctcaaaaaaaaaaaaaaaaaaaaaaaaggaattctgtgtgtgcttcaaattttcctcattgtacagaacctccttatggtcatcactcctgaaatggaaatctgtacagatgccttattcaaatatctctcattatgtagaaacttcatgtggtttttctggcatatggaaatcccacatgggtgcctctacacggaatggccacaaaggtggtctgatctggttgctggctagggccatagggtggtcacagagcctctgaaccccctctccttgcccctgcagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgtgcctgccatgggccagcctagcccttgtcccttttaatataaaagatatatatatatatatatatatataaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggcccagccagttggtggggccaggccaggaccacacagtccccagactcagctggaagtctacctgctggacagcctccgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagcctcttcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggactaga

SEQ ID NO: 1356 - DNA, 24828 bp, Homo sapiens
ggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaatagtgtttgtattttttctttatctggtttaacacatctaggaaaacataatattataaaaaatatatataatttgtaatataatttttttatgattacaaatactgccttttaaaaattcttacctggataccaaagcactttcacattttttttattgtaatcttgttttttgtaattattttatatttgtctggctttgagttttactgggcttttggttttttggaaatgggggtttatcccaatttagaaatttgtatccttgctgtaatacagtcttccatttttgttcccccaaatctttcatctgtcagaacgtcactcaaaggtgaaaatatttcccacataaaattattctgttcctttaatgaaatgagtttcagctgtatatacgtaggaaaacattcttttttgtcaacttgacgttgacaaacttggtggatgtcaggagtaagggtattcaagagaattttgaagaagaatttaatatagtgagtatcgaagacaactcttaaagagtcttgcgttcaaggggttgtgagaaatgggttgttaatggagggcaatgtagtatcaaaaagctgtttaagattgatgatatagcaggtttgtatgctaatcagactgattcagtagagagaaaaaacataatgccggaaagagagggatattgctgaagccatagacctggtatacaaatagaagggttcgttttaaagataggcacacaaacagctcattagtaacggtaggatgaagggcagattatggagttctagatgtcggtagttcagtaaataggagcatgtcaaatttttgttatattttctcagagaaataggaaacaaggtcataaagagggaggaagtcatgaaggattaaggaaggaaaaggagatgtaaaatgggtatccaggaatgtaggaaagtaaacatactcttaggcaatctgtggtttatttaagtggtatcagtcaatgtggttttgtgtttttctccagttgagttcagcataggtgctatcactgaaaaagtacagaattcaatttaactaaagttgagatttccctaggtgaataagacagtgatgagatgttgttacatttaagagaaagataataaaagagagatatggaaagtaatctgggttaaggagtgaagtgagaaaataaagaaggttgagacagtggaaaatggtatcatcaattgtagattgcagtgtggttgaagatgcattggagttcttgaggtacaaactagaaatttgggagatttaaataagagtggggtggctgaaattgaaattagagtataataatatataatagtactaagtatagtatactaagtatagtataatagtactaagtatagtatactaagtatagtataatagtactaagtatatagtacttagtgattataagttttaggatgtgaggatgggagtagcatagaggcaaggtgatggaaggagatgaattcaagaaattgggaacctaggagattgaaagcattatctaaatgaattttgaaatctcaacaagaactgtgctgagtgctttttgtaattattttatctttactaccctgtgagaagacagcacttccttttgtgagtaatggaaagctctttaatgtgtcaactgtaagatactttattacatttaattatctttagtaattcatgctaacaaataatgacctcagtaggattattcagtagatatgtgagctaaccccctgtgtcagacacctaagagatacaactgatgattttcaagaagaatagagttctcatcccaagtacttaagctgcaaaatgtcccaccctatattttctgaaaacaaacggtatatagagcgtccatttaaaagctaataggaaatcttaaagcgtgcgcgcgcgcacacacacacacacacacacatacatacatacatacatacacacaaaacattgaataagcatcaggaaatatataccctgtacccaacatgcacaaggtctaagcaatgaagaaaaagccaggatatcaagtaagactggaacatctgtgactaatatataaagacttgaggtggttgtatctatttaaaaggttatcaattagaaattaagaaagaggccaggtgcagtggctcacggctgtaatcccagcactttgggaggccaacgcaggtggatcaacgtgaggtcaggattttgagaccagcctggccaacacgatgagacctcgtctctactaaaaatacaaaaaaaattgctgggcatggtggctcatgcctgtggtcccagctactcgggaggctgaggcaggagaatcatttgaacccgaaggtggaggttgcagtgagccgagattgggccactgcactccagcttcagtgatggagttagattaaaaaaaaaaaaagtattttacataagaaattttaattttttgtaaattataaaatagcacttaatatggtatttgtataccgtgatctttgaatatccaaaatttaagaagatgtgagcagttttatgaaacttttcaaagcttagaaaaaggtaactacataaaattccattatatgttatttatgggaacattagatgaagtaagtcataaaaacatgcatagaaatgatcatacaaacttggaagaaattgaatgtcttgctatcgaaggaaaggatggaggtgagaagctctatatattgtatttttctttatatatttaaactcgcatttcttatttttcaaatgttcactccaatgaaaattcttttatttttcctgttagtttttatttctgatctcatatatgcaatatactattgttcataaatattagtgatccgccctgcaaatgaaatactcccatcctgttgaatttgggaatgtccatgtgatttgttttggctgtgaaatgtgagcagaaagattgttttactttggggagttcccgattgctaaagcatgtgtcaaaatgaagtttttgtgacattacaaagggactaataagagtgcctttgttgatcctagttgaacatgagaaacttggttattgtaagccactgaaaaattttagtttcttttattactgcagaataacctattctgtcctgattgatacagccacaacatttccttaagctctttgattttcatatttccattaggatgtagaaagtcaagagaagaataaatcataggatcagagaatattaacagtgaaagagactattggaatgaacttgttcaatggtccagactttgggttctaaataatcagtaatatttcaaaaaaaagtattaaaagatatttcagtataaaaaatgatgacatttaactttgtaaacaacaacaacaaaaacctaccattgctgggcataattagtcatgcttgtaatcccaacaacttgggaggctgaggagggaggaccacttaagctcaggaatttgaggctgcagtgaaccgtgattgcatctctgcactccagcctgggtgacatagggagaccccaactgaaaaaaaaaaaaaaaaagctgtcattaatacatttttcctctgtctctcttcccatcctccttaccacttagtctttaatcttattaaacaagatctaaggataagacaagagaaaggatggttgcatctatactgaacatgtattgagtttttttcgtcattattttgtaaacaacataatataacaagttttgacatggcatttacgttgcattagttattataagtaatctgagatgatgtaaaagttacatgcaaatactacattgtatataaaagactcgagcagttgttgctttaagtatccatggtgggtcctggaaccaattcctcatggatatggagggacgaggaaccactgtagttaaacaaataatcactttaaaacttaaaaccttttgcatggtgaatacagtcgtgcaccgcatatatgatggtggtccagttaagtttattatgccatatttttatcggaagtttcctatgtttaaatatatttaggtacacaagtacactgtgttacagttgcctataatattcagtacaataacatgccttacaggtttgtagcctaggaggaataggctatgccatctacgtttatggaagtccattctatgacatttgcacagtggcttaattacctaagggctttctcttcagaacatactcctgtcattaagcaatgcatgactgtagttggacaaaaaataataatacaggcatacctttggcactgtcctaattcataccagcattcatgattacttagatttacactgggaagccttcaaaaagcagtgatatattaggaaaatatatttgcaatacatgacaaacgataataacataagaactggaaacattcaataagaaaaataataaaagcaaaagaagatggaaaaaggaagcaaatttcaagagaaaactcaaaaggccaaaaaatgtgaaatgatgttcagtcttgctagtaattgggaaaagcacaaatcatttttaatctattaggcaaaaatcagagcgataatatttttggtgggagtgtgacaaaaggtactataatatattgctactagagagtaaaaactgacaggtttgtaagggcaattttgcataatatgaaaatataaaaatgtgcttcaagtttcactacgtttagtctacagaattacctatgtgtaaacatgtatacagatgttcattataacacttcttataacaacaaaatatttggaaatgttcatattaacaagtgcatactatatgatcttagtccaattagaatattcttttttatttcaatcctttaaaagactcaacttctgactgtatatagacaattaaaaaaataatgtgttctccgtatgtgcatttggtcaggttaattaaaacttgttgaaatctgcctgctcttaataaggttgttaaaactctctcataattgtagatttccctattattgtactgtcaatatttttgctttagtaattttaaacatgttataaggtgagtaaacatatatttgttgaatttctagtcagagagtcaaacatttttaattataaatgtacaaccattttactgtggtattaattttgccttagatctttgtccaatactaataaagcctcactgtctttcctttggttagaatttacatcatttatttggttctagctttacctttaccttttttctatctgtttttaaaaaatctgtctaaaaatgcatttagcagaaacatttaatcaatttacattgaattttttttaccctataccacaggaattaggcacattttctgttttgttaatgattagcactgattatacccatgcatattctcacagtccaaagttaatgcctatgtccattgccaaagacaataatgtgaccttagaatacttgaacactgttttattccagtttgcagttgtttttatttttgaaattacttctgtatttttaatcctccaagacattatttttgcagaattttttctactgttaatcttttaaaaattaatcagattaagcagaactcaggttttaaaatattttcatataatattttatttgatttttctaacaatccaatgaaagggaatataagactgattagtaggtaagagctcactgtggagttaggcttcttggctttgaaattcagtcccaacatgtactacaatttgaccattaataaatcccattatttaattttttagtgtttttttctcattttaaaaatgaggataatcatatttctatcatgtagggtacgcgtgtgtgataagtaaaagtgataatgcatagaaatggcacatagtaactatatgttgttagtggttattttatttttatatttatcaacaatatcttcatttcctaattgagaacctagtatgaaatccatagactttaatttttttctaaggttcatacagaaaaaaatgtacatggtgaagcatctagtagatggtgatgcatggagttaatttttttttggttttttgtttgttttgagacggagtctcattcttgttgcccaggctggagtgcagtggcgcagtctcggctcactgcaacctccacctcctgggttcaagcaattctcctgcctctgcctcctaagtagctgggattacaggtgccagataccatgcccagctaatttttgtagttttagtagagacagggttttgctatgttggccaggctggtctcaaagagttaaatttttgatttagtgacactgcttacattctagtctcatttaactaatttaacccagccctatgccaatcgggtctttaaggttattttattttatatggttattttatttttaaggttattttattaagattattttattccctatatgtttattatctatatattccctatatattataaatataaatggttcagggaaaagaaatagagattgcgagaggatattgtagaaaaaggaaggaagacagaaagcagacgagatatagtgtagtaagaagaggtggcagggcagcaaactgagcagaggagagaagacagtggtttgcttaggaaacaggagtgtggtgatcaacctgttgtaatactggagttcagagaagattccttgtacaaatctgatttggagaattggagtaggactctagggccacatattgaaagtaagaggttatagaaaatctataagattctaaattcagcaattttttttccaactgaagaaaaagcaaaaccagaactgtgagatttttattttatgattgtaaaacactcaactgtgggtttgggagattgctgattgagagaagttaatgtggtaagttgttttaatgttttttgagtattatgtaagtcctcctccaactttttgtcttgaaataagtggtttctgtcacatgatttgatatagagtttcacaatctattttcagtttgttgacaaatcatgtttcagtgctgtgcagtacaaaatgtactatttatattgaaaatgtgtcttagccttggctcaaaaggtttctctgatttcagagatctgttaggcaaacttgattatctgtgctttcttttctctaacctttacattgcaacttatcctgagttcaggtttattttctttcttattttattttcaaaagaaaaacagaaaactgttgggggaagggctggtggttgaaggtttactattttgagaaaattgtacctaatttattgcaaaactcagaggaattaagactttattttttagtaagagaaacaactaacttgatcaagttcataaatgtgacattaaggtatttcagttgtaatttttaatcacacttaaattacttccaaagatatttataaggcatctaggctaagaactacgaatgacattaatagataacttgtcttttttttttttttttttgtcaatgttaattcatttgcatgttaaaaaactataatatctggtataaatgtgaggctactttggatagggggaaagaacttgtaaataactgatagttatataagtagaaagggagctctagaaagacaagttatttggaagttgctactttctgcttaacaatagagctctttcattttatttaagtcaaggctttggtgtgatttaagtaggctttgagctaaatgattaaatttatggtacttgatgtgtcaagagggatactgagtttacactagagccgtttccctataatgccatttatattatggatgtcaaaatagatacctcatatatgatattgattgaaaaaatacttttgagaccctcagaaactggctaattttgagttaattcttgataccggatatattttattttttatatgagcccaaatgagaagagagaatatgttttgacactccaaatataaatctttagtgactattgctttgtcgtcaggatattatcaaatgtcctatttcatattcttagggaattcccaagatatgtcatttggcacatgatagtaaccgttagagctttagagtaaagggaagttttctctttgtagagcattctaggaagtacaaaatatgggcaataatgccgtatattactaataactgaatagcttctctaaggataactcttttagaataactatttcagaaagtagatataacaactattttaaatccttatttttgtgtttttgatgccgaagatgctaagaattgtttgtgcagatttttatttcagaagacataaatatactttaattgttttaatgcttctcctatggggtatatagctcttcagattgcttgtttgaggtgaaaattaagatcaaatgagaaaatatatgataatgcctgactcttagtagaagcttattatatgtgtgtctaactctacctttcatgcagtgctaaattccctaaattatatctgcaaattatccctttttttttaccaacattccaaatgcattgtgaaaaatgctgatttgctattacaagaacagagttcattgatctggcattgttgaaaagtatatttcaaaactaccatggatctgccagaaatcctaagcgaataagcaagaagaatactgtgagggaaggaaggaaaaaattgcaggtagaaaatattggtgattctttttcatctctgtccattcctttactggaaatgaaaatacttctgagaagtagaaagtattagaagttaagaagggtagaatgggaagacagaatggccaagtgttagtagagcgaaggcggaaagacagtatgagttgataggatttttaataggaccaggtaaaaatatcaatacaaaaataacattatcaaccatattgagcttttaccatatccatacattgggataacagctttatttgcattattcgtttaatcacaataactctatgaggtaaacattactttttctagttaatagatacatttagagaagttattttccagcatcacacaggttataaatggaaaagtcaggatttatagtttgtcttaactcctaataattgcgttttcacatttggaaccttgagtcaagcatgaagttcaaatggtgcccctcttctctgtcaactctttacaccatcagccctgtatcactatctagtcagtcttctatttaaattctgatactcacccgtatccagttagtttgttgtactccctgcaaattttccttccctatttgcttttaaaaatcatctcgggtaataaaactccctttgctactttgaaggcacctctttattatctccttcctactccctgtaccccatcatttataaagcttggtgacttcatccaatatcttttttggtattttgtcagccctcaagggtacaactctccaggcctgataattcagccagtgtacactgccctctgtatagtagttgcttagggatagcatctgttctgttcagtgtctgtgttaaatcagttaagtattttttgttccatttcttagactgtcattgctttgttgaaaactaccaattctctgcttctttcttcatatctttttttaattgtttttatatacccatttgttttaaaaatggtacctctaattcaatatgtccccatattcatcggtttctctaaaccaaatctgcctttagattgcactatcagtcataaagacattgccattctaatattcacccaaagtttaaatcacagagtccccatttgactctttatattctctattctcttatatctgattaaccaccattttctgtacagtctccaccaagtctgttatatctcccctctctgttttacataaacatttcccctctattccaggggtatatgttccaagacccccagcaggtgcctgaaaccacagatagtaccaagccttttgcagtcatctctccagtatctgtgggggattggttccaggacctcccatggataccaaaatctacagatgctcaagtgccttatataaaatagcatagtatttgcatataaccaatgcacatcctcctgtatactttaaatcatctctatattgctagagatgtaatatctactgtaatataaatgctatgcagatagttacattgtttagggaataatgacagaaaagtctatatgttcagtacagatgcaactatccttctttaaaaatatgttcttccacagttggttgaatctggcgatgtggaacccatggatatggagggctgactatatacaccatgttttttcctggcacatcactcaactactattagctggcgagtcaactcacgttgttggaatgactagggacaactagacttcaagtgatctttcatcccaggtaggctcacaacacaatgtatgatctcagagttccaagagatcaaactcccttctgcaaaccccagtcaaactttgcttgtgtcttgtttgctgatatcccatcggataaaacaaatatcaagctaattccatagtctttgtagagagagactttatataggtatggatactgggaagtgtcattcattggatgccctttaatataactatcacacttccctaattttcattcttactgctgtaatcctaattcagatttctgtcactgctctgcttactaatgttcctatctctttgttttctggtccatctgatataattaaaagtttttattattactttcctgtttaaaacaaccaaaaaaccttctgaggtaagtacttttttcttctccctgattttgagtgtccccaatatacctttccaaatttaactgtcatgtctccctcacacttgacttgtttctaaaacactgtattgacttcttgccattttccttgctcttctacatgtttttcttacttaaaagcaattttacctatctcttttcattgatgtcaaacccattcttcaagtcaattttatctccccttattcccatctgtcagaaagaacttttcctaccaattaaatcctgaagcacttaatcgtaaccctcttaaaactatgttcatatctttcactttattgtttgtttttgtgtatggacatatcccttctctaactgaacataacttctagaacagctctgtctaatacaaatagaatgtaaatcatatatgtaatttaacgtattttactaactgcattaaaagaaaccaaaagacactagggaaattaatattaatggtaaattctgtttagcctaatgtatcacagtatgttatttcaacctgtaaacatcataaaaatatatttttttactttttattttcacactatccgagtgtgttttacacttactactcatctctgttgaaaccacatacatttcaactggttagtagccaattgtttctagtggctaccatattagacatcacaactctagaattctaggagaaacattagtgtagtacagagaatgttgacttgcaatcagacttattatcaaatcctgtctttgtcacttaccatatgagcctggacaatttacccagtctgtctgggccttagttccaacatgtgtacaacacttttgctaggattagagtcaagtttattgcacaatttctaatatagagttcattgatttttagaaaatcaatgaggacataacccatgttatgccaatgttttgcacaatacctggaacctagagttttcatgttatagccatttattgagcacataagacaatgtcaatcattttactaggatttggaaatactagatatgaagtctaacttcaagaagcttggtccagaatgacagacaagtaaattgttaattataatatacttacaaaagaagtcaaatatagcttaatgtcatataaattaagaagctttcatacaacagaggagctaactatgcttgagaatatgagggtaagcttcataaagttgtggtttcaacttaatgtggaaggaaaagtagttgcttccacactaagttggatgtggaaggggatgatatgggaaacaaaaccactaggaaattcatgaaggtatgatatttcatataaaatatgaggaacttctagttttgcaatgaacagagttcacaggattggctggcggaaggaccaaagggcagcatcaggatcgacagtggaatagttaagatccacagctctcctgatacccttcgtcaaagctggtacttcctcattttgtctcatgttaaaaaatggtatcatccccaaatacctatatctttaatatttttcctcatccttcagctctaatctattcataaatctactgcctgtttacctctgaaatataccttgtctatgccctagtccaagccactcacctctttcctggaccactgtaaaagtcttctaacatctacccctttccactcttatcctcctataatctggtttcttcccagaagcagggtgattttcttttaaagtttattagtctttcagttccccatgtcacagccttaacagctctctctttcttcatgttctacaaggttctacatgatctggcctacctctctgatctcatctcattttatcccaccctttatcacatgtgctctagccacactgatttctttttaatgtgtcttatgtactagctttttcctttcttgggacattactcttgctctttcctctatctgttgctctttctctgatctctaaatgactggacacttctaatccttcaaatcacatcataaagtcactcttttaagggatgtcttcccttaccatccagtctataataccctgatggaaaagtcactttctattttatgattttatactagttcttattgctatctgaaattatttttatcatcactgttagtactgttgctattactgttatttactaatatattttcttttctttccactagaatgtaagttctctgagaacagaaacctgtctttttcataattgtctcctgaacatcacctacagtgcttagcaaaaagcagacacacacttaacacttgttgaatggatggatgaagtttttcctacctgtactattactccctttcatagcatttcacttacattacattaagaaggaaaaattacacaaatttatttatttagcattttgtcaggtacaagaaatatttgcctacagggagaaaaccaccaccaccaccaatcctactactatatgcactatattaagcacatgagttgatcaaggggaaaaaagttagtttctccaattcatgggctttgagattttaaacgttttcttaaatcattaatggagaaatttaaataaccaaaactttgaattaaggatgggaaacagggctgattttaaaaatggaaatatcacataatatgtctgtttgaaatggaaacatgacaaaaatttgaaaatagttaaatattttgagaattcagttggcttcaattgttattttctattagtgacggatatcacaaacaaaagacagtccttatttgttattaggatttatatatatacacacatatataaagactatatagactatatatatatacactgcattatatatatatggaatatatatatgtttgtgtatatatatatgtttgtatgtatgtgtgtgtatatatatatgtttgttctcatgctgctataaagaagtgtccaagactgagtaatatataaaggaaaaagattcaatccactcacagttccacatgactgaggaagcctcaggaaatgtacaatcatggtggaaggggaagcaaacccatccttcttcacttgatggcaggaaggagaaattctgagcaaaagggggaaaagccccttatgcaaccatgaggtcttgggagaactcactcactatcatgaaaacatctgtatgggattaccgcccccatgattcaatttcagttacctcctaccaggtccctctcataacacatgggggttatgggaactacattcaagatgagatttgggtggggacacagccaaaccatacatatatacatatatacacacacgcacacacacacagagtctatatatacatacacacacacacataaggactgtgtagatatgtgtgtgtttgtgtatatatatatataaatacagtccttatgtgtttaaatatatatttactgtccttatttatgtgggtttgtgtgtgtgtgtgtgtgtgtgtgtgtgtgtgtgtgtacactgccagaggtttaaaaaggttaagattttatcagtaagaaaaaaccagtcacctctgccagcccatgcaccatgttgtcctgccgctccactgtcccactcctccaccagtcgcaatggaagaagagattgccgtactggtgattgacaatggctccagcatgtgcaaagctggctttgctggggacgacaacccccagccatgtttccttccatcatcggtgcccccggcaccagggcatgatggtgggcatgggccagagggactcctatgtgggctacatggctgagagcaagcacagtatcctgaccctgaagtacccccattaagcatggtatcatgaccaactgggatgacatagagaagatctggcatcacaccttctacaagggactgcacatggccttggaggagcacctggtgctgctgaccgaggaccccctgaacctcaaggccaacagagagaagatgactcagatcatgtttgataccttcaacaccctggccatgtacgtggccatccaggctaggctgtccctctacacctgtggttgcacactggcattgtcatgggctttggagatggggtcacccacatggtgcccatctataagggctacgccctccctgacaccattctgcatctggacctggctggccaggacctgaccaactacctcatgaagatccttaccaaggttggctatagcttcagcaccactgccgagcgggagatcagacactacgtcaaggagaaactgtgctatgttgccctggactttgagcagtagatggccactgccacatcctcctcctccctggagaagagatatgagctgcctgatggccatgtcatcaccatcggcaatgaggttgcagtgtcccgagacgctgttccagccttccttcctggacatggaatcttgtggcatccacccagaccatcttcaactccatcatgaagtgtgacgtggacatccgcaaagacctgtaggccaacacggtgctatctggtggcaacatgtacccaggcatcaccgacaggatgcagaaggagatcaccacccgggcacctagcaccatgaagatcaagatgatcgcatccccagagcacaagtactccgtgtggatcagcggctccatcctggcctcactgtcagccttccagcagatgtggattagcaagcaatagtacaatgacttggccccctccatcgtccaccgcaaatgcttctaaatggactgtgagcagatggctagcaattgcttcatgggttaattcagaagtaaaaatttgcccctggcaaatgcatacacctcatgctagcctcaccaaactggaataagccttagaaaataagttgtctttaaagcttgtatctgatatcagcactggattgtagaacttgttcctgattttgacattgtattcaagttaactgttccccttggtatctgtacatatctttgatttcagtctttagtacatgtggcttggtcacttcatggctaaaaacgtacttgtggaagacaagtctggcttggtgagtctgcatggccagcagtctctgatctgtgcagggtattaatgtgtcaggactgagtgttctgggatttgtctacaggctggtaagggctccttaaccagttgtttctgtcctgtcggtctgtcagggttggaaagtccaagccataggacccagtttcctttcttagcttctgttgtctgccagaacaccatgggctgttactcgccttgagttggaagcggtttgcatttatacctataaatgtattcatccttttaatttatgtaaagtttttttgtatgcaattctcgatctttaaagagatgacaacaaattttggttttctactgttacgtgagaacattaggccccagcaatatatcattgtgtatggaaaaataaaagtgctgccagaaccaaaaaaacattaatttctaaaaggtcatttagatgatttccatgagagactttttaatgttcttctcctgttaggattattattgataatccttttcagattatgagtaaacagtttgccctcaagtatttattcatgctaatatttactttgtaaaatgtgcttcttacaggaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtgggtatgattcatagtatcaattgcagaattcactatgcttgtagtaaatagtattctgatcttatccgtgaagcttaggcaacattttacttcacaggtaagtattctaagtaagagttttctgaggaaaaaacaatgtagtattcttggcaactttatattttgtttctgagataatctttcttcaacaagagccctccaatgtgctgttaatattttcaagagatagctgcatataccaagattcaagaattttttatattattgattagtttctagaacattcaatgatatagagtaagaatttggtagttatgaagactgtttaatttgtaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggtaagtgaattctagtttccttgaaaaataacagataggaaaatgatttctctctcttctttcttgctccttttcagcagaaagttttccatattttatttttttaattttacttcatactttaaaactcaaaattaaccgttgccttatgttcagcttttgtaaatatttgtgtatgtgctctctatctaccaaagaaacaagtttaaagcagaatttacttctaaagcaaaacatcaaattttaacttttatacctatctatatttcctggaaagagttttctggttaagagttataattccagttacaatatttgctatcatttttaggtgacttgtatctccatccataattcctgggtttttcgtggtgactagctagcttctctatttaatgaggagcataatttgagactaatagctcccttatttgtcttcaaaagcttagtagagagtacaggctttctcctggtgaccgactgtaatttccaaaacagtaacctttccagtctcatctgagttttgtctccccgaaatgggctttttgcatttcctcctatttatggtagtttctggttctctcaatttaccattactataaatatttgaccaagtgtctagaaggcatgtaggtgtttagttcacattacttcttcacagttgatttttgatcttgtaggaaaatagttataagatatcatgaaatattttggagttttattaacatactataaacttgaatcaataatgctttaaatttctgcctctctgtaagtcacactgaagtagaaactttgctttctaggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtaaatttttttatgagagtcatctgaataaggggtgatatatgccttttcttgtagacatgtagctaattgaacttcattttaaatacgaatttagatctcttagggacacaggttaacaggtttgactactttaagaaactcaaatccatatttaaaaacttaaatatagatttaagatttttaatcaatacacatttgcccacttttaaaaagctcccaaccaattaaaaagctcgtcgactttatttcctaaattctctattttctattagaaaatatttccaagatacatctatagtagaatgtgagcatccccagcgcccaatgcaaggaagtcactatagaatatctcttgaggaatcatggaataaatgaataatcaaatggattctcatgtgaaaaatgaggttttatgaatcaatcataacatttttacctcaacaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtacatcaatacatatatgcatataaaatatcatcttattcattagaaaataatggcagatttaattaaaaatgcaatttctataggataaggactgagtcatttatataaaatggtgttctttaacctcctcttcacatacagcatatctaattctttatcacaaacaaaacaaaacaagacaaaaagaaataataaatagcttaatttattaataaataacaaatagcttaaagctatcttttatataatattaacttattggttaaaatgctttaaagtccttatgcaaaatgttactttttcctaattttctactaggtaattgatctgggtggtgagccaattaaaagcagtgactactttggaaatggccgggtgacagaattcaagtatggtgcaaaactcggcacagttattcgcaagtggaatggagagaagatgtcttacctaaagtaaataaatacaacttttcccctgaagtatttcatagatttattagtcatagtaccccagtgtgagttatcttctggaacattctttttcagacaactatcaaggagtcaattgttaatgataagtattctagtgccctaaactctaatcaatcatcttttgtatttagagtgtctatcacaagtgagtatgcctaggaacgctaaacatatcctaggagtttccgtctaagtacgagatgaatatactggatttgactgatgtttgcatataatcttttaaagccaggttattattaaaatgatcctatcatttataaagtatgtacaaagtttccatactgtagaatttacatatattatatgaattaaaaatataaaaatatttatattataacaatacagtattgaagccttattttaacctagtttgacattccgtaaaatgtgatatggatattgatccttctggagtgcctctaaatgataatgtgctgaaacctctgaaaggaccttttttaataacaaaaatcttatatttgtaatatgaatataagtattccatacttgtatatacgaatatagactacatatgtagattacacacgtgtgtgtatatggtgtgtgtgtgtatatatatttgagtgtgtgtttgtgtgtgtgtatgtatatatatatatatatatatatatcttacagaataaccatttaattagagaaagaatttaatcttcagatgccatgccatgcagaaagagatgcacagttaagttactcgcaaactattgtgaaatgatacatcaacatatatcttatttttcaaaaataggaactggggagaaggttggggtttcatgccttctgacagagcacttgtctttgtggataaccatgacaatcaacgaggacatggggctggaggagcctctattcttaccttctgggatgctaggtagaaaaccaagttctctattttttttaacacatcttttaatgatggtaatgatattctgatattctgtgataatataattatgtaactttcaggctgtataaaatggcagttggatttatgcttgctcatccttatggttttacacgagtaatgtcaagctaccgttggccaagacagtttcaaaatggaaacgtaagttttgaaattgttcaaactatccttttctcaagaaacagaaggcaatcttgttctaacttaatatgacaactattaattatatattcaacaaataattgattagaaacctgatatagggctgcgattttagtaatgcaggttatattaaaggagtaaaatatatattttccattgacaaagagtatgcaagccttttcagacatatgataaacatccccctagcccacaggaaaaaaaaaaaaaccacttaaaaataagagctaggcacagggattaaaatatatacttcgaataagtacctacctcagggttaataggaagattatacatgccaacacttttagagaacttaaaacatcatctgcccacagtaagaacaatataaatgttcgttaaatatttttaaaaagttatatggaatacaaaaaaatgattcagttgagctgagttaaatagggaaaagtatctaataagaggaaggaaattatatgtactaaagaatggaaatttagagagtattccaagaaaggtaagaatgagaaaaatatttgggagtatggtaaagacatttatctgatgagtagtttcaaaaaggaacagagaaataagagtgtacagatatttggaaagctagtagaaggttttctttaaactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagcaaaaaaacaatattcccattttacaaatgaggaaactgagacacagagaaattatgtatgttgattaaattttcttagctactgttaatagagcctatgttttaatcctggtgtttctggtactaatgcccttcccatttcaatgacattgcatggcttacagtgatgttaagaagcccttgcaggccaggtgctgtggctcacacctgtaatcccagcacttggcgagtccaggcgagaagatcagctgacctgaggagttcaagacctatctgggcaagctagcaagacctcgtctttactgaaaattttttaaaaattagctggttgcggtggtgcacaccaacagtcttagctacttaggaggctgagataggaggatcgcttgagcctgggagatcaaggctgcagtgagctatgattatgccactgtactccagcctgggtgacagagcaaagaagcctttgcagttccttggaatgaaaaggagaggataacaatttgttacctttgtttgaaatatggcaaaagagaaccagaggatagagagatgatgaagacccagtaaagggctataaaaattattgaaggcattggattctagataaagtcattgaatgcagagacacaagtaacaggataggttgggtttggtttaaaggagaaggaagaggtaaatatatgtatgttaaaatttggcttttcaccccctaattaaggatgttaatgattgggttgggccaccaaataataatggagtaattaaagaagttactattaatccagacactacttgtggcaatgactgggtctgtgaacatcgatggcgccaaataaggtgagaatatgtatttagacatgtcctctaatagtaaactttccattgcattttatttaaaacagttgaagtttaagaatatcaacgttttatatggtattgtgtttttaggaacatggttaatttccgcaatgtagtggatggccagccttttacaaactggtatgataatgggagcaaccaagtggcttttgggagaggaaacagaggattcattgttttcaacaatgatgactggtaagtacatatcaattaaaaataatattttgtacctgtatgctcttggtttattcctttttttctgttcattgacatttatcatatctgaaaaatcatgtagtcagtggagcaagaagacaatagacatcaaaattgggcagaagtaaaaagatgatggctgttactccttcattctcctgttttattaagggctttctgttgtaagcagagtcctttctgtgcacccttgcaatatcttatgcatatattgaatgcacatacatatgctcacctacacatgccacaaaatacacaaagtagttaatatgaggattgtgaaatcattaaaagaacatgtcttatattcctgtttttttaatcatggaaaaatgctgcctgagtactaatatatctttatttctaactctttttctcaatgactgctctatgtagttttttggtatactttcttcacttctctgtctccttgtgacaaataatatttttaaagcatatgcataaataatatgtatcttgtggttaatgattggcttcaggggatttgagttttagttccgaaacttctcattattggcctttcatctgtgattcttatatcctttactgaagtataaatgattccctaacctatagctcagaagacctcgttgcaaacagttgaattgtctctgtccaaagccaactgatactcatacttagctcattctagtataaattatatttcactgatgaaaaataaataaatacataaatacataaatctagttgatctctttcctgccaaaaaagcccatgtctagttctttaatttctttcttttgtggatgaaaataccaaaataaatttttgtgagaaagctttatatttcaaactatcacttcttcatagaaatgctagattgtttctatgtatgccccaaattcttttttaccttatggggaaaaaaggagattaaaaaaataaaaccctttaaaaatttttttttaaattatactttaaattttagggtacggggaggggggagggatagcattgggagatatacctaatgctagatgacgagttagtgggtgcagcgcaccagcatggcacatgtatacttatgtaaccctttaaatttttaaaagtaatttgtattaagttcagttgagaacaaatttgattttaacaagctagcacttttatcaaagtgtgaccattcctgccaatcttcagtgatattcttcaactttgattttttggtaatattttcactacggaccagggaactgctacattttctgtaaggttacttttggtcctagaaagctatttacaactactagggaggcatatgggttttcttcttaatgagacttcactgcttagggttctacaacataaagttatgctgtttagttgtgttagcctgtattcttgattttcagtgtattgaagttaaatctgaaattttattttacaggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaa

SEQ ID NO: 1357 - DNA, 379963 bp, Homo sapiens
aataactgttcagctacaaaattttattggtatctttttatgttccctctagaggatgtaatgcacaaaagcattgccacggaacatataaaattacaaatgaaatttattgtaaaaagtagaatgtcttctagactggtgtcagtatttatgtcattcataaaccaaaactgctgtataatatattcattgtcagcaagttcatgtgtgtaaattgccatccaatgttattgactgatataagacagatattgaaaagacaatttaaatttactcttccaaacataaactgttccacaaaagcactgtaaaaactccttcaagattttgggttgtgcttgacatttatggttaactacataatttggtcgtgtcataatccattgtgtttggcaatttggcattaaacgcctgcagagcagattggatcctcaccacctcactagtagacagcttgagtctatgacgaagcaagcaagagaaaagatctagacgacgctgaccaggtggggagagtttatttacacggtctctgatctctagtagttgcaaaagtgctgaatcctgggatccctgagtataggggtagtccagctgcaaaatcaggtcccgaattgcttcagggtcaaagtgcatgctgtagccaaacacttgaatgttattgattttcatatagcccaggttccgggaagggtcaataaactccagaggttcatagtaaatgctctcattaccattgggaccattggacttgatgcgacttctcaggtagatgtgtactgtctcaaaaaatgtcttccatttgttccccagagttaatgtccagttataacactgcaggggtaggtccaacttagtccgctcccagtctggaaagctgttttcattcacaggcataaaccagctctcagagtggctgcctccgaagggattgacataaacagccaacactggctccaaggtgctgtttttagttaagcaaatctgtaaagagagacccaaaatcatatggaccagacttgacttgtacttattgctcttcaaggtgaggagcatccgcttacgccaggagggatcaaaccagctattgaggcgcatgtcattgctgataaaaatggcatggacttctattcgtctgtccgttttctgcagcagatatttcatctcgagatcttgcaggtcagtttcaaagccaatatagtgatcggtggactcggcgacttcaggcttgcagagcccctggctgagcatgtagccggtgttgcaggtgccgcagcgggtgcggttgtctggtgcgcatgtcaggcaggcagaggcgtctcccactgtgcagggcaggaacgcggtgcagaccacctggtcattcggacacgtgcacgagtgcgtctcttctgaaaagctgcctaggaggccgttctcattgcagtagagaaaagactggatgcgagtaagccagtaggttgaggttctagaaatacaaaacagaacgaatctacataaatacaaagatattctgtgtactgcagtaaaccgtagctcagaaatctttgctatcatttcttcaggtcatctccagccagtaatttaaatgaaataaaagattcatagagctcataattagactatataatacacacacacacacacacacacacacacacagacgtgtgtatgtatattccatttatcactgcacaaaacaagattagagctatacttggtctgaactgcaatacatttctaaatatgtgatatcttctaaagacattgcatgctatctcattagtgcacatggaagaccattgtaaataaaaatgggtcattattgttttgaaataagaagaagaaaggtaagtgattttatcataaaatatctgtaggagaattagagcatatacatggtgattgttcattcatttactcttagctttataaaccactagtgttgcaggaaggatgaatagaaagtaaaagaaaaatgaaagaaaaacagctctaaattgtcaatcagtgtatttagatgctagggttgtcatcaacattgaaagaacaagtacccactcaaagaaatattaaaacatgtttattcttacaggctgctcaagaaaatagttgaaaatatctcattaaaatcaacaagctccttcaataaggggtaagtgtgttagtttaatgtgtttgatttgagtcattaacattttttttctcatcaggttaatcatgattcctttttcaaatctcacttttctgattttctcgcattatttaaactattttggtgtcttaaaaccagtaaaataatgagggaagagcaatggccttgtaataacacaattccttgttttcagtttgttgctttctcatactgcatgtatgatcatgggaaaagttgcacagcctctataacacacagttctctcatatgaaaaatgggaatagtaatatcgtccatgttgagattttgtgagaaataaattaaggtcaaactctatgcatgtacttagaatattgcaaagtgtctgtttcacagtagatacacaacaattccatttttggtattcttatgcttttttggtgttcacatttaatacattttggatttcctgcaaaatatatatgctgtactcaatcctttaaatatctacttactgtttttcatagtgcatttttctgcttaagattttgtattactgtgtatttacttatttatattgtttttctcattacatataatacccatttgccaaaatcttgtatgttttctttcatagctacataacctgtgcccagtagaatgccaggagataacaagcctttaatatttattgaatattgaataaaatgcatggattagccaaaggaacattttcttaagaagggtatttttaagtgaattttaaaccctaaactgaatatttaatacacttggaaaatcctagctctgaagtagcaggtagtaaagtaatacaacactttatttgacatttgcacaattaaaaacacgcaaaagcctttcttgtccagcttctgtaaatgcaactgtgtcgtatatactcagaataaaagaaaaaaataaatcaaatctaagccaaccataaaacattttccttttaattatttcttatactgaaaatcactgattgaaattttaaacctattagattcatggtttgaatatgtcccccaaagttcatgtgctgggaacttgattgttaatgcagtgatattgtgaggtggtatctaatggaatatgatgtgtccttggagaaatgccctcatgaacagattaatgcccttatcttgggagttagtttcttataattgggcaagtttggctcctttttgctctctgtcttgccctctctttgctcttccaccatgagatgatgcagcaaaaaggccctcaccagatgccagtcttttgatcttgactttccagactccagaaacctgaaccaatacatttctgttcattataattaccgagtctgtgatattctcttacagcagcatgaagtggactaagataatttatttctgaatttctccagatacttttaagataaattctctcaaaaattctcccaaaagtatgcccagtgtgttgtgaaataacaaaaatgtgaggctatttggcacttcataaacattacatcaatatatgagtgtctctgctactcttgctgtggttccttgttttctcaccacagaatatatgtgcaaaaagcttcctattgctggtttataaaatagcttgattaatcatttctgtattcagtcttacaatgcagatgttaatactacagattcatcatttacagttactgacatgtttatgccatttcattctttttctcaatcacattctttcctcctttatgccttcctttttctttcttcctttttcattgctacctttctctttctctgtcctctcctgtttttgcttctttattcagttctcatttatgtatatctaatataaactacataaaatatacatcctatccagatgaaaattatattttcttccctgaaaccaaagaattaattccttgagccaactcatctcccactgtaagctctaatcatgtttccaaatcataagaagaaaacaaaaaatgaaattaatagacctaaggcaaagatagagctcacaaaagtagggcactgtagaaagaatcatttggacactttagaaaagcaagaacttttttcagctttctgtcttttccaatcctttgcatgtctggcaaatacattatggaaggaaagcgtttcggctgttggatttcagcttcttgggtttcagctctcatgtatgaatactgataattcagcatactgccaaagctctggtaccctgggactaaggagatagtatgtagattttcttacttgctcctttgcgtcctttttcctctagcacctaccttttgactattttgctacattctacaaggaggaaatagatttttcaagaaagaagaaatttagttacctgtcttttctttactccttgtgtaatcttagtgaaagcagcagtcaaaaataaagactaagcaaattgcagaattgtataatgaatttttcacataggtggttcccccacccaacaaggtaaaatttagttccccttactttatcttaaaactgtaaaagaattttggagacaaatgtcctaacaattcaaaattagtttgtatcaagtgtatttccactttgtttctttttatgcttaagtattaacacaaataaaagaagccacattttattcatgtatacacattggttagacacactatttacggtctacttgggctaagaattgtgaccacatgggtggcaagtaggtcttctgttgttttttatcaaacaggtggcaatatccctgacatctgcttaataatacttcagtaaacattctaaataaaagaaggaaaaaaggaagggagaaagaagacagagagaaactaaggaaagggaggggataaatacattatagtgaaggaactacagattatggaggaacagaagaaggaaactagaatgcaaactttaaaaaagcaattgacatgataaataccatgatttcgaccaattcaaggatatagagaatctttatctataaggaagagtttaagttttgaaaataattcctcaaaaatcttttaggtgaaagaattatgagcagaaaaatatcttccggagttcacttaaaatttaactggaaaaattaatcattagctaaaaggccattaatgtttataccactgagaaatcatgtgacatactagtttgaaatgtttagacagctgtttcttctagtcatctttgttcaacctataatattttccatttatttaagatttgctcttctccacaggatacacattatacatgtgtcaaaagaggactagagtaggagtgtgaatatctgactttacagccatactttaccctgtgccctgtgacgagttacttagcttctttaaccttcagcagaagctttggaattcaagcaaatatttgttcaaattatgattctgcatgactgtggactatcgatagttttctgagtcccaatgtgttaaactgtgatttcacttgctgatctgttgccaggatgaaaggatataacaggtaaaacccacctacgacagagtcttacactgggtaaatgctcataatgaaacaacatgaattaaatgtttgactatacattttttttgttttaaagaaaatcaacttaagatatgattatttctctcattaaagatgttaggtatgattggtgaaccaagttcctgggccccatcccagacataagaatttctaggagtaggattcaggaatctcatgttaaaatatgcagtcccagagaactattacgtatacacagaggttgcaaggtccattatgtatgtaaatcaacaacccaaaactgttattagggattccttaaataccagctaaccatcaatatggaggaatatgtctacaagaaggtaaggaaaagttgaaagttctgtagagaagaggacaacagcagatggcttttaatttatatgcattttggggctccgtggcaactatgtacaataaaatttataaactgtagtagaaattttacacataagaagaataagccacacactaaagcctgtcataatacatcacttctgttctggtccagtaatattaactgtttggtgaacatctctcattctggggccagtcactttttttttttttaatttcatctcctttcagtagtttgtaaatgctaatcccattttaaaatttgaatacaattgaaccttatcaattttaatgacttagttacatatctattaagcattagaatgaagacaaactcagaggaaaaaatctaaatattattttttaaatatgtgttgaaagttttgtttcacagaataatggagtgagggagggggcagatggaagcacttaacaacctcagggaaaacagtcatttattgccatagcaggacaacatcaaagatacaataacttttatttgtgatgtaacatttaggttcttgagtgacaatacactatattagcttgagaccattttcttaggagccagactgtccactttgaatcctgttcatttacttcacctggaaaataggaattaaatatagggttgtgctaagaattaaagcacagttgcaggtaaagcatttaaaagaatgcctgtgcacagaataaacaggaaataaatgtaaactcttattcctattatgaatgttattcctactatcatcttttaaagaaatattgtaggcattttctttattatagccactttttttttctcagaagatggaacatttcgttttctcttcaacaattcatgcactcacgcatagtattacactatatacctgtgtttcacctttttaaaaatagatgccattttaataacatgatcaagactatattgaaatatacttgtatgacttctttgtgatccttttgaaaccctcaaaaatatggaaaacaatattgctcaaattcaggacagacattctagatgtgtaacgcttttcactgaagtattagaacatatgttgatagaaaaacaattacctcgtctcatggttaaatctgctctgagcagtaataatcttatttcaaaggtcccttattccaaccttctaatcctttattgctctccaaatctgtgcaatgtggatacaaactttaaaacctaaactatataatttcagaatctttttgaagttaaagattagcacttttttatggttaggctattttatttcagccttcatagatttgttattctcagacatgaatactttaaatataaatttggaattaggcatccacagccatttaagcaagcataagctgattattagctcagtcacagacagataaaaccaaataaaattctgtcactgtctctccagactcttgctctggccatctcagttttggcagcgttgcctagggctgatgttgacactcctgacacacaacagtttcactcttggaaatacttttgcactctgagaaagggaaatgtcactttcaaagatccctcaactttgagtctctcaagaaagtacacacacacacatacacacacacacactttaatttattaacctaaattcaattatctactaataattttggcttgcaagaaggcaatgaataagtgtgtgaagcagttgaatgtgtaagttatattttaaagataatattagctgatgttaacattcattgagcttttctcatgtgcacagttatattacaaggattatttcattttcacaactctcactactccctgatataagtatgcttgttatcctaacataaataaacacacaagttttaagaagtttaaataactagaacctgtccaagatctagcagctagtgagtgtcagagctaaaggtttacccctggtctctatttctccagaatcacagcttcttatcgtcatgaactgatgtaattcaaataatttattatttaatctggttaagtggtgtacacagaaaaatgtgcttacttctcaaagagctatagaaattttctgtccacatctatgcagcataatatagttcaaaaaaatcaatagataaatctctcttccacttataatataaaatataaaaagaaacacatcaacttttaaagtgagaaacatgagtcacacaaagataaacacaattacttttctggaagtaaaaaaattaccaaaaataactatattttaaaaattagcgtacacatgcgattttctatcaaagattactgtcaattgaaatatatttttcactaaatcatatatattaaaataaaaaggtttaaaaagtattattataggcaagttcatgctgttaagtgattagtgtgattgaggaatatggatacatgcaactattctgcaaataggagccatcaggcctctcctatgttcttttataacatcttggtattcacccccccataatattcattacaccaggtcactgttatcaaaccagctacataatttgtattctgtgagataaaacaattatatacatacacatatatataatgaaaatgattttatatatataacatatgtttatttcataattttattatcataaagtacctaagtcagtttacagtgtttatgtttaaatctttgcattgcaaccttcaaaacctttattgctcttaaaatctctgcattatgaattcaaatttgaaaatctaaacaataaattttaaggattttaaaagtataatattatttttaaaaggtcatttcatttcatccttcatagatctgttcgtctgtgaccctaatatttgaaactaaatataaatttgttatgaataaatacattaattaacaacatagagaggaagctagaaaagcaagtgcagacttaaactagaaatgttcttggttgtaaaggatttttaaaaacatatatttatttattattattttttattatactttaagttttagggtacctgtgcacaatgatttaatacttttttcttactacccagtgagtggtagacattttaaaacctggacttattttcataatatctgtttttctttaaaatatgtttcatgaccaatttcccattagtttaaagacaaatcaatatatttttcttgttgaacattgaaaacctgaaaacaaatgaaattgtataatttaaataatttaatgaaattttagtgtgcttccaaaagtggtacaatttagcatccctttaaaccaaatgtttctggactcactacttactctctttttacaatcatcgttgttgttctcaatgctgaatatcagctcattcctttgtgtcacaattaaagcaagaatttggtttctgaaaatcttgaatgtagtttttgtaaaatagttttattagatttgtattgccaagctaatctacttaaattgatcaatttctgattggatgacatcctaatacctttcatataaaaatataaattattttgaagcctttacattctgacaacatctagttgtcattactcaataagatattttcttcgaagcctttacattctgacaacatctagctgtcattactcaataacatattttccacacttaaaaatctgtccttgttaccctcctaaatatgtcatgtacaatttcaactacgtggaattttcttttacagaatcgaatgtcctttttcctctgcttagccagtttaagatttaaattcaatttttcttaccctaaatgatcttccttaacaatctaacttacaatgacttacttttttggacaagtgtgttaattattatctatatcacttatttgtaattaagcccactataacaatatagtgttgtataatagattcttatcttgtgatttcaactaaaatataccattcctgatagtatctgtgtttgtctatatgttagctttcctaattggagtatgatctcctaagaaagaagaaaatgtatattgttacactagaatccctagagtccaagaaagtgctttttctcccaacccctccaaacaaaattgctagatcaaaattgacctcgacttatgttggcgagaaaatgtaacagtgaacactcttaaaaactcttttactggggaaaatcaaataattatggcactgaattttttttaatgaatttatgatctggaaaataataatctgatttctggtattgtaagtcatgtgactgctatgtcatcaaataacaatatggccttctagactctatattattgtttaggagtttgattgactaaaatgtaatttcaaaactggtcatctttaaaatgctaatgtagatggagatactggagctgaatagttgtcagaaactgggccattaaaaaacaaaacaaaacaaaaaacaccaagataatatcaccttctaggaatccttgataggtgaacttcatcgatcaaaaatgtcacccaagtcacactcgcaatgcaagagctttatattaacattttctagtggttggaataaaattctgaactcagaatcataaccgcattaatagagatgccacaaaatcaccaggaaataataggttatacggcccttacaaatgttaccttttatgagcataagcaaatcgtgtgtgtgtgtgtgtgtgcgcacacgctggtataaaatttgtacaatggtttaaggaatgacaattcataactttaaaagtcggctcatttaaaatactaatagaaacagtaaaatgtggtcctgtttcacatgactttgcttttcagggagaagagtacataggtattatctcttaatttttctaacaatttaatatgacattatgtttacagaaaataaaatcagaatgtataaaatgactgttctaaagacagaagcaatctagtatgcctaaccatctatggccacattattttccagatgagactacaaacaatgatgaattaacttaaattactatctcacatctacatagaaaacaaatatttaatccttggttttccagacaaagttacaaaatgtagaccatctccctcacctcagtgacaagacttctcactaaccaaaatatcatctgattggaaaaaaaatgagtctctttggatgatatcagcaatcacgcaaatcaaataggtgttcaaaatacactgttctctcttacttgtggggtaaaccacagcaatacaaatgagagccttttatcagctggcaggaagatagaaatttgtgttacttgaagagcttcatctgttcagttagcagggagaagatccgtaagttttttccttagtgtttctagttcagccttaatgtaatttttgaacagtaaatccactttgaaatcatttgaatatcagatattattgttttctttttgtttacaaagttatgttatctttatttctgtattcatgtattgcttttatcatgtattgtcttttgatattaaaatgattctttggaggataaaaagaagccacatcatatgtaaataattgctaaaaccatgatatgaaaagttacattttttcatatatttacatatgatatgtagattaaatacctgttcaaacaaaaatagtttgaccttacaaaatcatacataattatcaagccaaggattaacaaaagtcattctggacatagtttaccagatccccagtatgtacttactagagttctgagtcacaatctctccagtattcagagccatcaacctattgacacattcctcatatacaccataaagtaataatcataagtatacaatgtgatggctaagttttggtgtcaacttcactggattaggggatacgcagatagctggacaagcatcatttctgggtatgcctgtgagggtgtttccagaagagattaccatttgaatcagtggactgaataaagaagatgtgctctcacccaatgtgggcagacaccttctagtccaatgaggatctggatggaacaaaatgtcagaggaaaagcaaactcattcatactctcttctggagttggcaagctctttttttccctgcccttgggcatctgaatttcagtttctccagcctttggactccaagacttgcaccagtagtccctcaggttctcaggccttcagcctcagactgagagttacactattggcttctctggttcagaggctttcagatttggactgatcctcatgactggattctctggttctccagcttgcaggtgatcaactgtgggacttttcagcctctttaatcatgtgagtccattcttctagtaagtcccctttcatatgtgtgtatgtatatctgtatatatctattctattggctctgtctctctggagaaccctgactaatacaataaagagaactcactatgtacacgatgggctatgacacattttttgtatattaatgcttacttagcctttgcaaccaatacgtgtggtgaatgctttaatagtctccagttataagtagggagagtaaggtacaccagatacctcataagttacaggacagtctgtctaggaaaatgaggtagaactcatgctctcaaccactctattatctatcatgttactagcccacccaagaaaggcacataaaatattgtgaaaaaaaattgagaaaagatatttttctaggtaattataatctcacacctttctaagatgagagttgtctgaaacattttaggcagcccagataaactttggaaaaaaatgtgagctgctctactttctctggatgaagcaacacaaagtaagatgggcatgtaactcatactggcatcttgatatcatcatgatattttatagtttctctatagtttagccaagtaccctctactaaaacacatatttcatagagtatgttaaagccagatgactgttggagtcctgtagtataaatggaattctgaagtgacctgaatcaggatatctcaggccttctattcaaccagcctaaaaactaagaaacgggcaactcacctcagctgatgtttgtggccattaggaatagatttttaggttacatctatattccatgaaaaaaaattacaaaaactgaatggacacagggttaaaaccaagtagcctttgattttggaaattaaattattattatgtaaacactttgaatcacaatctatgattcttctagcacaagataaacctgtcaaaaaactatcatgaaccagaatacactattttattaaaactttaattggatcacgtggtcaggagattgagatcatcctggctaacacggtgaaaccccgtctctactaaaaatacaaaaagaaattagccgggcgtggtgttgggcgcctgtaatcccagctactcaggaggctgaggcaggagaatggagtgaacccgggaggcggagcttgcagtcagccgagattgggccactgcactccagccgggagcctgggcgacagagcaagactccattaaaaaaaaaaaaaaaaaaaaaaaaaactttagaactttaattggaacagaggaagggaattactttggacccgatggtaatcacctccttatttaaacagtttactcaaaatatttcttttctttttttaattagtaggtcatctttatatatattgaagtgttacggtatctggttgtgtgaggggcaaagggaatctgaggaggtaagtgagaaacagcaacgtgatatgtaattatgtaatttaagagtgggtgctttatttgacattggtgcctatccaatattcacaggtctattattcttcctaacaggaccttgattttgttcaacacaatgtgccaaaataaaacaatttttccagtttcccttagagttagaggtagctatgttacgcagttctgaaacaaacagaagtctaatgtgggagagtcttggattgcttcttactcctttagtcaacagacatggcttactctactactttctgctactcaccctgaaaatggacatgaggtctcaagctgcaggagccatcttgccatttcaaagtcacaatcataaggaaacttgaggggaaaggagggtgaatcataattggccctgaaatcaagttcagggaccattggaagcaatttcttcctatattagaaagaaaaattaagaaccttctgtgaatggagattggaggactggaggagtgttccagggctgaaacaacttgaatggatttgcatactgagtctcaaaaaagtgtttagaggaaaatacctcagaaactaacttgtttttagcaactctaaaatgaaagccaagcaggccatatagttggaacttttgtggaataaatagataaaagggtgaaaatctgaaagaggaagttgagcctattgaccaaacggacaggtgattttctttcaccaaacagagtaaaaacatataacttagtacaacaatcaaaaaaagtagtaacaacatgggagagaatgtggaggtttgaagcatgactggttatacatgaaagctttttagtgcttgttgaagataaaacctggaggcatgtaaagaaaaggcttttaaaaattaagtatgtgttttcagcctcagcaatccatatcacagtgttcctgcaacaatgtcaaattaatgttgagagtatatgctatttgcttgatttatgaggatatattctaatgtcaaataataataaaatattaactgaaatgagactgaaatcactgaatatttctatgcattagtatattatgaattccttgaccatggcaccacaggaggcaagtagtatagcctctatctttcacaatgctattttgtttttgcactgaaaagcttagaaaaatacatttacagtcttggattatgaaaaacaatttgaaaattaataagtacatactgaatttttaatctaatgtgtactttttccttttctaaagaatcaaaagtctccctttagtgtcttcttaactgtatttggattcttgtaaggaatattttattcctcattttagtttactcccacataaatcactccagtaaatgatctgaagctcagcatttccctagtcctctaaattggaagaaaattgacacatatatcaatgcctaaagttgttttggtgagaattgtactgaaacattacattccccaggaaagaacccaggattaaatcaaagctactttcaattaagtattcaaagcacagggctccatattaaaagaaaatgatgtagttctttttcttcatgaaagcattactgaatggtacaaactttcagctataaaataaactgtggggggtgaatgtatagtatggatggtgaaggatgttttaattaactagattgtgataactgttgatactacacagtgtatatgcatatcgaattatattgtacactttgaatatgtacaaatattaccaattaaatattttaagataataaaaaagcaataatcaattgattattattataatcatggtaatagtccctatgtactaattattcttcttccactcctcctcatccttaattaataattaagtcaattgattaattatcattctcccactcctcctcatcctccctctcccttaccttctcctgctgctcctccttcttcttcctaaccatctttggagaattatgcaatgtcacttcagtttattatctttatttagagagggcggagattgtggaacataaagttctgaaacaacttgtcagtaccattgccgaaaagtcagtccatttaaaatacatggacaaagaagaacataatcccaatctttcacggaattatgctaattagttaaacaaacagcatgtgtctcctttaaggagacattaagtaagtttctacacatttacccatttctaaacatctggaattactgaaaaatagagttgagtcaaaataagtcagaattaaatagaactatactcttgtttataaatgagaaagctgaaataacaatagcaaattactcaagtcctccgtcaattagtggcaaaactaaaaccagggagcatatttctagtatattgcaaacatgacagaacaatggctggatttgagatatgaaatgagacctgtccaatccatggtttggggactccaaagctgtgtgatttgaggacatattaacttcttttggaatacgtttttttcactaataacgcaaactaggttttaccagaatatctttaaatttctttccagcttcaacagtctacattctacctgaagactcaggaatcctatgtgtcttcaataaaaatacttagattataccagtgatatagtttggatatttgcacccacccaaatctcatgttgaaatgttatcctcagtgttagggttggggcctgggggaaggtgatcagatcatgggggcagagttctcatgaatggagtgagttgtcatggaatctggccctgtagaagtgtatggcatctcctccccacacattcctctcttgctcctgctttcgccatgtggcatgcctgcttctgttctgccttctgccacgattgtgagcttcctgaggcctccctagaagtagagcagttgccagtactatgcttcctgtaaagcctgcagaaccatgagccaattaaacctcttttctttatattttacccagtctcaggtatttataataatgcaagaatggcctaatacaacccccaaaaaatcagtacctataaattagattatagtaactataaagtctgttagtcagactttatagtagtattatccaaaggaaaacaactatcttctgttctcttcaaatattttagaaataagtttgccactgtgtgtgtgtgtgtgtgtgtgtgtgtgtgtgtgtgcatgtgtgtttgcatttctactggtctcttctaaatacattgtaattatattacaccaaagtaggatcatatcacggctcaaatcacagtccttcaatcatctcatttagtacacaaatgggaatccttacagtggcccgtaagaccctgtataattaggcctcccactactctctaagctcacctggatttctttcccactttctcactccactacagcttcactggtctcttcactattttgaataatacacatttgcttctctatctgagcatttacatttgctgttttgtatttctggaaccccattgctcatatatctgtacaatttattccttaatcactttcagatctttaaactattaataatattttcttagtgaggattctcatagctatcctatataaaatatctggccactgtagccctctcgatcatccttccctactttattttcttgttgcatttatttttcatttttctgcttttaaatgtgtttcttagtgagaattttacatctaatgatggcaggaagttttatctcacttattcatggtcatagtccccatgtactcaataaattatggtaaagaatggatgaataaatttacttagaaaatttgtaaaatgataggcatagttagtaggtacaaataagcactctgtttaatttgcctatattcaatttagagaagattttcttagatatactaaaaacaattctcagcaaagtagaaacatctgtagttgaaaattatgacctaattcttctcctttttgctcccaacactacacttcagtttccaaaaatccactccattcaattttctcaaccactgtgatatttagaatagaaatttgttttaggggaaatttttagaatacagcaaatgagaagagcaaatcaaaatttcagtccttgaagatgtttctcatctataaattgacaaatatttctacgtcccaggttttctacggtatctttaaaaaatgtgaaaaagaaatgtccatgcctatacatgccattagcaatacaaactaagcttaaacaattacaacaataaaaacaggaacatcccgactctctgcctcaccaacctcagtggtttttggatacagagatatggagaagttctaaaactgtatttgcttaggacagataagagaagagcagtcagcaataactgtgggaaaccgaaggtgacataatttcttattgcagctctaccatgtgattacatatagactatggtggatgaaattgattttctgaacaggttctacctatctttctatttggctttctttttacattcataggaaaatgaaattcaaagtgtatatgtttctttgagaaagaaagcaaatggattacctcaaaaagttgccagtcgttgggagagttatattgtgcatattaactttgctaattcattcactctattcctatttttattccatatcacttacgatagacacattcatcatctcctgtgtagtgtaaaatcagaggaaaaatgaagttgtttcctaaagctgcgtacaatactgtctatacttgatattttttatccagataatcctatgctacaatagattctggcagccttaaatttctcctcaaaataaatgtcatgtaattcctgaaaaatactaattgaaagtatctgcctttcacaaatgtggttaaaatctaccattaagagctgaaaattgattgaagtagacaacatctgcttttagaactaacggctctaacaaataatgtgttattccggcaagtgggaatacacatactttagatatgctatggcatgtcacacacaagaaaattagctttcaaagtggtatgtcaacattaattttcatagtttcgtaatatctctaatcataaccaatggtgttagacaaaaacacctgctgtcctttctgttatttgtttgtaaaattaaattcaaagtagcataactactatgtaactggctctccaccctggggtaacatgtcctcaaatgttcttccaatatcagtggttggtgtaaacataacaatctaaagggactaaacacaatttcaaaagaacacatttgcattacttttcctaatagattttctgatccaaaatcaagtgagggaaatataaatttttatttatggaatagttacctgaagataaattgaagaaagaattaaagccacagaagtatttaactatttgcctgtgaaatatttttgattctatcatgttctcttttgcttaatgaatttgagtgccttatgtgacttagaatttctgtatacaaaacaaattcaatttttttacatcactgtcaaatacagggctttggatataaggacatcatttccttacagttattctcaacttaaaaagcttatgacttgtttaaatcaagttacagttggtgaaaagggagtaattgctgctacttttgctatttaatctcctccttcatacaaaacatagttgaccttctcagcataatgcctttgcagaatatagaactaaaagtgtaaatccttttgtaatgcaattgtttcttgttagagagaatgtctcattgttatttacaatcaattaagaagaagcatcttgttaaaggctttatggttgtagtatcaatctttcaacattaagttaactttctataagaagcttgtgtcagtataaacagaaatgtgcacataacaatacataagatttataagtatttattaacttcctactctataaataattgttgaaaacctgaaaagacacaatggctaatattaaggagcctatattcaatcttcattatttttaactattattttaaatcactatttattatgaaaatttcaaacatacacaaacagtagagattctacttgaggacccaggtattttttagctagcctcaaacattactcaaatattgttttatatgttttatctaccaattcccatttttttgttaggttggggaagcaggtgttttagaatgttttaaagcatctcccagatctcaagtaatttcacctttaaatatttggtgtgcaattcagtgtatatcctcaaattttaaaaattaaaaggatattaacttacagaatcacaaatgtcattatcacataacaaaaccagctgtaatttattgacaagaactaacacctgggcatattcaaattaccctgataatctaaaaataattttttaattcttaaaaattaggattcaacaagattctgctcatttcatcatgtagttacatcacttaagtctttttcagtcgtttcttttttctcctcatgccattgactttttgtagaaagcagatcagttttataaaatagctcacattttggattcgatgatgtattccatgtggtatcatttaacttgttcttacctccttaattaataacatgcacagcagaagttgtcaccaaaggtttggttagaaccaaatgcattatgtttttgggcaaagggtacaaataaatctcataaatgatgctgaatccactatgttttagtcttaaattaatattctgttcccaaatcatacacacacacacacacaatataaacaactctgatttcaaataaagctctgtgattctctaaaaatatttatcaaaaaatagtctgcattttaaatagaggtaagaaaatatggtagcagtagtgcctattataatagaaagtctttgtttatagtcccagcataactataaattaaagatgttccctttaatttttactcttaaaatctttactgtatagataatgatattgacttattgactggtgcttatactttaatttttaataaataaatgtttcataaggacttacttttaccagaatggctaataattatcaagtgcctactatgttccagatacttttctaaacatctcgcctttattaactcacgtctcgcctttattaactcacgtggaactcaccatgaacctaggagataagtactaatgtcttcatttcacagaaaagtgaatcacagcctggagcaaagtaactttaacatgaacattgaaatggctgagctgggatttgaagggcaatatggtactcttctgtgctacttaagactgcctttccacaaaaccagcttcttcttaaaggcataataaaggtaatggtatttccttcaggcaattaaaacatcaatcaattgtaaaagatccatatatacatgaaagtggtaagcggtactgagggaaaaagactttttgtttttcaatagggaaatagagaaaacctaaattattcattcgtttagtaattcattcgaggaacatttatggagctgagaatttttaattttagccatagtcatccattccatttctctcatcaggccattttatgttcttcctggtttgctcaattgtgggaaaagttatgttcctacattaataataacagttaaaatataaacttttaaagtctgtctagataataagggaagcaaaggataattgctatttatatttttccgattatctgattagcacctaaataaaaagattgcattcaattctgtacttttattatcagaattaatataaaaacatccatttctttttcatatcatgacttcttaatagtttccaaatctttaaaacattacattacatgaaagattttttccatctgttttatttttcattttatttttattttattattattattattattttgagatggagtctcacgctgtctccaggctggagtgcagtggcacgatctcggctcactgcaaactctgcctcctgggttcaaattattctcctgcctcagcctcctgaaagctgggattacaggcacatgccaccatgcccggctaatttttctatttttagtagagatggggtttcaccattttggtcggggggtcttgaaagtctgaccttgtgatcctccctcttcagcctcccaaagtgctgggatgaatgaattggagtgccttatgtgagctaccgtgcccagccctctttttacttttttaatcacctattgtcaataagtttcacttatactgagtgcaggtgtttatatttcagacaaatttttagtgaactgttaaggcattttattcagaaaaatcatgaggaacaggaaaggcaacaatgatgagatgtaattgtattttggttgattaatgccttccatgtatctttttgtgttgtaaaatccttaagctgggagtcccagattctgaaataagcatcatctaacatggagaactgttgtgctgctggtgtactcccactggggactgcaggctactcctcacaggggtgtggccagagccatactcagcatctacagatcctcgaagagcagctgtttgttagcttaactctttttcagtaaagtaagtagttgagtccatcacatctagcaagtagatatggtacttctctgtttccttcaaactgctagacgagcattgtttttactttttaatttattttctcttttgcagaagaagaggttaactactttctatgggcattctgaaagacatatttgaaaaaatccaaaggctagtcattagcagctagtgattctgaattcaaagaatgtagaattctgaaaatcccaggtttttcttattccccttcagcactaatttttctctgttacaaccttatctcattgcagccaattcacagtaaagtacttcataataaaattttactattccatgaaaatggactagaaaataatttgttgtattaaatatgtgtattagaaaatacaacatataaaacaagaaaacagcaggttcattgattatgacacattaatattgtcatataactactgttttcttataatgtcaagcatttaaatacaattttacaaacctactttttaatttatttatttaattttaattaatttatttttttgagattgtgtctcactctgttgcccaggctagagtgcagtggtgcaatcttggctcactgccacctccgcctcccgggttcaagcaattctctgccttagcctcctgagtagctgggattacaggcaccagccaccacgcccggctaatttttttttttttttgtatttttagtaaagacggaatttcaacatcttggccaggctggtcttgaactcctgacctcgtgatccaccgcctcggcctcccaaagtgctggtattacaagtgtgagccacggcacccggcccaaacctattttttgttaagtgcaaaatttttctaaaactgcttgtttgtaaactaaagagagaatcttttaaacatacgatttgaattaagcattcacaatgccaacagataggcatatctatgtctatagactaagaacaaaaaaaggcagtgagttaaattatgacatatcatgtagaattgaaatcaaacttgggaaaatataaacaagaaagatatcttttggtatagcacaacatgttgtcaaccaaagtgaaaatgccaaaaaataaaattatctatgaaatcatgaataaataaggcatattggcaaagctgaaaaacagaaaagttttaaaaggcaacctcccactaaatctaacacaaaaccggccggagctatagtttacttggttaagagcagactgccactactgtactgtactgtactgtactggtacggtataacaaaatgtgttttattatttggggatatgaagagaatgaaaaataaaatattaatattagatattaaaacaaaactgattttacaaaaacaaattacagtatgatagaactaaaagcacaaaccaacaataattgtacaattaagaaaaacagcacacattaaggtaacttaaaacaaagactacatagtgataaaaatcaaaacagatatcaaatgtttatgaaatcaatttgctaacaatgtgctattgatatgtttgtatttactgcagaagtaaataatatttctacaaataaacactaaaaatattattaccttggttctcctattttgaaatgtgtaaaatacagacaaaaatataaattagtttccatatggaaaccttgcataagcattaatataaaagtttaggcagtaagttcttattgagttctaattatctgtcagcatcattttagatactattgtgtggggaaagtggaaaagggaggaatagaaaagaaagcagagctattctttatgaattctaactgcctattacattagaacctcaaatatatggaatgaatcaatacatgaagtaaaatagaaaaaaagcaaattaggagtatgtaaataaatgcaagaggaattttaaaaaataaaaatcgtgtggactgaaataaccaaatgagatggtaaatgaactgaggcttgtagaatgaatgtaatgtaatatgaataagtggaggaggataatagagcaatattactgtgaagaatattatattacaagggtagtagcagtgaagtgacatgtttcaactgacatgattccaactgcctgtgagaactccacttgtaagatataccatcaactttaatttggtatgtataatattgaatccttctctctttttagtatcattttctgccatcggatccattgtttaactcacttacatagccttgaattcatacatttgttcatttgtacattcatgtattgatgcattcacacactcactggatagatatgaatataaatattatactgggttgaatagtgtcctccccaaatccatgttcattcagaatctcagacatcatcttatttggaaatagggtctttgcagatataattggttaaacttagataagttcatatcagaataggctgggctctaaattcaagcccttataagaataggagattacagaaacatagagggaagaaagccatttgacatcagaggcagattgaagtaatgcagctacaagccaaggaacaccaggaatcaccggcatgaaaggctttctccctagaaccttcagagggtaaagtggggtgggggtgggggagggggagggatagcgttaggagatatacctaatgttaaatgaccagttaatgggtgcagtacaccaacatggcacatgtatacatatgtaacaaacctgcacgttgtgcacatgtaccctaaaacttaaagtataatacaaaaaaaccttgatttcagaattatatttttcagaactttgaaagaataaatatctgttgttttaaaccatccagtttgcagtaatttgttactgcaaacttaggcaactaatacagaaataggtatagatatagatagtgttttgtctgtgccggctactgagattataaagatgcatgaatctgaggtcatgtccctcaatagcagacagtctagggaaactgggatcacttttgaattatccttctgttgggacagacagttgcaaccagacttgaactttctaacacattattcttgagtgtgccagacttcaagatttacctgtcttctcaaactgagaagtctctgtagctggtcacatagcctgatggtgacacctgtataattgttcgcccccctcgaggaggggaactggcttacttactgcttatgataatacttgttgcttgctcaaaaagtattggactcttggctctctgtttctcagcagtgatgaaaacccatcacatgtaaagaatccacctggaccacttacataaccctgtgtgaactggaggcaaagggaactggggcaaatatgcagatgcttatactgcttgctttgtcattactaataacgacttcagtctctgactcaggagtctgtgtcttctgctgacatctatgaaaagcaatacactaaaatgttagctcgtcggtatggtaaaatctcagaattctgaacagtttttgagacttcctttctatccattcaggttctaaattttattgtctcattattttcaatgtctgtaagtacttagtacaacttatattaagttatacttgctatgacttatatttagatagtacttaataccagttataccaagtaccaattagtactacttaatactactcataatactgctaaagctattaattagaatattgattgttttctaaattgtttcctaaatgaataaccatatcattcagccaaaaggaaaaactatgtagacttttcattgcaaaagttccagtgaattattcaaagcccatacaattagattttgtgaatgctgaaatctgtattttgctgtccattggtaagcgctctcttttaattgttagctaaatatgctcactttcacaatttcatttaaatgatttcccctatttagatagttgcatcaaactttgcccgagttcttcccttattttatagacaaactgtatattatctgaattgtcttcagtttctactccttagtgattctgaagtcatttgaaatatctctatacttatatatggcatatgcccttatgctatgatttgaatttgtttcctaacatacatgagttggaaacttaatcttcagtgcaacagtgttgggagatgagatgattagaccacagggctctgcccttgtaaacagattaatacagtcatcacaggagtcgtctgatccttgagaaagtgggtttgctttgaaaataagtttgtcctcctattgctctcttgctttctgtgagtgctctctcaccctcttctgttctgctatggaatgacataacaaggcggccctcaccagatggtggcaccttgatattggactttatggcttccggtgagaaataaatttctctcatttataaattacctggtcagtggaactctgttaatagcagcacaaaacagactaagacaacttatatccctaaatgatcctgagcttttgagagctgatggcaataacttatgtttttattcttaagagtccagcacaatgtacaatgcgtagaagctgcttaacaaatacttattaataaaaataacaacagtgatacctgatggtattttaaaaaatcatttcaggttaaacagtttataactattttaggaaactcatttatttatattatgtatttaataaatagttttgaacacaaaacatcatatgtaacaccgtgggtgtaaaatattttgaatcatatcaaagcttatcagaaggggcagagatgtgcaaaattgatgtaaaaagaacagggaagggagaagagtggttgtcctatacaagtagtatacattttcataaacaactctgcaccacttatggaagtaaaaattagtgtttatatttacctaaaatctttacagatacaaatcaacctctggacttcatgagaaaatatattccacagagtgtcatgaaggtgactaagaaaattaattagatcagcatttgcaatgtaccatgagtcagagaatcatggaaattaaagcaggataggaccttggagatcaccttgtccaacaccttcatttggtagatgaggaaattgaaaccagattgacaaggataattttccaaggtcacacagataattagtagcagaacaaggcctcaaatgtaagtattcaaatgcctaactagggtagtttcaaccaaataaaggtcacgctgttctaaagcattaaaaaataaaacagagtaaagagctctgtcatcaagtactttctaaagaggtaatagtgaacatgtctatatatgcctatatatgtagcataaaaatacatatgcatatttacaggtttatatatatacatattacatatatacacatatattatatatatacatactattttttgaataaaatgtgtagatatgcccatatatctttcttctcttttacaatgctttaaaacatatttttttctccttgaagaatatgttgtacattttatttcaacaattattaacatgcaaacttttttgataataatgaagaaataagcagtgagattgagatagctattcagaatatgtaattgattttctgcatggttcatttgattatcttaaagaaatttctacacttccagaaatgaatctaacactttaaaattaaaatcacaatgggaggatatagcagagactataacttgtgtgttaatagtcatcttccttcctttgcatagcaataaactttttagctgagtacagagatagccagtcagtcaaaggccaaattttctaacatttggtacctatagtgacttaagagtaagttctgctctctggattgtgactgatatgatatattcaacttctaaggcatgcctccatagggaagaagcaggctctctttttcatttctccttcgctgctgctggaatggagttactgtagtgatagctgcagtagtcacacagaaccacagctaaaaggaaactagccctctaacactgtgaataccagctataaaaggccttcctaacataagtgtgaaaaatactcgtatcctgtgaaagctaccatttgagtcttttacttcagagtaacttaacatgtaccctaatttaactggaattgatttgactaggaatttagatgtttccattcattgataattttatgtgcaaaatatttaaacaattggaataaaaaatgcaagttggcttgacaaaatgctgataaaaattcttccaacctaagaacaatttaaaaaataaatcattaaaagtaaatttaacagtttatttcatagaacattggcttttctacataaataatggtattacattgtatctctgcacttcccatatgttcaccttgaatttgcagaactatctgcaatactagagagatccattccacattcccacttgacctccaccatggtatgctttgactgtctttcctctgtgctgttctggatattccagaggtatatcctgttaaaatacctgtatcataggacttacaccctgttattataattgtgtatttacttatttttattgttaattgaagcaagacacctcagtattagcactgttaattcccagttcactgacgatgctcagtgtctttgcatttgatatttatttcttttcctcagatctacattggccagctggccacatctttcattgtctttgttcaaattttgcctcttcagggagatttatctatgtaaaatggcaccctcctccccagtcaatcattatcatgttaacctgcttatttccttcatagattttaatatcaggaattatctgatgcatttatttgttgattgtcgattgttttctccttgcagtttttttgaatgtacattacataggagaaagagtgctgggattcttcaaattcaaacatggatatagtttctaccttcattggactgatagagcagtgaagaaagcaaatatttaacaatgattactcatgcaaccattaaaagggtaatgtgactcttacaaaaatgaaatatttaatttgatcacaaacagtatttatttatttcttaagtgaacgaatcatagttactgtgtctcaccattgtacacaatatggaataaaattataactgtagataaattagtaatgcagcattatgagtcttttctaataaactgttatttaaattgatatattttatatttttatctgaatttatttttatttctgaactaaagagatgattatacatttgaacagctattccaaattttatctttgaaactgcacgttaatacatcctttattaatctgcctaagtgagaaacacctaatagaaataaatgtggtcaataatataatttgaaatattaaagtgttttaaagtatttatagttattcatttatataaaatacaacatattggcctatttaaaacattttgtaaaagatcagttgtttttcaaggtatttaatcaaatgtcagttctaccaacatataattaggtttcatcctgtcttttcttctttttacagttctgaatatacagactttctaaaagttacatgagtttttgttacacccacaattatctatttgaataaacaagtactatatcatagctaagctcacacatcaaactaaccgtcactgtggccaagtaaattcccttcacaatgaaatcaaaataaaagtaatgttgtcacttctggaagaaagacttagtaaagattgcacatttcagtttgtatttcctgccctagcaattatgggtatatatggcaaaatggaccacccatcagcctggctatctgagtgactacaagaaactgagtcctttctaattttttttggactgggagagtgagtgaatgatgaacttttttcatgttacatcgctgaaaacctaggatttgtatgttatagcagtgtaatctagttcactatttcaacttgaggattccaggatcaataggatagggaaagaaaagacaaagagtgattcattgagtcaaatttcttggtccagaagtaatatcaatgctgctttcaattcattggctgtaattagtatcatgtctccatctaaatacaatggagttggaaaaatcaggtaggaggatacaaagatccccagtagtcagtcaacatttctatctcatacttattcataattatgtgaatttcataagttacttctttgaacttcgttattcttcctctagataaatggagaaataaccactttatgtggttgtggtaaggtttagattctatgatatatgtgcaagatttatcatatagtaagtcccaggactactttcccagactttaaaatgacttttaattacattttttgtaattacataacttcatcaatttgttatataaatatttatcacacaattacaatgtgttatttaactgacaattcaattttatcatccacaaactatttttgctagcttctcagtgatatattgatttacaattgatgatgtatgtctacatcaaatggacatgagttggttgatgaataaaggttatcattctccactggtttcacagaacttaaatatcaacttgatctagaatttaatttcttagaagtctgtccaatatctgacaaaaatggtagaatgagatataattccacactcaatacacattatttgttaataaattatgcttccaggattaattcctatttgatatttgctgtgatttaccagtttatcacataaaagatgaattgcctttacctatgcacgaagtagcagagaatcaagagaaagattaaatcatgcaaactaatgtctgacatatgtgatgaaaagggatattggatgtaacatatcttaaatatagctaatgctttgaaaattcttcctgactcaatttatttatcaaagcttgacttacactagatcaaaaaagatctttataccaataccggttctacagtagaacatacaaaataattttaaaatcttacagatatgtccaattattatctcataagaataaatacttgaaagttctgatttgatttgcaaagtctaccatgtatatacacagcagtcagaataaaattttcactgtgtttttatttatacatatctccttttccaaagcataaataaatcatatttgatatcatctgataatcccatttacacaaaaccactcagttattgtcatctaagaaaggatcaagattagggacatcagagtgagaaagctaataaacaaatcctatttttttagtcgttttcctcttaccaatagtttcctctatgtaaaccaattgtaaaatgtattcagctcagacagtaattttaaagaaacagagttatcttttaaaagtgacatggtagtaattttattgtctactagattaagagtgcatggagagacatttttggtcatctacatgcaaataagcattgaattataatttcagtttgtagtgttatattatttaccagttctggggatacttgtaattcatgcagtagataattacagcattgttcttttaaataccattagaaaagaacaggtgcagtttctgaacactaaggacaataagccaatctgtgtttagagcagcatgcttagtgtgaagaatgagaatgttactgatgtgatgaggacttttaaactgtagatgatgttagcaaacaaaggattgtttttagttgccttgttagcagtctttattattccgttagcattttctcccaaaagtttaggacaatttctagagaaatgtgtatatcaattctatatactgtaatgattaacacagaatgctatttgcatgctgtacttctaaaatcaagacagaataagagaataataatcatgataaatatatcgataagacagccaattctcattttacaagaacatggtgaacacgaatccattctttagacaacatttaacattcctataagattcaaatatctattctggagtctgactttctgaatacatatctctacgtagttgtgcttacaaataaataatttgccagttgagacaaaataatttagtagaaccttatatattcaggaaaaaattctagcatcgtgtccagatatcaatttggcttctacaaaaaaatttgtctgacttttgatgtgtttcttatctctctagtttgcaagttttaagagcaaataagagaattgacccaaatctttgagctgtttgactatatgcctcctttttattaattgacaaataaacaaaaactcctctgtttcttgtggcctgtcttcatgctgctctttgaaaaatcaggagtctacgtttgggccaaactcttcatgctgttttttgtttgctgctttgttttactcaatttaagtcttttatcaaaaaatgtttttacttactcttataattagtgaataaactagatttcatatctttaaaactttttcgctgatttcattaaccttaagcattattttaatcatctgaagagtggaaaaatttgctaactatgaaggtcctgggcagaacaaggaagagagtccttctgcctcctgtccaccacacttccccttatcctaatgtttgctgagcacttttcatattctagatcctgttctaaaagtgccatatgcattatcttacctaattttctaaagaacggtaagtattcatatgacattttgaagttatcactaagaagtgactgtacagccagggattgtgtttctcagtcagctttgcatccaggtatagccacgtgacaagttcttgaccacacagtcagtatgaatggcagagataactactaatttgggcccttataaaacaggcggtgctttcccacatactcctgcccctgccccttttactgaccagatgctaatgtaccaagtaaacttggaagccactcatcaaaaatgaaaagccaccatacatcgggattcctgaacgattatctgcagctaaagtacaagttctcacaccagtataatcctgctccctatgccctatcaccttgggttcttttaacgtggaaaagcaaatccatattgtgttcattcattactcattgtgagtctatttgttctatcagcttgccctaactgattcagatagatattattatcctcattttatagatgaagaaactaggaccaagagagtttaggttgcttgtttgacagtaaaaggttatgtgtgtgtggcggggggtggggggtggggggacagggaagctaactccaaaaacgtgctaccaaaagctgtgtacaaagccttcactcaaagttaagtggatataggatgttttgacagtaatcgacactgggtggatattcatgagttaaaatgttgagattaaccagtaatgtataattttcaagaacccaacatagtaataataacgataaccatttctattccactactgcagctatcctaacatggtacataatatctctgtcaatgtagattccaggttagaaactcatgtttttctaaaggcttctgactcccacattctcacacatccttgtagtctacaaggtctgtctattgtatttcctcaatgtatcttttatttatgcccgtcttctgtgaaaaactttgtcatctgtagtctaatgtcccctgcctctaatttcaacctttcttagctacattttatactatcaccattgtgaaatatttaacaagtaaatctggtagtatcattctcctgctccaacaattcagcccacagttaattcacattgtggacttacccagctctccatgatcttgctcctatctacaaatgcattttcatttactccatctttttctttgaatttatgagctagaaactctaaactataacagataccagacattatcagatttaatattctgtattggtcatttgcaatggtgactttggaaatatatggatataatagtacctacaacatagggctgttaggatggataagaaaacatatgcaaaatgtgcagcgaagttttaaactgtctatcctggctagtgtgtagaagcaaaggacttgactgaaatgaaagtttgccaattgtctgtaatctaagcatcaatttataatattctttagtataaaatgtatggaatactcaggacctatgtatcaaatttgccaatgacctttaattatagattcctgaacatatctgcaatgttcatgattctgtagatttgcatatcatactcttctgcctatagcctcctatagatgggtaatttacctagaaactacctaatcaatcattctttaaatcttacctaacattataacttcattgtgaaacttttattcccaaacagaattgggttgatttcacttatgttaacagtgccctcatgttatgccattacaattttcgtagtgtattgtattacatcatgtaggactgtgttatcttagatatttgtattatattgggttgtagtaaaactcatttcaatgtatctttatcaaattgcattttaagctgtttgtatcatattttttcttatccaattgtaaatttcttcagagcataaacgttaaatattcatcctattcttcatattatttaggaaaatgtttagcacaaggttgacatttaatgtttacagaatcagacacataacataataaatgaatgtgcatttattcagaacttacacaatattgtactccattttatcctctggattttgtggtgaatttaaaatatgttcacaagttctttgaaattccttccatcaagaagtggggcttaattaccctttccttgagtgtggaaaagatttgcatctcacagatagcaactgatgaaaatgactgtaacttctgagaataagtcataaaaggttttgtgttttccttctcactctaacttttggatcactaactttgaaggaagccagctaacacgtcataaggacactcaaaaagcactttgacaagtccacctgtcaaggatctgacaactcctgccaatagtcatgctagtgagccatcttggaagtaaatctctcccaggcccagtgaggcctacatatgactgcagtctggcaggtagctggactgcaacttcatgagagatcctgagtgagaatacttaactaagctactccccaaatcctgacccccagaaactatgagataataaatgttctaagttttagggaaatttgttttgcagccatagataactagcattttatagattatagtaagactatacttgtattctctaagaacttgtaacactgcatctatgggaaattcatactcatccataggatacaattataatgtaaaatagtttattatgtggttttaaatgattaatttaacaaatatttaccaaacatctactgtcttactgaaaataaatatatgcattataacttaagaattttacttctgagcatgtattacagaagaatccccacaaatcagaggcaggacatgcagcagcatatttactgtggcatagtatagagtgggaggtgttatagataatttggaatcacatcatgagggaatggattaaaaaaagtatgatggatgaaaagcataatggatgcaggctaaaaatatatatattctacagcaattaaacatcaaacaatataggcagataagaatggatgcatcttaaaaacatacttaatgtaaaaatgcaaaaacatgatgcataatacacttaatacaaattgaatatgcatacttgtacatcattacatgttacaatagtacatccatatttaaggacatatatcaagcccaatacggtgggtatgtcttttggggaagggaatggaagtcaggataagggatttaaaagggcaaactacatatattcataaaatgaggcagggtcctggcctagaaagaaaatggtaactatgaaatgtaacttaaatctctgtatgtaagttaaaagaaaaagtcaaaccagacacataaaacaaaatataaaagcaaaacaaacaaaaaaccccaaaaccacttactacatttcttgtgttgggggatttaaaatacaacagcgaaaaagagaaatagtcccactggggctttcattctcaatatataagtgaaataataaataaacaggaaaattttaagaaagcgttaagtgctgtgaaatgattaagggtgtgacatgatacataataatacatgaggtctacggtggttagggagtcttgggaaagcctcttcgtggaggtgatatttcaactgaaagccaaatgattagaattagttctctgtgcaaagatgtacaaaaggatatgtgttccaggtagagtgcagatgcctcggcttggcaagacagggataacaaagatcaatgttgctgtaacatcatgagttcattgagagtgacaaagcaggattatgttagtcgtaagaaacaggtttagattttagcattagtgaaaaggaaatcagggtagaaaaaaataggttttacaaaataaacatcataactgctgtgtggagaatgaattcaaaagaagggcgggagtgaaatgacaaagactagttatgatgctacagctatagttatacttttaggaagacatataattattctgagcagtgatggaaacagtagcatttgaaagattctaaagagtctccagagacaggcaggagtcatacaaaccaagtgggttagatgagggacttcagttttattccagagcaaatgggtaaaaataaaattgcatgatctgatttataaaatgatagcctacattttaacccatgcttttgggagggatattaaatttgcataatgcgcaaacattaaatatatgagtaataataaagtgtcaacatttggtgtcactgatcctacagagctggaacatgagcttttaggacaaggcaagaaacctccagaggaggctgggaaaagtcagatgagaggtgtatctcagtgcctctttactacaggtttagtgacaaatttagttacctgctgaagtacacatgttatttaaggatgattttagcatctagaatagtaaatgtatatacatcaattagcatcagaagtgtctgccaatgcctggcttgataagactctgacctttcttgaagataatcttcccaagaaacctagatgaattctcctggttgaatcttcacaaagcattactgcatttgtgataacaaatgcatatgggaattaatcctttcaagatgctgttaaaaatactcaataaaaatcaagaactagtaatgctgccatgatagaatttttaaataataagattttaatggtatacacattgttaaaagctcttttatggaaatgtttctgggaatattccctgtttcagttatgcttggggattttcttccatttgttagtagaattgggagttcatgagctttagtattgtggagatgacatttcttttccaaagcatttagaaatttgttataatttttaatatagtggttatacttaattttggtgtgtatgcatacaaatgggcaacagaaaccacttttggaaattaaagtaatattgtagaagtagccagaaatcataattgtgtacatttcatgttccatggagataacaataatcatgccaatgacaaatatgtttgtttttaataaaattaccaatgatacttgcatgtgactccctgatttctggtaatagccccaggctaaacttgagcatcatgtagtcatcttgaatcatgattttgtaaaggggtagattacaaattataaattaataaataattatttctgcattagtttatattcttcatattatctgaatattgcaggttgcctacaacatacgtaaaaaggcagaatgcagcacagcatatatcatttttcctattttattaaaatttgtgaatatttctctaactctcttatctctataccaagacacaaatatgtaaaataatgcacacattactatagtagctaacttcttgtggaacaaaattatcttaccatgaaatgtacttaaaattaagtctagaaataataagacaattatgactaaggtgtgtgagtgtatttgtgtagcaaacgtcttctattcaccccataacaagaggcacatgccctggtttcctattttgttaaagataaaaaaatatttcatgagagaaattccaatacagtacaatcatattaagagagtattcatattcaaaatctccagaatataatatattgctatcattttttgaaaattttctttatattttgttttaaaaagataattaatacatccttagagttttaaaaatgttgacttaattagcaatgcacttaaagatctaacaaccattgtttaacacattgattgggttgatttgggttgctggggatctttgtttaacaaaatcactacctcttaggctatgtacctagccaccacaactgaactcagttcatcacatggattccttcttttctattcccattagctatgcactaattgcagtttttctctaatgcttacattattccagtatactgctcaccttcttccctgccttccctctttgaataatcttgtttgtccaaatttttaacttaaaacaatgcttcagctattattttcttcattgaaaattaaattaccatgagcttacaattttaacatacgcaaacatttttattttttccatcatctaattcaaatttttcatatagtctgcataagtcttgtaatttgagggaagccattattcttaccttaatttttactcataaataaatatgaagagacttttccaaaatactaataggaagcaaatgtaaacctagaagagctatgagaagtgcatatgggataatcatggttgccaattattgagcacttactacataacagatatttattaaacacttgaaattcaaccagtcatttatttaaattgaccccaaataaattaaatatatatttatataaaatgcttatttaaaagctggggtatggtaattaatcaaattaatctattataagttctcacaatatctggatgagtaggtatcactgttccccaatttacagataaactaaggtatagtgtagctatgtgtcttgctcattaagagacaataaataatgaaagaaccatgatttgaacatgactcttttcgaataaaacattctgtttttaatctctagactccactgaaggaggtttggggaaaaaaggcaggagtaaaattttgaaggcccaaggcaatacaattttttctttgtgagctatgaagaattatagatgaaagagagcaaataaggatgccagtttatccggtttttatttttggaaaagaaatactctgattgccatgtgaaggaaaaattgaaatgatctgagactggaggcagggagctatatcccaactagatatacaaatattctctcgggtgagaattctagacttggaaccaaagtttaaaaaaaaaaaaaaaacctgaaaaaatgcttcgcattatagacaagaggtggaggggaaggaagtacaatacaagaattgtctggaatgataatggtgtgattacagaagtagcacatcaggaggatgtgagatcatagaaactgaaaagagagaatttttaaaaagagcaaaacccgtacagtttttaagtatttccaggttgacaagaagtgatacgccatttgatctggcaattagatggtcattattttaagactgatggaagaagatagtaatattggagtgaaagccattcttcaatgttttaaagagtggatgatattagataagtaagaaagaggaaactaaaagagaataaagaaaaaagtacatattgattatattgattaaatataaattattttagatactttacatatgctgattcttgtaaccatgacaactgtcttatcttccattctacaaatgatgcaacctgactttacagaaattatgaaaagacttcctagttttttttttttgtttgtattttagatggagttttgctctttttgcccaggctggagtacaatggcatgagctcggctcaccgcaacctctgcctcccaggttcaagcgattctcctgcctcagcctcctgagtagctgggattacaggcatgtaccagcacgcctggctaattttgtatttttagtaaagacggggtttctccatgttggtcagtctggtcttgaactcccgacctcaggtgatctgcccaccttggcctcccaaagtgctgagattacaggtgtgagccaccacacctggccaagacttcctagtttttgaatggtagatccccagcaacccaacaaatttatttattagtgttatgagaatctttatttcaatgaagactgctaaacatgagttacacatgatttgaggtgaagttattgcataagttaaaaaaacaaatccttgtattattcagttctcagtttaaaatcaccttccagatatgaaacaagaaatatcagaaagcaggtatgagtcagaaaatgacttggtagctcattgcagacaagagagtcgtaggaaaacccaaagagctcagatgttagtttttgtgctttgccctctgtgttgagccttggtataggtggcatatgtggtgggcaggggtttgagggagaaataattgaacgctgtgaaacttggggatcagggcaaaagggagccagcagtccacctgcagagttgcagaactgaggctgggtgtagctttgcagagataccagcaacagagacaggtgggtctcagaaaggttggtagaatggccatgtccttctttgtgtccagaccaagaaaggacaaaggacctcaatgacttagtacaaaaatgaggaagatgctgagtagcctgtgtagctttgtctccttcagagcctgagtccagatcatatacatctcaatggcggcagcagggacaggcaaacaaaactggagttccacaatagtggggcttagaaaatccatgctgggtttagaatcaacccaagaaaggagagaaaaagccttgagagggaattttataactgaatgcaatgaaatgacagaccagagttgaactttggatttagaaagaatatacctaaaagtgcttagattccatttctgcattaggtaaaatagatgggtcactgtcagaagaccgcatcatagaaaaaaaaaaaatgatcggcccggagccgtggctcacacctgtaatcccagcctttggaaggcctaggcgggcagatcgcttgagcctaggggtttgagaccagcctgggcaacatggtgaaaccccctctgtctctactaaaaatacaaaaattagccaggcatggtggcaggtacctgtaatcccagctacctgggaggcttaagcgggagaatcacttgaacctgggaagcaaaggttgcagtgagacaagatctcaccactgcactccagcctgggtgatagagtgagactctgtctcaaaaaaaaaaaaaaaaaaagaaagaaagaaaagaaaaaaaatgatctttgtcatctgacatttgagtgtctgacttgcaaaatcatattgaatatgaattattttattaatttttatgtgtgaaaaaatactaggtctgctgctaataaagaacattagaaggaaaggtgggcagggaggcttgaaggaaatagtaaataaacattttcaagtcactgtaggaaaggagcaaaaatgtgactttattgctgaatgatatacagagttcagtcaagccagatttgagacaatatagcatacgacataaatctacatagttaaggttttctccaggcaacatttagtgttacctttctcatgtttgtaggcccaatattatatctatggtaaacatgttttggatactcattatgttaagtcaaggggctaccccatgagtaaaccacaatccttgtctctgagggcttgctttctattggaaaatacaaacgtaagcgaataaatacgataaaaatgtaatatgacaaaattgagaaatattgaattccaaaagacaatttctaactttgttgtagagaaaggggttaagaaaaattttcaagaaaggagataatatttcaactgggttttgaaaacatctatagcaaatagtggaaataggttaaaaatattttaggaaaaaacagctaagctgcacttaatttgagtattttttattttgtgaaacattaccagaagcatttctccacttaaactttatttcttgcaaatattgttcatgttgaagcgaatctatacaaacacttttcactaacattcaaaaccatcttggttatccttttaaatatacttgtattattagtctaaatataaagattcatagaaagataagaagatgcaaaatctacaattatatgtgatactattattattatatgtttattaaatgacttcatttgccatgaaaacataatttacctgatatatctgtttacttaaccacactgtatgaaaatgtgccacacagaactatatttacacatataaacctactattaattattaatcttatggcaagcataaaagtaaacttttatattaatacagtttaattttatttcctaaaaccataaattttaggataaaaaataaattaattttgacattgctcaacatcaaacaaactttaataaaatgttaaaattaaagctgtagaatttgttttcaaatttagtgagatgaactgtatttcaaaacagcacataaacattgaactagtcacataattcaaggataccaaaattagcattccatggattcattcattagaaagtactggtggcctctttacccacatagtgtaaagctattcatgccagcagcttaagacactcaagtttgccaaatttcacaggtgctgcctgaagagaatgatagtctgccactcctcccttgcaaaagacaaatctctattcacaagagcgggaaaacttacaaacagagaggctattttttaaaatctttgatgctaattcaaataggaacttgaccagttgtacctcctcttagcaacaggtgcagaattatacactgactctcctataaatattcttgaaagaatcccttggctttagcattttaatgccatgtttctttaaatgaggcctgtttttcataggttttctaatttgaatgttatactcttgcagactgtacctaatttattttactaatgaaaatatcaaatgtcaattgatttgtatctcttgtggaaattttgccattaagatattaatataatatattttatagatgttctgctagtaaaaagaagctcctgtttttcatcaatactaaattgctataactcttcgttattttcccagtagtaaagataattttatgcctggaatttaaatccatattcttgattgagatgtttgtttgtctgcagtgtagtcaagaagacactgcactagactggggctcaattccagaattaacaccacaattttataactgtataacctttagaatatcacttaatattttaatcctctttctttctctttttctttctttctctctctctttctttctttccttttttttttttttttttttttttgagacagagtcttgctctgtcacccaggctagtgtgaagtggcacgatctccgctcactgcaacctccacctcctggttcaagcaattctcctgcctcagcctcctaagtagctgggttacaggcgtgtgccatcatgctgggctaatttttgtatttttaggagagacaggatttcaccatgttggtcaggctggtctcaaactcctgaccttgtgatcagcctgccacggcctccaaaagtgttgggatcacaggtgtgagccaccacgcctagccttaatcctcattatttttcctatatgtaaaataaaataataaagactgatttgtacatcccaagtagttaatgtgaggatcaaaaaagatatcgattatgaaaaatatgaataaaagtttaaaaagtaaaaagtaaacatgaaaagaaaaaacatatataaaataaaaagactcttttttccagaagaaaatatgggagaaaatctgttcaagttgtgattggcaaaaatttctttggactcaacctttctacctatagaagaaaataattgatgaattagactttattaatggcaatccacattctggttggccacatttacaagtcagaaaaaaagtgcttgcctcagaatatgtaaataattattttcaactaataatgggaatacaaacatctcaataaaaatgaacaacataattgaagaaacattttacataacctgatatatgaaaggtcaagaagcacctgaaatgataactaatcataattagttatgtggaaaggaaatctcattctagtcagaaagtggaaaactgctaaggatttggatatggctagagctgaaaacagagttaaagaaaggtttttgcttttgcgctggcattggaaatgataagattcatgctatttttttaagtaattctattttaatacgtgtgtattgatctctgtttttacagaaaatgccaggtacaaaggtatagtttatcttggatactaatttgagtggggttttgtcttcattttttacaatttaattttctttttttcttttctataagtgtttgacaccatacttgtcttcattttaatagtgttcagagtataacctatcagaaatatttttatacttgaaaaaatacaactttcaaataaaaaaattaaaaatatggaattgaagtatgcctgagacaagttaatctaattatcaaaaagctcactttttgcttcagcaatatgttttatttagggaaaaaaaaaaagttggcctttctggactaaagagatctgagataaaaggagagactaaaactatgcctggaaaacttttattgaaaaaatttcctgaaaggccgtaagtagtttttatttttccttttccagatattagaattttggcttgagttttctgtggtatctgaggaaagaaaataggagaagagagcctagctacccaatttccttctttaaagtaaagatgatttgcaagaagttttcaatcaaaaaattaaaatgttttaaaatatacaaaacatagaactatacatcagcttggagtggaggaaaataaaatgcaagtagcctatatacttgtccgattatctttctaaagatttttggcttatggagaacagcaaaactcagactgaagttagattacctctaccacatggagactgctggctttcggaagatgtgtccactcacttcagtttggttaggccaagacaaataataaaatcatgaagacaacatggaaacagatgcagaaaatgtaattctccccagcttctgaatgcaaagagaaactagctcaccaatggaactactcaaaggtcaagcctttcagttaaaaatagaaaacagccttttcctaagggacattgagggaccattctcatacctgcaggaccaatagtcctttgtggatatggaaataataatagaatgttctgagagggatgcttcaacaagcaacacccccaaaactgagttattcctctatctaggcaatgtatatttttatagatgagtaagggctgaatccaaaaacatttaatgactagcactgcatgaacaccagcccatcagaatgaacacccaacatataagaatggtatcaactcttacactgctatgttctggctctagctgaatgtcagtactgaggtatgccatgactattttaagtcattttagccaaattcaaggtggtggccaggtaacatccctttatcaaatgctaactgaactacaaaatttagaattatgaatccctagacagattggtaatctgaaagttatgagaattgcatagccatgaccatttataattttatcaaataatatgatcaataaaacattaatctaatttcctcacaaatttatgcaaggagcatgatgtctggttggcttgtttggatattgatgtccatgaaaatgcataggagagtattaaggggaaaatcctccctatttgttgtacaagattctttaagagaggctgcagaaacaccaaacaatgtacaggcataggagacacaaaatgtgccaagaaaattacaggaaatttcagtatcaattaatgtctttttgaaatgcaaccccctccccctttttatttcctctctttcactaaactggctcatagctagtatcttcccccagtgctcatataaaataatacaatggcatccatagcatccatatttcattctctaattctaacctgccctaaaacaaagtggaagttcagggaaagtatctgactccaagtttagggcaggggaattcatgatagccctggaatcttgttaatggacaatggcatcatcaactgtgtagtctcatctgggatgttagtaccctacagaaatttcaacccattgtgctgtagcctttcctctaggtggtcatttatttccattaagatactttatattttaataattaaattagaaaactaagtatattcatctttttttccatttttgtataatttttgttaaagttacatcatttttataaaagattggcttccatagtttcttgttgcctggaaaaaacctaaataatatttctaaccttctaaagtcagaaaaatcttaccgatgaacatatctcatcttcatactttccaaaatgggtattttatcacttttcccaatgatctgtcagtcatccccaataactctttgactatgttttctattactatactctccatgggaagccacaggggctcctcatgattcctggagcactccaagccccactgcacctcaggaatttgaacatgctgctgttcagtcggcctgtaattcacttctccagatatacatatggcatactgcattctcaccttcttcatatctttgcagacagtcttgtttaaaattgtaaacacaatgacaaccacatagatacctaacccctggcatgtcctttttttcttttctggcttattttttccataatactgataatcttcaaaaataatatataatttgcccatttactttattttttcaccccactaaattattaactcataatttccaggctatttatatacattatatataatctctctctctataaaattgcacaggctgatgtatgtcctgtgtcatacatgacattaaatgtttatttgtccaatgaaataaaaaatggttacaagttctcagtaactttaactttttgtatgttgattttgtgtcatgcaactttactgaattcatctaaatcccatttaattttttattccttcttctttatcaattaaggcatttgtaactatgatctttattttgagtctagaattcactgtgttctcatagcactatgcagtgttctcttttgaactgctttctttagagtctgaaatttccctttgaattttctttgaacaaaggattaagtaggaatgggtttcttaatttccaatcagggaagaatttcatttttaaaaattgcatgtcaacaatttcacttaaatgtaaattagtacaaccactgtggaaaccagtatggagattccttaaagaacaaaaagtagacctaccattcaatccagcaatcccactactgggtatctacccaaaggaaaagaagtcatcatatgaaaaagacacatgcatacacatttttatagcatcacaatttgcaactgcaaagatatgaaaccaacctaactgcccatcaaccaaagggtgaataaagaaaatgttattatgtatacattcacatacatacatatatacacacataccatggaatactactcaaccataaaaaggaatagaataatgtcttttgcagcaacttggttggagctcgaggccattattctaagtgaagttgctcaggaatggaaaaaccaaatatcatatgttctcatttataagtgggagttaagctataaggacttaaaggcataaaaatgatataatggactttggggacttggagggaaagttaaaaggggagtgagggatcaaagaccacacattgggtacagtgtacactgctcaggtgatgagtgctctaaaccctcagaaatcatcaataaagaacttatccatgtaaccagaaaccacctgtaccccaaaactattggaataattttttaaaagagcataaaagttcacttaaaatatttaaccttattagattatgataaaataaatgacctaatctggactttgttaaacttttaacatcagggaattaatataaccttaaaaggagtgtcttggtataccttctccttgtatacctttgtagcccacttgaatgttacactcataaatcaaattgctacatacacgtgagtgtatttgtagactttgtagcattttccatactatttcaattactgtatagttatataaatattcactattttaattactatatcatcatcaccaccattactatcatcatcattatcaaatagattgtttgagttttaataaatgctgagactttacacatataaaagagattcattttcataataatttggtaaggaaagtattcattataggtaggaaactgaagtcaaaagagattaagcaattttcagtggctactcagcagtgtagccagagcacttctggaacactattttatttctttagaaaatatttgaatatttggcaatcctagtctactatcattatccctcttttaaaatattatttactatatttgcttacttgttttcccacataaatttcaattaatattgtattaaattgataattagtattatattgcaatattaatttagtggaaaatattaatggataaaatatatacatacagaattatttttccattcagaaaacgagcaagctctccatgtattcaaaatttcccttaaattgccacaagatttttattacatttattttcttatattacatattttgatatccttgtggatgtattcttttctgttatattttcttaaggagttttgtttgcgtattggtaggctattcatttttatttattctgtagctagcaaatttctttaagtacattttttcagttttttaaaattatattctatggggctttccatgtaaatatgcatgccatccacaactaacaagcatattttattgtaaatatcaatattgcgtattttctaattttcaaattatgtagattcaagttttatttactggcaaacttactaaacaaggataaacaataagtaatagaagacgatcttttctttggcataattatactatccaataagaataatttatttcaggataaagtttatataccttcttgagttgattattctattaatttgtttaataagtaacattttcagaactagagtttataatatctaaagacactttatatatatgaaagtccttttgttttcctctcaaataaaatatcaattcactaagcagaaaattcttcagtcatattttttcctctcaaaacaccatgcgttaatctaccataccttgcaattagtgttttagattaaagaaattgttttcattcttacttggttacctttccagtgaggaaaacaaaacaaaacaaaattcttttgctgtcacagtcttggaaagacaagctggaagtcagtttccctctcatggttagattggactgctatatttgcttttataaccatgtactacttgacatcctgacaaactgctttgttcctctggttctccctgagagaagaaagataggaatctgagaagccaatctgtggtccagaaagagccggtggccatgtctgccttaggttacttccatctagaaataaacaggcctggatgtatgatagacaaatgctgtaattgttgacttggagccagacatgtaagatgagcacgctattgtgcacactttttctcttcctttgtgcccatacacacaataagtaggctttaaaatacgtcaaatatttaaactaattgatgaactaagaaaaactgaaatggagtagctaaaaatgattgatattaacttagaaccattacataatacaattctattttatatattttgcttggtgctgagtcttttttcatccaatttcaagaaaagctctctctctctttctcattgcctcttctcaatgaaatatcagtcttctctctatggaaattctattatgcatgctgtatatttttactctcacccatgctcttcatgaacctcacttttaaaataaattcttgccgggtgcagtggctcacgcgtcatcccaacactttgggaggccgaggcggcggatcaagaggtcaggagatcgaaaccatcctgactaacacggagaaaccccatctctactaaaaatacaaaaaaaaactagccgggcgtggtggcgggcgcctgtagtcccagctactagagaggctgaggcaggagaatggtgtgaacctgggaagtggagcttgcagtgagctgagatcgcgccgctgtatacagccagggcgacagagttgagactctgtcacaaaataaataaataaataaataaataaataaataaataaataaataaataaataaattctatctcctcattctttatttatagtactgcattagcttgttttactgtaataaactaatgctcttcttttaacagtctactgtattttagttttaaatttagtaatcatatttttatcttctaaactttttcttgttttcctatttttccattctattacttaatgttttttgcatgaatttaatactttctcaaacttttcaatgatgacagattgggaagaactaggacaccttctttaacaaacatgataaacctgagaaataacatggtagagtaatgaaaaactcgacgacctctatagccagattgcctgagtttggactctagctctgccaccagtagttgagtaatcttgcttaatttgtttagattatcaaaacttcagaatcctcaattgtgaatttaaagtaaaactactacccaccttataacattgtattaagttaaaaatgaaaaatggtaaagcatttagaacagtgtttgacacacgtttgtacttaatacatgttagctaataactagttaaacatgacagttgtcactagtgagtcagttccaggataatctcttttagctcgttatgtgggtggctcttcatcaagagatattggtggattccactgcatgtctcttctgctatttagataggtatttcacttacatgtgatgaattgtgatttggtcagcttcagcttcattcctgtttactttctgcggtttatctttcaaaatatctctccatattattgcatattgatgaatgatttaataatttcaggtagtgacacagttttgttcagttcaacaggaatttagatgaggttataaaagaaaaatcatgtatttagatcataatcaggtattgctctccttatgtattaaatatattgttgagggagcatgtacgtttttgtatacacgtctcagtgcgtgcgtgttagtgtgcacttaggatattgttgagtagttgtgtgtgtgtgtgtgtgtgtgtgtgtgtgtatgtgagagagagagacctggtagaatttccttatattattactaatgtacattgttttatatttgtttatggctaactttcctgcttatatgagctaattttgtttcagttcaatacaaagtgctacctgagatttgatcttttgtatttcctttgaggagcctacatgaattcttcctgctgagcttaatacaaccaccacagcaaactgaccttcattttcttgagtgttcttttgtcacatcaatgttcttttgtgatgttctatttgttgttgtctgaagtgcatttagattgtgagataggagatttttatttcaattggcattgatttttgaaatgtattcactcactttataacttgtgtgggctgcctaaaatgaagtgcttcacattttttttcagtgttagggatttgtgctggtatgcatctcataatatgtagttttcaccctcttgatttataaaaccattttcacttttagaaaacagtgtcttaatttaatgctcaaggaaaagaactccagatttcagtcatatgccattttaatgagttggtatatatgtgcatatgccattttaatgagttggtatatatgtgcatatctatgtgtgtgtgtgtgtgtgtgtgtacatacatagatacatatacatgttagaaaataatgatgctaaaaggcggtgaggaagattatttatagggactattttgtcctctgcatgaggattctaacacatagtattgagattagagattgcgtactgcatctaagtggtgttaccaaattagtcattagattaaatgtatcattaaagcaactcaaattaggttttccccactgcattgagcaagtttgattcagaaatgatatcatttgtaagatttacctgatttctggtgtttagtacgacatcttattatttattagtactatcattcagaatgagaagtttaggacaagcatctacatatttacctaatgacaattttgaaatagccaatttcatttttatgcattgatgcttccaatattatttgtatgaagctgacaaaaaagattctcatactttgagaaaacactttgagttattcctcttttatgcatgcacgattatatttttaaagaataagagattttaaaatactagtctaatctcagtcagatgacaccaatatcatggtgtctatccctggccacaacattttaatgggaagtgtttaaaaggaaaggtcatagataaagataaataattctgatatacgagatgggattctactgtgagataacaagaccaccacatcctcagaatagaaaccctgtctctaccaaaaatataaaaaaatagtcgagtgtggtgtgtgcgtgtaatatcagccacttggcagggtaaggccatagaatcgcttgaacctgggaggtggagtttgcagtgagccgagatagtgccactgcactccatcctgggtgacagagcaagactcagtctcaaaaaaaaagaaaaaagaaaaaatgatgttcagattcctatttatttggcagtttaaaaggcatccacttattcaaaaacaagtaaaattgtttagaagtgattcaaatatagatgagacctattagagattcagccctaacttaattatatttaaaaagcaaaagtacaaccattctaaagatttcacggtcaaaaacattgtaagatctggagaaacattagtaccttgggatctatatggatttacactatgtggctcatctacaaaccattgacagttaatgtgatatcagcaaataatcagtttatcaatttgtactccataaaatttttctctcatatgtaagttcatgtatcaatatcaaaagaagagtctcacttaaagtaactctctctatataagccaaaataaaaattgagatgaaaatctcagaaataaaggttataagaaagaaatctgacaaaaatatgtcctagtaaatgaatcagcattttatttgctggccctatcaaattagaattttacaaggacatagtggtgtaatctctgagtccatttgagaaggtaatgaagtaattgtttgccagtgattgatacccagcacaaagaagacaactaaagaggtgagcaaagaagagtcttccaaaataattttcagcacaaggtaattgccaaatattttactgtgattgaagttactacattacaacaaaagacaagcctaaaatcaaaaaactggagaaaagatgacgtgacactgatctccaagcacatacttggacaatttaacaggcatttaaggaagtagaaatttaattctgaaaatcccttgtttaaattagtctaatcatgtttatttcctaattgtaaaattttatggagtatttggcatgcatgtgttgtagctttccaaaaagggctgtagtattcaagaatctccaactttgtttaaccaccactcccttttaaaaaaggaatgtatttatttgagataaaatacattatcttagataaatttattattttagattgttgtcagtaaaattaattctttttaaattaattcatatatagatatagaatatttttggtcctttttaaatatattttttgttaaccaaccatggcagtcattatctcaacactttagttgctttctagtagctttcatgctagataccaatctcaagcaaataattattcattaccttctcagacagactcagagtttacactttctcattgttgtaaaaattgaaattgatatggtccaaaaaacaacatgctgattctctataaatataatgagatgatcattttgaactattacatacatgcacaaatatatatatatatatatatcgccacagaatctcccccaaccccccccccgccccccaaaaaagcaaagccttttgactctgttattattgtcaaaatcagctatctaaaaaaagtgcctctattgggttgagtctggacatctttcctgtgtacactgtgggctgcagacagagttcactggacaaaatgttgaggtaccgaagtctatgtcctaatctttcatccgtgagaaaaagatgaagaaaagcaagcacaacactatatttctacagactttaattttattttatcattatagtcgtactctgcctaaaatgcccaaattagtgactggcatggctgacaaatagtataataaagagtaccaataatttttatacatacacataatacatataaatgagtttaaaaaactaatttcaactcacaactgtctaagatataataaagtgaaagataattaaaagatttatgagtaggttagagtagaaatattatggcaaaaataaaaccaaggccattttagagccatggtggctgaaatgtaagctatatcaagaattagatgaaaataggtagcataagtgataggacaattttccctactttgaaacttatttagaagttatcccaatcaagaacagtggggtacatgcacgattttttttccttcttcttctgttgtcctcaaaaagctaatcttggctcccttgaatcggaattcagacaactaagacattctttcttaagtaacagtttgtttgcatttagaccattatctttatggccaattttattttgagtatgaaacacatgaaagacattttgcagaaaatttatgagtgtattagaaaatacctacacacaagaaaaggggttttctgtttttgaaatggaaagtacttatctaagcacctttcatgcactgggtacttcatatttccatttctcaataacaacatttaatacataaatgtaagggtttgtaaatttactgcttcattattactgagtatgtgcttgtgagtcatcctggagtgcctgaaactagaaaaataaaataataaaagatcattttataacatgtaagtgtaagaaaaaactaatatcctaatttccatacagtttcatataaaattgctttcagcaaaagtccctcacattaatatataaatgcaatttttaactaaatcatagattctataatattaaagaatttgggtcagccatggtggctcatgcctgtagtcccagctactcaggagactgaggttggaggatcccttgagctcaggatgtcaaggccacagtgagctatgatcacaacagcctgagcaacagtgtaagactctgtctcaacaaaatgaataagtaaagaaataatttggaggccattctgtaaggtacttttatttgttgggatgcaagtttggctctagtaatataactcaaataacagtaacttatacaaaatggaattttattcctctcaaataacagtacaacataaacaatccatgacttatatggtggcctcaaagatgctgggttctacagttcttcacaagttttttcagttatgatttttagttctagtcatcacattttcatcttagctaggggaaagagataaaaaagatgacacatattcttcttcccttaagaaccaatttaggagtttcatgcattcctcccatttatatacatgtatccaccttaggtgcaaggaaggtatacaggtgtgatgcagcatgcgctcagatgaaactcagggttgtactagtaaaggaagagaagatgcaaaggaagaagtgtttgtcttctgtctattagctacttaggaggagaagaaattgatttcaggcattctctatcctaaagagtgatccacatagccctgggtgtaggtgggaaaagagggcaagatcctatcagaagatgcacaaagtcaaaactattttcatagaaataaataagacatttttcttttgcattgttttgacacttccactgacagttctaaagcaatggagagtaaactactgctgaaggcttactacaaaccaattagtgccaccaaactgctctcctagtggggatatattccttactgatacatacttgtaaaacagaaagaaatgttttcaagaatgttcattttgaagcatttaaaagaaagtttactgcatcttaatcttcagtataaatctgcatgtcaaaacaagacacatgaataaaggacttatgctgcagatagcactataatagttgatttgaggaaaataacttttgccattattttagttgcaggctgaggtagccacgtttttcatggaaaaccatttttacttgacatagtttgacagaaaaatgatggttattcagacttggacacttggtggatctgttatcaaaacttaaaaaaatgaggctgttgcttcaggacaaacaactgatttatttaacggcaatgataacaataaagcattcaagtgaacaatacagaacttgtatctgccactagaagactgacagctttctaaaatgtaaaggcttttctcatgagtccaatgatgatattaataataagttcttttgttattgcctactgaaatatgtcagcatttggaagattttcatatataagttgaaagagcatatataggagtgcatgacatagctcttatataatgaataggtagacttcaactcatttttctctgtggcattaaaatattccattacatctcactttattttgttaataaaatatgaataacttcataataataatatattcaattgttttaattgcttgctgcagcctgtgtgtcctgactcagaagatctgagtgtgtacttctattcacaactctgtgttcagtgacatcacattggtagattgatattgactgtggtagtgaacaaaaattgttaaatattgttcatcaaagctttcctttttcctaaagagttgtttgctaaacttttaccaacacttcattaaatgtagtatttctatggatccttgctgctctgtgaatggcagcacaacatagtatagctcagttacgttttaggaattatactatgatagttttcaataattgctgacataatttggctctgttcccctactcaaatctcacctcgaattataatccccacattagggagggacctagtgtgaggtaattgtaggggcagtttcccctgtgctgttctcctgagtgagtaagttctcacaagatctgatgttttaaaagtatagcacttcccccctagcttcctttctctctctctcctctgggtgccatgcaagatgtgtcttgcttcccctttgccttattccatgattctaagtttcctgcagtccccccagccaggaagaactgtgagtcaattaagcctcttttctttagaaattaccaagtctcaggtagttctttatagcagtgtggaagcagacaatacaattgctgtaatcactatcttgtgatgaaattagtaagccattgttacatagctgcaaagttttagaataggagcaaaagttgactacctcaaggaaaccaaattgtcgcaggctttagagtttactcaagtaagaaaaatgatttttatgtcgcatgaattcctcagagcaaaaatggtgagattaatctgaatgtcaagctttattgaaaaggaagaactatacactatacagagtaactttaatctatctgtcattatataggaaatgtgaaaatatcttattggtggagatgtactttgaaggtcttgtttgtttttgcttatttttcaagatcttagcagatcataaattgagagaaaagttcaagggaatgactgagaacaattccataaaggcaagaaaaaaatataatttgtaatgaaagcgaattactggtatggcttatctaagtcttcttcaaaaatttctgaaaatgtaacttacaaatacccaatgttcagtttacattctaccatattctaccctcctagaatccagtacatattttttttttgttttcctgatgtcatttcatattattcttttaaaatggaaaaaaagagagatagaaacaaaatgttacattggcagtaaaagaaaaacggggatggaaaatatcaaacttcaataaacaaatttatctagcaagaagtctgcattgtttttgtgtgtgtggtgactaatagtcaacttaggaattacgctaaattaaaaaaaaggaagtcaagaaaattctgtggcaatatttgacttatttaatttagaagttttggaaaacaaagatttatctctactatgttgaattctaatgcaaatattacacttctattttattctacttatttgtgttggacgctcccagtttgaactgggatttcagcttcccacattttcattacaaaacttgaacttgtatagcatttttgtatgtcaacttataattcatttatttttactagaaattaatgtggcttccatgatatattttactctagtatctgctcaattgcagtttctgttttttcactcacctcacatatatctgcactttctgataatacagtcttccctcagtatcccaagaggattggttccaggaattcctccattcccccaatattaaaaaaaaaaattaacacatactcaagacccacagtaagccttgcagaatctgaggatacaaaaatcagccctccttatgcatgggtttcgcatcccataaatactatatttttcatccaccaggttgaggatgaggaacttggtgatggaaaaggttgtgtgaaaatctttttgattgggagaaatctgcatataactggacccacgcagttcaaactcgtgttgttcaaatgtcagctggattcagatttcatggattcctgtgaaccaatgattgccgttccttgagattggattccctgagattgtccaaatcttccctgagcttcagacatacatatccagctctagatgtactagttaaaaagaaccctaaagtcaatgtctttataaccagactcatcaatttgcttcctaattcacctcatcttcttgcactttctattttgggtaaaataatgtattacatggttttcaaattgcttttaacctacatatataaagcataaggctcattataatcaaataacaagatcttcacccagccacattttccaggcatggaatgttccctgggagtacacaaaaagacatattaaatatcttatttgtggaggaaataagaaaacttatgagatgcataaaataatgatttatagcagtgcttagaggaagctttattgatgtgaatgactgtatttaaaaagatgaaagcaataacaaggaatcaacctaggtttccaacaatggtggactggataaaaaaatatggtacatacatgccatggaataccacatagccataaaaaataaaatcacgtcctttgcagtaacatgaatgcagcttgaggccattatcctaagtgagttaatgcaagaatagaaagccaattaatgtgtgtacttatttataagtgggaactgatatagtttggctgtgttcccacccaaatctcatcttgaattaccacatgttgtggaagggaccccgtgggaggtaattgaatcatggggcaggtctttcccatgctgttcttgtgatagtgaataagtctcatgagatttgatagttttaaaaatgggagtttccctgcacaagttctctctttgcctgctgccattcatgtaagatgtgacttgctcctccttgtcttctgccatgattgtgaggcctccaccagccatgtggaactgtaagtccattaaacctctttttcttcccagtctcaaatatgtctttatctgcagcataaaaatggactaatacaagaactaaacatttggtacttatggacataaacatgctaaagtagacactagagactattagagtggagagaaagtgagggggccaattattgaaaaccactgggtactatgctcactacctgggtgacgggatcaatcatacctcaaacctcagcatcatgcaatatacctataaaacaaatgtgtacatttaccacctgaatctaaaataaaagttgaaaaattaaaaagaatgttttattcccaaaaggtgaaaattctcaaattaataacttaagtttttattccaagaaaccagaaaaagaaaatgacattaaacacacagcaaagaggaaaaaataatagaattggtatgaaaaataaactaaaaatgaaaaaaataataaggactatcaagaaaactaaaagttagtgaaaaatgaaaatgaggttgaaaaacttttagctaaactgaccacagggagggggagagagagagagagagagaaagaaaagagaaaggactgcctaggaaactgaaaagacaccttaaagaatagaattaattatctgtatatcatacaactgatagggaacttgcaatcagaacatatgaagtcctcttacaactcaatgcccactttcaaaaaaatattgaaatctgtgaaggatttgaatagacatttttccataaaagatatacaatgaacatgaaaagatgttcaaagcacatgaaaagatgttcaatattgttagtcattagggaaatttaaatcaaaaccaaaagatattatttcatattcacttcgatggctataaccaaattgatacaaaatcacaagtgttgaagataatgtggagagattggagttgtcatttgtgactggtgaaaatataaaatggtgcagccactgtgaaaaacagtttggtagcttctcaaaatgttaaatacagttgtctcatgactcagcatttctccactttggtatatacccaagaaaattgaaacatatgtccacataaaaaagtgtacatgaatgtttatagaagcattattcataatagcttagaagtacaacaagccaaatcttcatcaagtgatgaacgaataaacaatatgtggtatacccatactactgatgctacaacatagaagaacctgaaagcagtttgctaagtgaaagaagctagtcacaaaaggccatatattgtacgatcccatttacagaaaatgtccaaaataggcaaatctatagagacaaatagtagattagacaaatttatagagagaaacagccttggactgggtgaaggtttatgaggagtgactgctaattggtaatccattcctttttgaggcaatgaaaatgacctcaccttagattatgatggttgcatagttttttttttatactagacaccaataaattgtaaaaccaaccaaacaaacaaaaacaatccaatgttttctttttaaatggatgtttaaaattatgtactaaccttcagggttttttttccagcaaaagaaatctataatcacagagttctcatcttaatgatttaagcaccaagtcaaaattcaaacattttatgtaagatatactgatacaaatatatatttcttgtgatagtgtcctatattttcccgtagctttttgttttcgaactgacctcaaatagataaatacaactttttattacacttacttgtcagtacatcctaaagcaggaaattcaaacactgcttccccaagtcagttcagacacaaataatttaattgttgtcatcattcctattaaattttagaagctttcatagtaattttcagaagtttttgtagaattaggtttgtggttttctatacactggttatagaaaatacatcttgaattattttatttgaaaattatgtattgaggaattttaatttctcatcctgtttgtttcctaggctcacaatgtaaccatagggctttgtgcttttctgctcactgtaatgcaattattagttggctacaacacataataaattagaatgatttcttcattttgataagaaaagaaaaaaagaaataagtgctagtatatatttttctcattgtactattactttgagaaataactataatttattatttgagacaatatattgttttcaaattatctctaatagtataaattagatcatgatttgtatattaacacacctgcattcagaaaaataaatagaactcactttttcggcaataaacttaattgcttacattaccacaaatgtcttacctttgtcttggcaggctgatgaggggttgtttatgacacctcttgctaaggctaaaaagcttgtgtacaattttctgcgcctttaggaaaagttgtttcatgctgttctccagttgttcataacggcgctgaaaattagaatccattgtccacaaatgcattatagtagatgtgttgaggaaataattcataggtagccttttcataaataacttgaattcatctgaaaaatgtcaaaattcaacactttaattatgaaacaattattttttgtttttcacaaacacgtatgtcaatattaagaacaaatacatatacacatatatgtcaaattaagaacaaataaatacagtgcctcatttgtgagtagcaaattaatagaagatggggtttttagatgctttagaattatcttctttgctgttccctttaaaatagaactttcatgaaagaagaaaactaaaataatttgtgctaaagcaaatagttgaagcagaaagtttaagtttaacttaatttttctgtgtgcttcttttaaacgtctttcagtaaactttcttcaatacataatcattaatctgactttcatttttggcaatggtattaataatcctttgtatatttaaaaaccttttcagaaatttttattaaatcagaatagaaaatatataaaaccaaataattgtatcagtttttaaagaaaaacaaaaacctttttaaatataaaattttagattttaaatataaaattataatattaaactatgcaccctaattataaccgatcttatttttaaccctctttgtaactgactatattctaatttgttatgactaaccatttaaaacatgagtacatgctaaaaaaatactgaaaagaatttaaagctgaaatattggcttttgtttttgagtcaataattgtgctgtcttttcaactgtctcgtttaaccaacattaggaataaaagttgatgctacactaaaataaataataataaagaagagctaataaatatctgaacacaaaagatagttgaaataattttctaaaggtggaaacaactagacggttaatcaacaaatatgagcatatacaaaatgtattatatacatacaatagaatattattcagccataacaatgaataaagttctgacacatgctacagcatagacagacctttaagatattacactcagtgaaataaaccagacacaaaaggaaaaatatattgtatgacttccctttaacgaaatatcaatgctgggaaatgcaactttttaacaattcacagtgaattatattcatgaacattgggtttatttttcctagatcaaataagtacagagttctggcatctttacggcattgaaggaatagacttttatctgaaaaaagaaggaaaactaagcaaggtaacagtactttttacagaaaaaagaaaagagaaaacattttatagggcgtatctgtccaatatgcttcaaaccattttttaagtaagcagagtttaaataatagatgcattttttttttttttgagatggggttttgctcgttatccaggctagagtgcaaaggtgccatctcggttcactgcaacctccacatccaagcaattctcctgcctcagcctcccgagtagctgtgattacagtgcgtgccaccaggcccagctacttttttgtaattttttagctgaccaacaaggtgaaaccccatctctgcctcccaaagtgctgggattacaggagtagagccactctgcctcgcctataattccaatttgatcatatcctatattttatttggtcccatttgtgtcttttgttaaattccctcttttgaataaagagttaatgcatggaaattggaaagcatttcttggattatttacatagcagatgccactatcttcaaaactaattactcatttcattgtcatctttacttgaatagttttgaaaatcctttattgtattgtaggcatacatagtttaattatgttcattgtttgttataatagtattgggaagggatttaaattcataaattttattgaagataaggagtatctttaaatacattttaactgaactaaagtgagtataacaatgtatggcagctgaaaattgccagtatgtaatttctaagaaatagggttttaatatgacacttgaataattacttcattatgaaatcattaagagtcaccactgtcacccaaaacatttactgaacacctgttgtgcacagtacatacagatgtttcaatctatgacaacaaatatgaataaacctgtctttttatttaaaaaaatgactaatgatgtgcaatattttcagatgttaaaactaacatcttcagtatctgaaattcactctacttagaagacccccggaaatattcctgtggatatcttttcttttattgttggcaattagtaaaatttatatttatagaatacagaaataaaatttgaatgatgcattagtattataatataaatcaacaatttacataactacagaaataaaacacaattgttagggatgccagataacattttatcttataggaattaccaaagctatgtaaaaaataaagtattatttgcttttaaagtggaaaatacacaacagccctacttttggggatacataaataagcctgtaaaagaaaacaaatcaataccatgtaaaaattacccagaaaaagttaatctaaaatattggtaattagagagattttattctacaaatatctctgtgttaagtatgtatcaagtgagtacttttcatggcataattttgaggacaatggagaaacaaagtaaccaactgcaaaaacaataataatgggaataaacatcatctaagctggcaggaatttatagtcagtcacagtcttcttaaaacttttcacatgaagcaaataataatacgtagtgaaatgtattatattaatgaattctgtggaaataaatagaattagactgggtgacaactttctaataaattatagatgaataatgaggcatgatgttaactctctggactactactacttctccattaaaaattgagtaattttgaaaatagttaaacaaggtttgttgtgcctttatcctttttccgtcaatagaaaatctagttaacacttgataaccaattagctaattttgaaactaatagctataaatattaattcaattatttatcccagtaatccttcatgcagattttattggagcaattttatatgcaaaacacaggtaagacttggtttcataactctgttagcaaaaagttttattaacaccactatattaaattatcttatgtatttatgtctttggcatttatttccatgctttgcaattgaattaaactgatgagagtggggaactgaaaattttggggatgttaaagaatcagactcagatacatacccccgattggaatttttgcccttactaataaacgtaaaaaaactttgaccaatgcagttaattgtgtactttcaaatgttcagaacctctattcagaactgctttagaatatattttcaaagatattctaaagcattctaagttttctagagttttgagggtatataatttacttcctgaattatgtaaaacattaatcagtttttcattatttgtaagtaatttcttgagttataaatcaactaaaataactcaaaacagaagctgctgtcattggtaagcaggactatggatagggagtattgaaagaggaaacttgtgcttgcttttatgattgttattaattcatattattgtgctaattatattacaatttatattaatattgtgaatacatataaaatataagcacaatactacagaattatcaatacaccaagtacatatcttctgtttcagacattgattttttatttattattttttagagacaaggtttcactctattgcccaggctgaagtagggtggcatgatcatagctcattgtaaccttgagctcttgggctcacgcaattctccggcctcgtccactccagcaggtaggattacatgcctagctaatattttatcttttatctctttttttttttgtagacatggggtcttaccatattgtacaggctcaagcaatcctcccatctcatcgacccaaaacgctggagtttcaggtatgacctacagtgcctggcttcagacatttaaataaaatgacattatttaattacttgttaacatgaggtaaaactctactggctcacattttatgtatgtgtttttttaaatcaatgtatatattggtataattcaagtatttcagtagaaatgacaatgcaatatggataataaatttattatgaaagcatagcaacagtttcagtacaatgatagaaaaatacataatatctaacgaaatacataaaggatgatcacagggcacataaaataaaaagagaaatagaaaaaaacatatgtctgatatatatataaagaatccatgcaaacatttgtttttacacacaaaaaatgatcatttctgattttatattaccaatccaatgactttaaatccatttcttctacttatgtttgtgaacataggatttcttggaaaataataagtgctcataacaaattctagtaacacaatttttttgtaagcaataaactaaaaaaaaaaagtattactttctcacactaaatgcaaaactttggggctttccatacatgaacacatagcaagtatgctctgtttcattggctgttttttttttttttttttgtgtgtgtgtgtgtgtgtgtgtgtgtgtgtgtgttttgctgttgtttagtctacagttggtttagacgcaatactaagtactaattccaaagctgacaaataaatatgaaactatgttttcaatgttattgctcaaccagaacaccctctaataaagctatttcttgtttcttgagaaccacattttcctggaatatgagttcctttgtcttctgattttcagtggcaaaaaaaaaaaaaattctagcaaataagttaatcaaaaacctcgacactacagaaatactagctttaagtcagtaagatacaaaattggcaagatatgaaagaagtgggaatgtgagtgagaagaaagactcacggcaagaaaagttgagacagagaaattccagacagtgtcctgaatagcagaaagttaccaagggctgaaatggcacctgctcctccagggagcactactaatacacaaattttgaccctcgctataacccttagtagaactggtagattttttacttttgctaactttttttctcctaacggttctaagggactatttcaatgatttgtattggttttgaaatttcccaatatctacagtaaatcactgatatgactttgagtagccacacatcaatgtaagtctattcaaaccattctataagccatgggtatagagtttatacggaaactgacaaaatactataatgctgcataaagtaaatggcaagcctgttcaatagcttgtgaactggacaattttatgaggctacaaagtgatgggtacataagggtataaatcagaaacagattctaattccttagtagctgccagaaataaggtatgctgtttctcactattttatttttctctgaaagatgcatcatgttttatattaaagcatttcaatacatcaagccaattaatctgtccctcactgggttgccctgtttatgaccccattcatctgtttgagaaattactcaaatacagccttatctcttagaagctggaaaacccaggtcctcactctcccagtgtccttgcaactacggagggattgggtgtatcatttaaactagaagaaacaggtgtaccacccagattttgatcttaagttgttaatgcaaagacaaagagagtgcctagagaaattttctcaggagataatgtttgcagcagtaatggtaatggttagttggttagttccatatggtgttgttcattgcagttagcagtgttgacctcactaaatacgtcttatgcatttcttttttttaagatggggtctcactctatcactcaggctggagtccagtgggatgatttctgctcactacaacctccacccccagggttcaagcgactctcgtccctcagcctcccaagtagctgggattacaggcgcataccactacttccggctagttttttatatttttagtagagacggggattcaccatgttggccaggctggacttgaactcctgacctcgggtgatctgcccgcctcagcctcccaaagtgttgggattacatgcgtgagacatcgcgccgggcctatgaaatttttttttactgtttcctgtgtagcacatgagtaggtttccctacttttcttggcgatttgatgtgccatccagaatccctttatccgattttggattttggttgtgtcatccaaaatccctgaatttatccgattaagtgagctagagcctgtttgtcttatttacatcaaagaatctgggcttatacaggtacagataccagaagtggtttggtaaaagcttccaaagaaaattgagagcatatgtggtttgtttcctactggctgggacaaaaagctttataaacctacacagcattaagggtagaattttgacattagaaattccacctctgcccacctagaatgaagtgtgtgttgcagaaatggcatttggacctatatgcctgcatataattgaatgaagagcatgaaaaattcaaagactgtgggtgagtttactactaatagagatggtttgcttaaagtgccccaattcctacccattcaaagtacagaatgaatgtgagactttcaaagcctgtgctaaataaatctttcacctcttgcagctgtagggcttcaaaacaagctttgaccccaggattgaatttaaattcctttcagatctgttatgttaaagttacaaagaaccgtgattggagaggcatgggaacctcggaactgaagggtagatatgtaggatgactggaattgatttaaaataatctaaagcataaacttttgctttcccacccctgtgaagccaattcttatgcccattatgccccaggggagcttattaaaaatattcaaagggaaggataattttccaacagactaccaagaatttgctcattttttattggaggaaaaagcattaaatgcatgggtaaaaggaatgctagtatctccgagtgctgtattggcatttgtctataggatagggacatcagagtgaaaatcggtgtgaaatcagttcagctctgacttcaatgaatatataattaccctctgtactgaggcccagtagcaactattagccatcagagtcacagtgaacataggtattgtaatacacagatagttcaatgtgctacttagaaatgtttaacctgtagaaattttagagtttactaatcagatcatgcgcattgacaaatacatgaccagtgccttgaggtcctatttaatttgtatatatatatatatataaaaagcaagacataggtctggcaacaaaggcctggtttgagtcatcatgagaagaaagttgtcttatcaaattctcagccctgaatcattcctgaatcatttcaaagaccacatctcttgtatcacaggttagtaagtatggcaaatattcaactcgaatggtgagtgataatttctggggccctggtatgctacaatattctggaaatcagagtgtggtcttataaaaatccggtaataaattcaatttctcctatatgctcttcacattaggccaataaagactgtaacccataagatgtttagtttccaattacttgagtaaaaaattgtaatggaagaacattgacttcataagctattatggagtaagatcaattaagacaaaaatacaaagtgaagcttcctgtttctgcttaaagtataaatctagagttacattgcttgtttttcatgtttgacacaattccaggaatttgggatgcatgcagtacttgaaaattgtgaagagagtattcatattccatctccaattaactcaaaatgttggctaaagcttcaacatagagtcattctaattaaaactgctattcctgatgtggtagctttaccattggcatgattcttggcactggggataatgcttcctctctggcataaattgttttctctataactgtaaacagagaatatcaggcacaatttttctttcatatgtcagttacaagagttaaagattctcattgtattctgggtttaagtaatttctcagcatctgtgctacaatttattttacaaggacgtagatcatctcactgtgccacaggacatattttgttaatgacatactctgaaaaatatgaaatgtgaaatatgtaaaaaaacacgactagcaggtattctagcttctggcctataccttaagtatgcatgaggactgaaaataaacgttatttatattgagagtctggtgattctgtgcacatttggatatcctcttcaaaatgaagaacaagtaactgcttcttcatatccccttaataagaaagatgtacaaatcttggaagttgcataaaatgctttctctggtgacattactgataatgatgacttcagtgatctgtattggtgtggcagatgtgccagctgcaatgcttttgctccttgatgccctcaagagattacttctgctattgtgatttgaggcttgtttctggcatagcatctgagccagcatctccaatccttttgttgattctgtgaactatccaatccgatgtctttaaataaattcctttctgctgcaatcagatgctgttcttacaagaatgctgactgatacagctaactgaggcctcaagggcaattataatttgtagttcaacaagattttaacaaatatttgttgaatgtctactgtgtaccaatcactgtgctacttgagtgttaaaaccacagtaataataattattactgttataataatgacaactttatcaggaattctgtgttgatgaaattatataattactatgaaaacaataaaatgtcttttatataattagtcataaataactgttagttattatttttcttttataatttatttagtgtttccatatgtgctgtgctcagcactttacatggattagcccgtttaatccttacagcagtcctaggaggtgggtcccattataatctacattttgctgatgagaaaatttccctaagcaagtttcagcaagctgttcaaagtgacacagttattaattaaagcccagaacaaacgaagtctgaaaaaagtaaggctcctgccttaataaatataaatttttgtagagttgacaggaaaataaaattattattccctacacttaaagagtgcttttgtttggtagacttttcataaatattatcatattcaatctcataataaccatgaggtaggacagtctggttttgttgagatgtggtgtgaaatgaatttgaattataggattattgacagaccaacctatgagagaaaaaaaataggaaaataatagacctgaggaaatataaaaggaaagaattttatatttctctgagggtgagaacaatgttttatttttctttgtattttccctttccaaagccctaagacagcatattacatatactatgaattaagtatatatttcttaaatgtcgtaaccaattaacaagttccagaaggaaatgattgaacctaaatataaacatctacagactagttcatgtggaaaagcagttagagcttagtcatataaaacgtgaagccatttttttatatcttatgaccacgaatgactcaagtgggtaaaaaacagttgaaataacatatgttttacaattctaagacttaatactaatatgaataaagagaagtcaggttgaaagcaaaactgcaagataaaaatgtagatacatttcttaacttatggatgagaaaatggcaaatgaaatttaggtggaaaaattataatgtgtgtaaattgcagcttgatgacttactagtcaaaatatcctgcaataacctgtgatcattagttataagcaaaattagtagtacatattcatggctacattagtaaaatttacattcagtaccttttaagtcttaagcatttttataggcccttaacactcttaactctctatcttagttattgctgtaatgtctgctgcactgaaacaataaccatgacttagatatgttgagtaaatttttccaagtgtgatgcctgctatgtaatgcctggagaaaagttgctgaacacacaagcaatatttgcctatgagactgaaactcaattgaagccatgtacccactggcagatgaggaatccagagctaaagtgaaggtggtgagagataatctcagaggagggatttttaccctggcctaagcggtcagtgtggttgacgagatgccacccatagttccctgtttctttattggacataaagaaatcagcatacatgcacaagcatattgctgtttttgattgtttggttgcttgtttacttgtactaactagccaacagtatgttgatcaacatctaatggagagagaattggtggaaaacacttcacaccctttaaagagcaagtaataataccttcaaggaaaaataccctttcttttaaacaggaaacacttgcttgccactactctcctcttgtaggccaattgttaatttttgcattagtttttattccttttcaccagtcaatgtaaatggaggccaaataagtttagtgatttccttatgaataaagatctacagaaaagttgaattagtacttaaattaagaaatttcatccataatttgtctttcatattatgttgctactgaagtgttacatatattaaatgaaaatgtataataattattaaaataacactaattcacatattatttaactattaggaaagttaagaacaagcataaaatatattatacactagccacattgagtatctctacacataactaggaagaatgggaaacctgtcagttattttgctctatgacattcagctgtaatctgatttttaaaaatgttgtcttcttgccacacacagtggcttacgccagtaatcccaacactttgggaggccaaggcaggagaattgcttgacaccagaagtttgagaccagccggcgaagcatagtaagaccccaactctataattttttttttttttaattagccagttgtggctgtagtcccaactactcaggaggctgaggtgagagaatcgcctatccctaggagttcgagtttacagtgagctatgattgcaccactgcactccaacttggtgacagagcaagatcttatatcaaaaataaatttaaaaaggtctttctttcttgcagtagttttacatatagtggaactgcctactagatgaaaaataaaaacaatgtgattaaatttttaataagttaatatcagtgatttgggtgacaaataaatgcctaactccttatatatgagttaaattttccctcaaatatttaaatattggcttttatgtacataagagctattatactctttatttttatcatgttatgtttataaattatttaccatatttcttagttgttgaagacatttttcctccggattgaattaaccaaatgtgctatgtgttatactctcccatacatttttcataatgttacttaaatttgtcagaaaatggactttattgaataaaaactacatgtgatgctgctaattggtcatgtttagtttattgattcccaaattaaaacatctcagattgtggcattaataatttacagataattggtagctgtgctaacttgtttattatgaacttggcaccattgtcattagtctgaagctggtacatttctccccaaaccctcctccttgggaaattccagtttagactttatcagtgacagaaagtcatgtgggacgtggaaggctgacaggaagtggaagccatcatcctcagaagtttatgataactgaacatacgacaatcgaacatagcctttcccaaaatgcagtgatatggtggctcccacgaacagatacagcagcttccatagaaatggcagcattcccagaaatagcagcttccaaatacctccccaaggtttcaacttcacaatggccagatgcatgcaacctctcggacctgtctgcaaactaagctttctattcatgacagggctttgagattaagtggattaagaatgtttcttcagttctctttctaccttcttcctttccttcatcttctctacatcttcatgtgagcactaattcccatttaaaatcccttgtttctatcatacttttggttattttattttcctgtttaaaaacagatgaacaaatcaagtaatgcagctgcggctagttttctattacacacattcttcactcattacaaccggaacactgattctgttgtggatagcaatggatccagatataaaactacttgcagcatctggtgtatacatagcaaccatctggccaatgagacaaaagcaagaatctgtacgtgggggaagggatatattcatggctaatgttttcagtttatgatttagatcttgtccttattccttattgagctttcctgtgtcctttggagtaaaatgcagacccaaagctggagcagccacactgtaaccatgaggaaaaagtcaagagaaagggagatacattggtcttcatctcctcacgcccttgaagcagcactggcactaccacttcattgctgttatatgcagatagttgtcattgaaaatgagaaataaagagcaagaatggaagtctttaaagcaataattcctaaattgcttatctcaagaaccctttacattcttagaaattattgaagactccaaagagcttttgtttgtgaagatattttgtaagcatgtatgatattaaatacgtatttattaatgtaaaccatttcatataagtaacatattttatgaatgaaatacacataaataacacatttttatgaatataactattttccccccaattttttgtgagattagcattgtttcaaattttgcaaacctcttcagtgtctggaataaaagaaaacatctggcttctcatatctgcttctgtattcaattttccacagtattacacaccatgtagattctagacctgtcctctgtacacttgttagagaataaaagtaaaaattggaggaaacaacatatctattttattataataagaggcttgatcttgtggacttcctcaaagtatctcagggaccagcagatttctcctgatacactttgagaagtacggctgcaaagaataacaaaataatcacttttcatgcttgtaagtcactttataatttacatgttacttcagttaaaatcctcatcagtcctatgaagtaaataagagtagctctgctctattgactcccttttattgtcaagggaacttagcttcaaagtgataacattttctccaacatctaagttggtacctactctgcctcgtcattaatgtgtcttattttccactatgtagttattctctgtggaaagtaatattgaaaggatggatagaaaaaatataaaactgaaaaatgtagttcttctgagtatatagatccatacgtatatatacacacatatacatgtacacacatacacacatgtacattggattataaacacataaatatgatatatatatgagatattgtatacattagcctgtctatatgtataaacggcaaaactcgaagtttacatattttgtttagaatgtaataatatgtagctaattttaaaaatacctgtgtagttttatatataatagcattgaaataatataataaaatgcagcaccaatttcatagtatttatagtatgctacctaatcaaagaaaaaggaatttgtgatattcctaagagtttaatatgtaatgtttcatttttcaaaccacctaacataataaagagaaaatcatatgttagttcatatttaacagctgtagatcctcccaataatcttgcttttttctacagattgtcttggaatttcatgaggcagagaaacaaaactttgacagttatcatgtgatttttcccctgaaatatgccaccacatattaaaattgaggaatcatatttatcctatctgctgtagaggtgagcttctctgaccatagctctgaaaatcaccattactatcctttgtgaagaaccctgagagccagtcataaaagatataaatgatactgcatggcctgagagcccgatgctttgcagactcctggcattgtgtataagaaaagtgttccaataataaaatcatggcaatattactcctttctcacaacaatatttttagtagtaatctaggcaataaatgtaatagcaggtctaacaccactggcaatattaaattgaaatagcaaattgcaaagcgagtgaaattgttatcagagggattgatctagagtagaaccaatatttttagcttccaaataaatgttcagtaaaataatacttcactattgtgcaaacattataatagcgatttaccaaaaatatattactttaaaaaagtcatattctttcatagactggggcacaataaaaagaacgaaaatgaaaatacagttatttttacattccaatgagttttagtagttcacaatatattacttaactcatcctaaaaactagactctcaatttccaggaatgttgtgtttatttatattggagcccatacaaacgttagaccttagccagaaatgctgctgcttctctgtacaagcataaacagtcaataggtttggaaatgattcttaatatattaaaaactaaaactttatgttactgtatattaaaaaagaattaattactatataggttttactccttataggacatgaaaagcataacaaacagaaatctgtctcctatctatctatgtatcacctatctatctatcgtatatcaacatctgtcacatttcttgtgactttcaggagatgctacattttgctgcagtaacaaaacaccccttaggtgattaaaacaatttatttctttctcacatcacatgccttagtggatcagtgttgagctctgcaggatcttgaatcatggaggctctatattctaacttcatgccctggaacataaggccctcctggttttcacagcttgggaagagacagtaacatgtgtttttgttttgttttgttttactgcctcagcctgtaaatgatgccctttacttgtattcaccctttatttttcagaacttaacacgttgcaccatataacaacaagaaagctagaaaacaataaaagagtataatactttgtaggcattctgtttcaccatgatgatatcaaatattcctttcctctcattgttgcacataaagaacatactccacacttccctaggaaagatgacccaactgtaccataactgtatcaactgcaaaggccaagtttgttgagagatgtgggctagtatgttaatcaatttcagttatggctcccattggtctgcaagttgattagaatacaaagtttaaaagatgagttatttgcctccaataccaatattaatgttggaggaatagaataaccacaacaaacataaccctttgtaaaggacacaaatgggagatacgaagtcactattagtagccatcctgaaaccctatgtgacaggtacatgaaaagtaccttggaagtggatttaaccaaaatttgtaattaatttaacagtcaaaaacacttggaagtagttttactttctgggaggttctttttaatcatggccctttactaataaccccacttccagttattttgcagatatagttcctggatctgctacatttctttacctttttttcatctctgcttctcttaaacctgaagggacgggctacgttaaagctgtcaaggttttaaatgaagaccacacccttattgtgatcctttgcagaacatgtgtcccttaggctttctcattcttacttttgctgcttggggtcaagaagcagttagctcttttaactctggagaaatgaaatctctgactttgtttcatgtaccaaagagagctcatctgcttcttttaacacatggccaaacacagccattagtcatcaacccaaaacacaaaggctttgcttcttaacctctttctatggagctaaaattgcatggggcaaatggcctcccttgcaagtaattgcagatgactgtattaccacaggataacatgagctgacatatttttttgctacatctccaattgactactaggccaaaatcttcatggttttgtttgttggtttgtcatggaagcacccacttcttttttttttttttttttttttttttttttgagacagagtctcactctgtcacccaggctggagtgcagtggcgcggtctccactcactgcaaactctgcctcccagatttacgccattctcctgcctcagtctcctgagtagctgggactacaggcgcccattaccatgcctggataattttttttttttttttttttttgtatttttagtagagacggggtttcaccgtgttagccaggatggtctcgatctcctgaccttgtgatccacccgcctcggcctcccaaagtgctaggattacaggcgtgaggcaccacgcccggcccgggagcacctacttctagcacaatttctgtaatagtcaggaaagaaaaggttacgtagtgataacaaatctaaatgcattatttaaacaaataaggtaaaatagtttaccaaattattgaaaaaaagaaagagcatgtattgttagcaaactctacaatccgatatttacaataccaataccccataagctctaaaaacagaaccaaaatttataattaatttgacaatcaaggctaattttacctaagttctcttgggaataaatctttcctaatgcattatgatgcaatctcaaacaaattggaatgttatttcacacgcactgcagttggcccttcttaactgtgttccacaactgtggatttaaccagctacaggtggaaaatagaaaatttaaaaaatggttgcatctgtactgtacatgtacaaacttttttcttgtcattattcctatacaatagagtataacaattatttacatagcattaggttgtattaagtattataaataatctagagatgatttaaagcttataagaggatttgtgtcagatatatgcaaatattatgccattttatataagagacttaagcatccatgtattttggtacctttcagggtcctggaacccctggataccaagagactgtatttgtatcatattttcattctaaaagatgaaatattataaattatgtaacacatttttcccaagggttttgtacgtagtactatggacctataatttctaaatcgtgtagaaagataggatatcatagatgactgctttggtacacaatatgtttctctggatttattatatttatatttttaactcatctccctttcaatatatgttgatttttctttctgaatattagtttatgttgttattattgttagtgttataaacatttgcagtttaaatatacttaaccagtgcaattgtttttgtataagctggttgtaatgccacacacaaataaatgcacctttttgccagtcaaaacttcaatgttttattactgtataggatctagaagagtagagaaagctatctaagaaattaggtaaaaatgttgatgctaaaaacctgaatactggttctatgtatttattgtttgctgatgaagattaatcacatctcagagcatacatgactgttttgccagcagagtgatagaaattgaattccatttttcttacagcctctactcatcacttacataagtacctataaatatacaggcaaccactatagagatgaaaggaaacagacttgctaaaaaagaaatatttaaaaaattgggtgagttaaatgataaaacaatatctcagtaatgaaaaaagtcaagagaaattgaagaactataagggaggtaatgcatttaaattcagtaggttttattttatacagaattatttgaaatatttccatgaatgaaatttgattatcagcttggtagaaataacaatatattctaaactgagcagacatcagtagaattagataacgcctacctttctcctttcttttattacaatgtcagcataatatttaaaacgtctcagcaaactctttccttcataactttaataagtagatttgccaggtgcagcactagcaggaggcccttaatatatttaagttggaaaatgaggcaattatatttcaaagttctgattggctacattttaattttagaactatgagatgaactgatttagctagtggctttctggagaaatctcccacatctgcacctgttcattttattaaaatagaaacaccttgccaggggtgagaaaaagatattggtcacagaagcaatgacagcttggtccctctgcttttactattgattacatttcttgacagtcacatgggaagttaattactagtaggcaattaacactcttgaaaaataatgaagaaaacataattatattgagaaccccaaaagactgtttgtaatcttaaatgtgatattcccaagtctctttttatagttttgtcaaccgaggtcttgactttccattttttctacactgttttgtcaacccagtgtctgtccctaacaaaaagcagtaattattaatgctctattttattattttaaattattaaaatgaatactgaattttcagcagtctaattaaaattctccaaggagtctctcaatgaaaacaagataaaatttgctttgcatataaagtgaatagtctttccagtaaaatgcatctgctgtgggaaatagttaggacaatttatctactatcagcttgtgatctgttaaatttattttttcccctttctccattatggggtagtggctcaatgaacagactctcaagctgagccatttaggctttagtctctgcactatcactcagcaaccatctgaccttaaagatagttctttgtcctatctgtgacatagtttccttttctgtaaagtggaataatgttgggtttgtactactcattttactggaatgagttcacgtggtattcctggtaaataatgtgtcagccctccttttccctaatctttactgctgtggtgtcataagaagggttgatgccgtttgttttttcttctgcaaataacccaacatgcctttgacctggggacaggagaaaataattgttctgcacacaaaagggaaagagcacgtgcctgctgcctacttcaaaggatctaatgggcctaaatcctaatttcacctgtttggtatattaatgaactctctctaggaaccagataaccccatgtgtctcacattttacattacagtttcacaacctagaggtgtatccaaattcagaatctttattcctccttcaaatgtgcacttctatagatatagctgttactgtctttctggcactttggggtttaagcatgaaactgagtgtgagctacaactatgtggacttagtgtggtgaaaagaagttttagtatccttttagatcagaaaagttcattcccaatatagggaaaaaatgctgtagatataatacttatgatatatttttaggataataagtaagacgttttacaggaatatgaagaaattgagggaagctatgtactctcacaagtaataaagtagccacctaagaaggtttgtgatgtttaaatgaattgataaataaattgcttaacaagtcactcattattagctactcaaaattatagtaccaacaaattctaactccaatggatttttcaaagactttagaagtcagtgtgttagccatagtatttaaatattaaaaaaactttatataacacgtcattatttggtgctaagctgtctttatttaacattttattttaaaataacaacaattcctaggaagttacaaaaaaagtacagacataatcctctgtacctttcatccaggttctactaatgattgtattttacatcagtaaagcacaatatcagaaacaggaaattaataggcataatttatgtgtatagttatataccagtcaagatcagtactattctatcactacaaagatatgctcagttccacctctttgcagttacaacaatccctccacttccaactgtacctaacccctggcaaacactacccaatcgtttttatcttcataactttttaattttgaaagtgtaatacacatgaaatcagacaatacatggttttctctaattggcttttttctttacttatcataatgccctcacgatacatcaaagttattgtctgtaccagtatacattcaaaatgttcattcttgttattgatgaatataaatttatggtatgtgcaatacactttgtgtaataatttacataatgaggaacattttggttgtttctagtttttgactaccgtaaataaaataaaccatttccatttcatgtaattttagatatgttaaggcttgagtctgccattttatttttttctcttgtcattccttgtttttgctttccgttttctttttgtcctgcttttctatgcataaaattttcttaaaattttacttgatttacctgtagtattttagaatgtatccctttgtatgtatttgttttaaatggctgtttgaggttttacactatgcgtacaaaacttatcatggtggactagtgtaggtattttaccagtttgaataaattgtagaaaacttacctcccctttaagttcctttactctcattcatttataatgtaattaccttaaatattccctctacatgtattgaggatcattctagaccatattataatgttttctttggccaccaaacgtaatttagaaaacacaagatgaaaatgaaagttgattttatttacccatttttgtttttttaaccttctgttatttctttctgtttagggaactttgctagccattaatttagggaggtctttagtgacaaaattatcttagttttccttcattggaaacctactaaaatccattcaatttcagaagatttttgcttgatattgaatcatagttagcattttctattagcacttgaaaaatgtcacttccttctcatcctcatagtatttgatcaaaattattaaaattattttctacctataggtaaatgttggttctcccttgtttacaagatttattttctttgtattttcaaatattatactgttgtgtgtcttggtgtggatttctttgtgtttatcctatttaggattctttcaacttcataaactttaggtttatgtatttatttgccaaattttgaaaattctctgctattgtgtctttgactaatttttagcctcttcattttcctcttcttgcaggcttctgatgacaagaaagttggatcttttgttagagtactgcaggttccccaggctctatttattttctttcagaatattttctcactgctgttcagattgaataatttctattgttccaccttccagttaaatatttctttccttgtcttattaattcttctgttgagcttatcctttgttctgttttagttacaatttttacttttaccatctcaatttggcatttattttataacatgtatttctttgttgactgcttgattttaaaaaaattaaccttgtccacagcaggtatggcctttgtgttcagctcagcgaggtaatctctggcttgcatgatagtagtgtttttcctttgttggaagatttgagttattcaaaatagtctacagagttatttatgcaagaggctaggcacatcagataatatttagcatgaggaaaacccttaccagaaagacaaacaatgtgatgtagcgtgggagctttggttcacacagtatccattgacctggagactaagatcaatcatatggacagtaaaataatcaattacgcctttgtgagggatacacttcttcctttggctgactttaaaatgtatcaatttcttgtaattacttataactgtaagtgaaataaccttcagtgatgtctgtgggtccttcaagtaaattatcaaaattgaggggggttttggaaaactccttaagttgcagttggtgtcataaatgagcgtagaagtacactgtgagaactgttacctgtgacttagcaatcagtctaacttgtcacattgagactttgcattttttctttattttcaagcatgttcataattttcaaggaagcatgtttttgatggctctttttcaatctctgtcagataattctagcaactgtattaccttctcattggcatcttttgatgctcttttctcagttgagatgttttggtatttcatgtaagtaatttcaatttaattttaaattgaaatttgggaatttaaattttaagtttaaaaaaattaaatttgggaatttaaaattcccaaattttaggtattatttgggaactactaggtcttatttaaatgtgtttttgtaactcatgtctgactctgctcaaagggggaataaagataatgacagattaaaggcaggttagcattgaagttttaagttccaaatttgtcttccattgaaacacctggggaacagagcttctcattacagctgggaaggatgggtgttaggtcagttttcccatgaggtttttgctgataccatcctgataatgggggatggatgcctcattaatgctctgcagatatctccactgatactgctggggtttgagcttgtgagaaaagtcctgactttctgactttccagtagaagttctttgtcacagtgtagatggctgtaatcattaccactcggtggggatgaaagtccaggctccccacttggctttctatcataccaccacaatagggtggtttggagcacttcaggatagcctgataaaggcagaaacccagactccctacttgacctttaatgacaggagtaggttagggctgcagcattttatgtggtgtttggcaggagcaggacaattgttgtctatcttgctaggttgccactttcctgattctgtgcctagagagagcagacttttcttttgtctgttcccattggtattttcaagtttctggagcatgtaccatatatatagtgcatgatatatgaggcaaaaaatattttaaaaaagcaacaacaaagctccaaagaattgatagctgtatttcttctcatgtcctatagtccttctccagaatgtgaatgtctctgcacttcttaaagtctcatgttgatttttacatagattgtaatagtttttagctaaaattctttagtttaaggaggctgacaaggatatggagaaaagagaatgcttgtacactgttggtgggaatataaattagttcagccactgtggaaagccatctgaagatttctcaaagaacttaaaacagagctaccattccacccagcaatcccattattgtttatatacccaaaaggaaatagctcattataccaaaaagacacatgcactcatatgttcatcacaacacctttcacaatagctcagacatgcaatcaacctaagcgcccattaatgatggattagataaataaaatgtggtccaaataaatgatggtctactatacagccataaaaatagcaaaatcatttcctttacagcaatgtggatgcagctggaggccaataccctaagcaaattaacgcaaaaacagaaaaaaaatactttgtcttctcacgtatagacgtatagtgtgagctaaactttgggcactcatgtacataaacgtagcaaaaatagatagtgagtactactagaagtgggaaggagggagggagacaagatttggaaaactacctatcatatactatattcactacctgggtgatgggatcaatcataccctaacctcagcatcaagcaatacacccatgcaacaaacctgcacatgcactctcttaatctaaagtaaaagtagaaattattttttaaaaagaaaaaaaatgaaatccctaccatattccatacataaacataaactcaaagtggattaaagacttaagtcctgaagctttaaaactcttaaaagaagacagaggaagaacttcatgacatttgccttgccaattatttcgtagttatgacaccaaaagcttgggtaacaacaacaacataatgaacatgtaggactgcatcaaattaaacagcttttgcacagcaaaggaaataatcaacagactgaaaatgcaagccatagaatgggagaaaatatttgcaaatattttatatctgataatgggtttatttccaaaatcaataaggaactcatacaactcaatagtcaaaaaccaataatctaattgaaaaatggactcgaatagatatttctccaaagaagaaatacaaatgaccaacaggtttataaaaaatgctcaagtccctggtcatcagggaaatgcaaatcaaaaccacaatgagataacatttcacatctctcaggatagctattatcaaaaaagaaaacagaccaaaaaacaaagaacaagaagtcacaaacccacattttaagaataaattgaatctcttagatattatcatatttgtaaattatacataaatagaaaattggctaagctggcacagaaatctacccacttgactctaagaagttataattgcatagattacaaaggtgcaaaattagtagaaataatgtagacatccatgtctcctgcatgtatttctatcttgaatgtatataatgccatctactagattatagtactcaaatacaaatatttgatctaaaaatgtataatagctgaataaaacatctgcaggcaatagagttaccctatcagggatgtacaacgataaaataattatctagtctacaagcaaaaggaatagactttaaaaggatatttaaaagtacagttatttctttgtgttgggaatattcaatatcatccttctagctatttgaaactatatattactgaatgttcccaacaaaaaggaaagaggtttgtttgagataatgaatacgctaattactctgatctgacaccatacattatatttatgaaaatatccctgtgtatcccataaatatatacaattattgtttgtcaacttggtcatttatatatatattttttaaattaaagtaaaggctggtcacggtggctgaagcctgtaatctcagcacttttggaggccgagacgggtggattacctgaggtcaggagtttaacatcagcctggccaacatgctgaaaccccatctctactaaaaatacaaaaaaattagccagacatcgtggcaggtgtctgtaatcccagctacttggaaggctgaggcttgaacccagaaggcagaggttgcaatgagccgagatggcaccactgcactccagccagggcaacgagagtgaaactccatctcaaaacaaacatacaaaccaacaaacaaaaaagtaaaattagttcaggtatatttataaaacacctttttttgcctagatccaggaaataaaatatattgtggatttaaaatacgaaaataaaggccacatcttttcacaacagtgcatggtgaagtctgagtttgtgagccaaaaggtcaataaacataaaggttcttcttggtactttcacagtattcattcattctgtttcctttaccagacttagcctgagtgcctttccaaaacacaaaccctatttatttcacattttaatctttagcacctcacgtctcaataaataaaatggttaattaaactcagtttactcatttaaaaattcatgggcagaaactcacattatgttaggaatataacttctccaaattcagaagtggtgcttggtaaagtggtatggtaaatagaaaaaaaaaataactctttttaagaaaaatcatattctcccagtttcaagatttattgtgcctagggaaccaggattctatatttttaaaggacttcctagatgagtctggttaggtttggacactctgaaatagatctgtatcttccttttacaaataattaaccagtattaaactgtgtgatctagaataacagccagtgaaaacgcagagtttgtgttagaacttagattccaacattcttagggcaagggcttttcaaacccctgggtgaagtactattatatatgtatttggatttccctgatgatcagtgatgttgaccatttaattcatatgcctattggccattcataagtctttttttgagaaatgttcatttaggtccctttttcccaattttaaattggctaatttgttttattgctattaagttgtttgagttactgttatattttccatattgcctccttatcagatgtatagttggcaaatgtttctctcccattctactggttttcacttcattctatgatttgtttcctttaagtgcagaatatttttttatttttatgtaatcctattagtatacttttgcttttgttgcctgtgcttttgaagccataggcaaaaacccattgaccagaccaacatcatggaggtattttctgtgttttctcctattagtttcataatttgggtcttatatttaattatttaatctatttttacttgatttatgtatatggcgtgacaaaattttctaattttattcttttctgtacagatgttcagttttcccaacactatttattgaagactgtcttttctccattgtatgttcctggcatctttgccaaaaagtagttcactgtaaatgcatggatttatttcaggactttcttttctattcaattggtctatttccatgccagtgccatgttttttgtgtttttcttttttttctacagctttatagtgtattttgaggtcagatagtgtgatgtctccaggtttgttctatttgctcaggattgctttggctattcagaggcttttgcagtatcgttcaaatttcagtttttttttctattttttttgaaaaatcttattgatattttgataagaattggatttaatctatagattgttttgggtagtatggacattttaacaatattaagtattccaactcatgaacacagggtatttttttatttatttctgtctttctcaatttcttttatcagtgttttatagtttcattgtagagatattacacattgttggataaatttattcttaaacatttttgtacctattgtaaatgtgatttttaaaatttcttttttagagaattaactgttattgaatagaaatgctactgatttctgaaggttgattttgtatcctgcaacttaatcttttgtttattattcctaacatttatttggtagagtccttaggattttctgtacatagatcatgttgtctgcaaatagggacaatttcacatattcctttataatttggataccttttatttatttctcttgtttaattgctcttgctaagatctccagtaatacgctgaatggaagttgcaagagtctttttgtctttttcttggttttagagtaaaatctttcaatttttccccatggaatacaaggctagctgtgggattgtcatatatagcctttatttcactaaggtaacttcttctataccttattagttgagagctgagagaagatgtgaaatttgtcaaatgcaccttctgcatctattgaaaacatcatttttttttcttttctgttcagctaatgtattgtatcacatttattgctttgtattgtttggattatctcatatccctgggataaatcccacttaatcatggtgaatgatgatcttattaatgtgctgtcatgtttggcttgctggtatcttttttttttttcacatggtggagtcttgctcttgttgcccaggctggagtgcaatggcacgatctcggctcactgcaacctctgcctcctgggttcaagcgattctcctgtctcagcctcctgagtagctccaattacaggagcttcccacaatgccaggccaatttttgtatttttagtggagatgggggtctcaccttattggccagactggtctcgaactcctgacctcatgatctgcctgcctcgacctcccaaagtgctgggattacaggcgtgagctggtatcttgttgagaatgtttgcatctgttttcatcagaaatactggcctataattttgttttccttagtgtctttacctggatttgctataaggatgatgctggccttgttaagtgtgattggaattattctctattctttaatttttgggacctgtttgagaagaatttgtattaattgttctttaaaagtttgacagtacttaacagtgaaaccatcaggtttagggcttttcttggacaggagactttttatttttgattcaatttccttacttatttgtctgttcagattttctatttgttcattattcagtcttagtaggtctaatgtataaatgatttgaacattttctcttttgatgctgtttcaaaaattatgtaagctttcttcatcccttctattattttttctttttctcctcttactatatattttcaaataaagtgtgattaaatttacaattttttctgcctgttcaattctgctgttgatactttttttcacattttcattgtgttaattgtattttttcagtttcaacatttatgtttaactttgtttttaatttaaatctattaaatttctcattctactcactttttttaatttttcccattgattttttttatctagattctcttaaaattcactgatcttgcttaaaagagttattttgaattctttatcagacaatttataattaccatttctttaggccatattattttgtccatttcatgatgtcatgtttccctggatattcttgatccttgcggttgtttgtcaatgtttgtgttattgtaagatacaggtacttagactttatagactagctttttctagaaaagccctgcatttatttcagtactggggcacataagaagccaaatgcatcgcagtcagtgtggcactgccaaaagtctgggatacattacaacagttgtggcactgaggagagccagaagcttagggacattgagttctgtctgtgctgaaggctgcctgggaccttgggcgaatgatattagttggtgatgatgaaggctggagactgaattcaccaagcaagccttcatcctgggattatttggtctttcctggcaccagggagggcgcagaaacttagtttacagttactggcttggaatagggggctatcaggtttttgcaaatgctgggctttactttggcaggccagcatttgggttcaatgcaaagtcctatgctcatttcccttctcttttccccaagcagacagcctcccgtttcacacaggactgcttggttttggaggaagggtgatgtgggtaatgtgaaagtgttctttttcccatcttaaatgcatattttcttaatactttcctacaaccaggtactatgatctctcatttggttttcttagtcttcttaaaggtacatttgtgcatgagtagttgttcaaactgatgtttctgcagggtacaatcacttgacagtcctactctgccaccttgctctgctccctctgtgaagtcttgataatacaaaaaaatactctcctcaccaataactacatatttctactgtagagcatactgattcttgcctatcagaattcagaatatcatgttaatcaggaaaataaagtaaattataagacatagggaaaatcaaagtgtttttttttgaaataaaatacttactgtattggggtctctaagattaaaaacaccctcaacagttaactttgtgtttaatattacatacctatatatttataaaattacttggtcatcatcaaattccactaaaatatattttttctttccacaaatttattcacttcaccaaatagaataggatggtatgtcacaatcttttacatatcaacttcagtgaaaaatgatttttaaatgcaaatagcagatattataggcattatgaactagtgatctgtaagcaaagcgataatgaggatagttttatggtcaattgcattggaaatcagagctaaagcatttaactgcatttataaagcagacacactagtttctaagaggcaacctccctcacttgacagataaaacttaacaatcatcaatcattcagtttcaacaagaaaaatagttttctataacaatgattctcttctcagacttaggtacatattaacattacctggagactttaaaaaccccatttccaggtttcatcctatacaaattaaatttagagctataatacaggcattttttttattgcttctaaaggaaaaaaatggatacatgtgtataacgtgcaggtttgttacacaggtatacgtgtgccatggtagtttgctgcacctattgacccatcctctaagctccctcccctcacctccacccctcaacaggccccagtgtgtgttgttccactctctgtgtctatgaggtctcaattttcaactcccacttatgagtgcgaacaagtggtgtttgattttctgttcttatgttagtttgctgaggatgatggcctccagcttcatccatgtcactgcaaaggacatgatctcattcctttttatgactgcatagtattccatggtgtatatgtgccacatttttttttatccagtctgtcactgatgggcatttgggttggttccatgtccttgctattgtaaatagtgctgcaataaacgtatgtgtgcctgtgtttttaataatctcaatgagttgcaaatgaagtaaagtttgagaaccagtgtcctaaggcataatttgcattgaaatcttacatattcttataagcatttatgtttcggaaaaaatatagttttcaacattgctccccaatttaaaatcaatttttacattcttgttactgcattaagggaataaaacaggtttaaaaatagaagtataacatataattaatatgttagttaaatcaaatgatatacttaatgtttatacatttcaagatttaaaaaaaaatctgtccttgctgaaattgacttattatttcactaatttagctacaaacaactgctattgcaaacatgctctgaagttgagttccaaaaatacgggctctgaatgcttttacaatctgatctgctgtccaatacttcacagggcatatttataaacaaagtagatagcaaataagcagtttatctctttgcttttaaaaaaggcttaagcatgttaaaaaatattttaaagtgaatttgaagtaaaaataatctttaaagtcctaagcttcatgtttgatttcaaatgataattttagatcaaatcaatcttgtactctttaaaacaaacctatacagtgttgattagtgtactgaatcactaaggaacattaaaaatgctattagtaaaacaagaaacattaaactggtgttctttaaataaaatgtaatcgaaaaaattaaataattcttcatttgttatatgttccatgaaccagcatgtgccaacatgtcctgtttgatattagtttagttttttttttcaaggaagcctgctctttagatttgcaattggcataagcataataaagtctcccaaaatgaaaactttcagtaaagataactattacctatgcaagaagttctctatgaccctcaaaaacactgatccaaggtgaagaaaagggtgaaatgaaattagcagtgtattttctagatgcaagaaaaaaatattaaactgtgacaacaggataaatacatagtaataaataaagagatagagatttgtttctgcaaaccaggctcaataaaactggttgggctttgattcacatgaggaagaactgatgtaactgaattacaacagccaaaagccgagattggaaatattcggggtaataatgtattgtttaatttgttgttttatgttttgcttaaacttttatatttttattttcatttggtgagtgatatagtaaactttatgcccctcaaaacatgtctgccttatgcagaagtcagttgtgcaatatttgtacagaaagtaaagatgaatgactccaaggcaatccaaatgttcttattgttaatttgatttatttttaaattattttagatttgtgaattccttactctttctgaaaatcctgagtggaatggtttatgagtggcactgaatgacttaatgggcttccttagaagaaactatcaatatggaggaagaaatgaggaggtgtttgtgatattaaaaaaaaatagtcatacaaagtagtaaattgacaaagaacaagatgatgttttagaagagatgagaggtaatgtgtgaagcccaagcaggaatttctgcaattcagttttgtgaaagataaagaaactgatttggtctgttgtgaaagtatacgtaatttttttactctctcaagtattcaactgctaagagcttttaagagccatgagtataaagagagttatcagttttatttactattttggtgattgtggtaggctgaaaaatgcccctccccaaaaaatacatgtactaatccctggaacttgcaaatgttaacttaattagcaaacacatctttacagatgtgattaagttaaggatctcaacattgacttagaagccttactcttcccctcagcttgactaaactttagacagatttatgaatgattataaactcctgacctccctttaattagagcctttactttagaaaactttcaactgtaaactctttccctgttcctttgagatgcaaatctactcccagactctggacagttttataatcagaaacgtttttctcaagggccagggagccatctctttaaaatgtaatcgtaaaaaatatagggctcctatctcccagggtaagagccaatcttctgtgggtaacaagaagcaaacacagatggcctaataacactaaccaactttcccctaaattatcctccggtattttccactaactcaccccaccttttgtttaaatgacttgaggtaaatctctcctccctattgcaatagtcttaaataaagctttccttgtctaagttgttcaaagcaatttttttccttgacaacatggagtgattaacctgaattatccagatgttccctgaaggctatgaaaagtaatcttataacagggagtccatggagaagtacatgcagagaaaaggaagacgcaacatgaccccaaaggcagggattgctgtaagcataatcacagaatgcagaaagccaccaaaagctggaagaagcaagaaagtattctcctgtagaacaaagtgacagtgctcctgctgacaccttgattttggacctctggcccccagaattgtgaaaaaatattttttttcaagcaaccaactttgtgacaatttttataacagccctaggacacatagactgatcagaaaacatttttatttgagtgcatcatcttaatattataatagaaaaactactgtgaaaatattaattccatttgaaactttctatattgagatcactgtttgattagggcagtatcataagagtaccatatgttgaaaactacactttgttttcaaaacgaaaagcagtagtgaataaaaccaatcgtactattttgttttagcaagaaacctgattttttttcctatttactattgttaaaatgatagaattgggataagccacttgagcacctgtttttaagaagaatgctgtttatgtagattaattcaactgaagccctggagatactaatgaaatttaccaatttagaatgagcagcttcagtatggatttttaataagaaagcagctgctcatctagaagtagtagtagctaacgtctgaaggccatgagatttgtctgttctggaagatatgataagcaaggaacagatggttagcataaataattcaaaagagctctccagtcacttgttttgggaaaaacaatatgttaaactatgtttacaaggttacttggaactttagaaaaaagaattatttccttttcatgctttctttcaacatgaagtttaaaaaaaaattataagcatttaagggttagtcctctaaaatcaatacggcctatgatatcgaatgcatcacataagagcattagatgtattttatatatgcaatcacaagtaaatatatctatgccatcagtgtaaatgtggttaaggctaaattgatgttgacttatgtatagttttggttacatctataaagtaagaccaatttttataattaaaaagattacatctataaaataagaccaatttttataatttaaaagattacatctataaaataagaccgatttttataattaaaaagagtttgctagtacttttgtacatagtttgtcttatttgactttattttacagattaaaaatctgaaggcactcccttggtgaagaaaatgtaatcctagccctgcagttttgtaatcttaataggtaccttaattttatagcaaactttttatatatcccttgctaaataatcttatttttttactctacctaaaaaagatttaacattgacacatttattcacttttccttcaaattttcctatgtattatacgtatgaagaattccttttcttgtctctcatagaaaggtacatacatacctatgcctaatttcgtccagagctgtaagcttttctaatgtgatctaaattggctttatcttaactaattaacattctcttcttcatttttttcttcctctcagtgggaaaatatgattagcaacttgctaattaaataatttttactgaactctgtattttcttcaagtcaccattctaaatttataactatatccataattggagttcttgaaaaaaaagcttgttatctccactttctttccactcaattattcaattattcttaaactcatgttcagctacacattatcaaaaacctcatatttggcacaccttctcagtccaaaatattacatgtaagataactgttggcagttgttcaaatgttgtaagcatgagctttttgagctagattgtatagaagctgtcctattttctgtggtgattctcatgtaacattttcaaaaccaagatttataagtgttacagtttctatcactataaagcagacattgccatcaatcactaatatattatcccaaccctggcttccaggtctcagttatgcttctttgtacattagatttagttcctttaggactgctacaattccactcacctaccaatagcaccctgccttctgcatttggagtacaatcattagtcagctgtggcagatagatttagacttcttgggtgctataaatcaaatagtcaaattgcttgttcaacaccagataatggttctgctaatgtgacatttactatcttcctggacatttcaaatgtgctttgatatggccttagatctgtagtatacatttttcctccaaaaaacatttaaacatgtgtttgcattccaaagtaaacagttataataacagtttcctcagccagaaatccaagagagaagcacatatctaggcgttaataatgagacattaaaataaagcaatgggtaaacataatcaggaactcaggtactttggtcattattgctgcctgtttccacagtggttggccacattaactgataggtttttttttgtttgtttctgttctgaatatatgtaactcttaagaaaattttcatgaaaaattaccctttgtgttttagaaacaataatttaatttgagccactgtttttctgagatccatgtttgtctcatttaataagggtcatctatgagtggagtccagatagtcactgagaaactttcatgggtacatttaacattgatatttctccttcaaaccaaccaaataagggtagacttgaaataagctcatcgttattataaataataaattatttataatataataaaatacataataaattatatattattgttttagtctgttctcatgccactaataaagtcataggagcgacctggcaatttataaagaatggagatttaatggactcacagttccacattgtgaggctggggaggcctcacaatcatggcggaaaacaaaggagaagcaaaggtgcattttaaatggtggcaggcaagagagcttgtgtaggagaactcccctttataaaaccatcagatctgatgagattcaattacctcccattgggtccctcccatgacatgtggggattataggagctacaattcaagatgagatttggaaagagacagagccaaaccataccatttcagcacctggcccctaccaaatttcatgtccttacatttcaaagccaatcatgccttcccaagagttcctcaaagtcataactaatttcagcatgaactcaaaagtccatagtccaaagtctcacctgaagcaaggcaattcccttccatctatgaggctgtaaaatcaaaagcaagttagttacttcttagatacaatgggggtacaggcattgggtaaatacagccattccaaatcggggaaattggccaaaacgaaggggcaacaggccccatgcaatctagacttcaggagggcagtcaaaacatacagctccaaaatgatctcttttggctccatgtctcacatccaggtcacacttatgcaagaggtgggctcccatagccttgggcagctccacctctgtggctttgcagggtacagccctccttctggctgatttcacagctggcattaagtgtctgtggcttttccatgtgcagagggcaagctgttggtgggtctaccattctggggtctggaggactgtatcccttttctcacagattcactaggcagttttccagtagggactctgtgtgggagctcccaccccacatttcccttccacactgccttaacagagggtccccataatggctccatccctgcagcatacctctaacctggacatccaggcatttccatacatcctctgaaatctagacagaggttcccaaacctcagttcttgactctgtgaacccacaggcccaacaccacctgtaagctgccaaggcttgaagctaccaaccctctgaagggtgcaaacagtctgagctgtatgttggccccttttgctatgtctgtgacataaggaaccaagtctcaagactgcacaaagtggcaaggccctggacccagcccagaaaatcatttttttctcctaggcctataggcctgtgataggagagactgctgtgaaaaacctctgacatgccctggagacattttcctcattgtcttggcaattaacatttggctctttgtaacttacacaaatttctgcagccatcttgaatttctcctcagaagatgggtattttcttttctactgcatcatcaggctgcaaattttctgaacttttatgctctgctttcccttttaaatataagttccaattccaaccatatatttgtgaatatatacataaaacggaatgattttaacagcacccaaatcacctcttgaatactgtgctgtttaaaaacacaccagatgtgtttcttgcaccagatgccctaaatcatctctgtcaagttcaaagtttcacaaatctctagggcaggagcaaaatgctgccagtctctttgcaaggatttatcaagagtcacctttgctcaagttcccaacaagagcctcatctccatctgagaccacctcagtctcgatattattgttcatatcactatcaacattttggtaaaaacaaaatcaacaagtctctaagaagttccaaactttcctataccttcctgtcttttgatccctccaaactcttccaacttctccctgttaaccagttccaaagtcacttccacattttttgatatcttaacagcagcaccctactcttagcaccaatttactgtgttactctgttaccacactgctaataaagacatactagagacaggataatgtataaaggaaaggggcttgatggattcacagttccacatgcctggggaggcctcacaatcatggcagaagtcaaagaagcaaagacacatcttacatgatggcaggcaagagagcttgtgtaggggaactcccctttgtgaaacaatcagatctcatgagacttattcatgatcatgagaacagcacaggaaacacccatttccatcattcaattacctcccactgggtccctcccatgacttgtggggattataggagctaaaatttaagataagatttgcgtaaggacagagctaaaccatatgaattatcaaacacatatctctttgccctggttgtataaccattttattctctcattccatttttcctggaggtacaatgaatttgataataattctgaaatattacttcatccaccacaaaatctgaatctaaggaagaggagaaacaaatgtccaacgtttgatagaccagaacattttacctccaacctcaaccctttggctctaatggttagtttagtattatgcagatacccaaaccagagcaataaggctccaaactatttatttttctgtaatatttggaaacaaaacaaaaccaaaaccaaaacattttcttgtgtagtctaaggttattggatacaattctgatgatgccaaaagccatctttgtcacaagttaggagaaaattagccaagatagaagtcaaaacaaagaaaagttacaataattaaagtgacacattcctaacaattgcaatctgctattcttgtcaaggcataggaaaaaaaaaaaaacaaaaacaaaaacaaacaaaaaaaaaacctaaccatttttcttttttctagggaaaattatacttcattaagtataaaacttaaaatggcaaaaaacaaaaataacaaaatataaaatattcaccttgtctatgtgacaactacctgaattgccagactcattttctaccatttttccctcttagtttatgatactgcagtcctggtaatgacaggagctggcctcactattgcctaattattctcctagatgtagttcaagtgttgaccttttcagaagcttttccttattgtttctcatcgatacaccaagctttgtttcccttctttgtaacagtaccactcagagtctacctgtgccttatttatattggaatttgtttggaaagacagattttgagttcttcaaggacacgatcttgatcattttataactcttatggctactagcacctcttcctcaataaatagctaaatttgtgaattatgccaaagtctattgtcttatgcctggctatgaaaactattattagctccatcttgagataattttagacttcagatgaatttagaatttgaatgggaatagaacatatagaacatgaaccaatagatcttagagaccatatattattctctattcacagaaagcagactacacaaatggatgactggtgtcaaagaacctcactaggaacatagaatttcatataacctttatttttatatatgagacttaggaaattaaacatatcagcttagccacagatataactcccaaatcctaaatacacattttgttcaattagtcatgtgatgatggaagatgataggatttgactctatgtccccacccaaatctcatcttgtggctcccataattcctacatgttgtgggaggggcccggtaggagatgattgaatcatggggcagatctttcccatgctgttcccaggatagtggatggtttcatgagatatcatggttataaaaaacaggagtatctcagcacaagctctttttttgcctgccgccatccacataagatgtgacttgttctgccatgattgtgaggcctcccaacccaggtggacttataagtccaattaaaagcctctttcttttgtaaatttcccaatcttgagtatgtctttatcagcagcatgaaaacggagtaaaacagtaaattggtaccagtagagtggggtgttgctgaaaagatacccaaaaatggggaagcaactttggaactgggtaacaggcataggttggaacagtttggagggctcagaaaaagacagaaaaaatgtgggaaagtttggaacttcctagaaacttgttgaatggctttgacaaaaatgctgatagtgatatgaacaataagctgaggtggtctcagatgaagatgaggaacttgttgacaattggagcaaaggcaggttttgttatgttttagcaaaaagactactggcattttgcccctgccctagagattttgaaactttgagctcgagagagatgatttaaagtatctggcagaagaaattcctaagcagcacagcatttaagaggtgatttgagtactgttaaaggcattcaattttatcaggaaaggagagcataaaaatttggaaaatttgctgcctgacaatacgatagaaaagaaaatcccattttagttgaagaaattcaagctggctgcataatttgcataagtaacatggaaccaaatgttaatcaccaagaaaatagggaaaatgtctccagggcatgacacaggactttatggcagcctctcctattgcagtcccagaaacctaggagaaaactgtggttccatgggctgggcccaaggtcacatgctgtgtgtagcctagggacttggtgtcctgcatcccagctgctccagccatggttgaaatagaccaacatagaattcggaacgtggcttcaaaaggtgcaagccttaatcaagccttgccagctttcccatggttttcggcctgtgaatgcacggaagtcaagaattggggtttgggaacctctgcctagatttcagaatacacatggaaatgcctggatgtccaggcagaagtttgttgcaggggtgaggccctcatggagagcctatgctagggcagtgcagaagggaaatgtggcgtcagaggatcaccacaaagtccctactgaggcatcacctagtggagctgtgagaagagggccaccaccctccagaccctagaatggtacatccactgacagcttgcaccatatgcctggaaaagtagcagatactcaatgccagcccatgaagacaggtgggagggagactgtactcttcaaagccacagtgaagagctgcccaagaccatgcaaaccttcctcttgtatcagcatgatctggatgtgagacatgaagtcaaaggagatcattctggagctttaagatttgacttccccactggatttcagacttgcatgaggcctgtagctactttgttttggccagtttctcccatttggaatggctgtatttatgcaatatctgtacccccattgtatctaggaaataactaacttgcttttgatttcacaggatcataggcagaagggtcttgccttgtcttgaatgagacttcgtattgtggacttttgagttaatactgaaatgagttggtactttacaggactgttgggaaggcatgattggttttaaaatgtgaagatacacgatttgggaggggcaagaggtggaatgatatgggttggctctatgtccccacccaaatctcatattgtagctcccataattcctacatgctgtgggagggacctcatgggggatgattgaatcattgggacaggtctttcccatgctattgtgatagtgaatgggtctcatgagatctgatggttttaaaaaatgggagtttgtctgaaaaaagtctagttttgcctgtcatcatccatataagatgttacttgctcctccttgccttccgccatgattgtgaggcctccccagccatgtagaactgtaagtccaattaaacctctcttttgtaaatagcccatttcaggtaagtctttatcagcagcatgaaaatggcctaatacagaagattagttaaccatgagggtcatttgcccagcacagagtaccaaatacagaatgcatgaacagatcccctatacttgagctccatttaggttattgtaataataaacatggcctaggaagctgtcatttttacaaatgggcttaatccatggaaaatgtattaccattttgacttgcattcaattttcttcaattctgtaccaagatgatttctgtaaaattctattagttaaagttatgtattactctctttcacaaagagtaagtaagacacatagattttattgttaatatgaagtgtagttataacttccatattatatgacaacatagtactttaaaggctttataattcattgagaacaatctatatttattcacaaatggattgggtttttaaaacatatgcctctaaaggaccatgagatgcagttgggatgaaaagagaacaaaatatttttaaaagaggcacattgcaaaagtacttatcaaatatatatatgtatgtgtgtgtgtatatatatatatatatgtatgtgtgtgtgtatatatatatgtgtgtgtgtgtgtgtgtatatatatatatacatatatcttacaactccaattgactggatgtctctatagccctctatgctcctgggaaggtttttcacataccttctagaatgttatcatcaaagttgtttcaaaattttaaaatgctggaaagttcaaacattgttttaaagattgttgaacagatgtagtttcccctaggagatttccctaatagtaaataccttctgagaacttcaaaatataagtgtgcattttagcagaaagcaagatatcactaaagaaaatatatatatatatatatatatatatatatatatatatatatatatatatatatatatatatataaatgaaaacaaagggcacgttggcattttatctattgtgttattattgcatcttttgaaatgtatttcaaactgaaataatgataaacatctatcacaaatgaaagaacacccaatcagaaagaccatatatattgtagattggaatttgttacaaatattggccttgaggatatttacagttgtaaatttcattatatgataccaattcttctaaaaattaagctattaaaacatttgggcatatagatatttcagattttgtattgatttcaaataaaaggcaaagtaatgatgaccaatttttcttgaataagagctggttaaattttgccttgatgaaagagaccttatcaagacttacccactccagaaaaactttgtaaaataaataagacctgagctgattttcatctttctgtagatagttggttatacctggagtgtctgtaaactttaagaagtaactttaagaggaaaccttaagaagaaaatggaacatagagttgatagaaaaacgcagaaatattaaattataaaatggaaagaaaggattaataataaaaaatatttattttggtagaaataagactatagaaataaattgactcattcaaatatattaaaaactagatggaaaaactaggattcattatgtgtagcttcagaggttaaagccgacatgagtggatggaaacctaggagatatatattggtagcaattaagaaaaaaaaagtaatactacctaaaaattgaatgtcctgccttcagaaaacatgaataatctgatcaccagagtagctcatccatcaatgcttcaagtattatacaggaggaattcaaatatcagatggataggtcagactatagaatctctaatatattttctaacattaaatattgtgatactatgagaggatttcagagtctcaaataataattgtaacgatgtttgagaactatcattacaagttaaatataaaatggttcaatatagttgttttcttaaatactgagatcagctgaacttagtgaatcaaaattttcctaggaaatgtgatagatttaatgaatatttatccattattggttccttctttgttatgcttccaaatagaagaagaataaatttcctctctattgaattttggattcaacatatcatttcctttggcaaaaaaaaaaaaaaatcagcccggacgatgtatgtaacttctgagcagaatcttcacaagccagtatgcagttgatatggttctcttttccacctgccacacatggaaatattcccatgttcaagtgagagtttgttctgtcagtcttggtctcagatgggtaggaggcagacaccagttgatctgcaacatccatgtactatagaggatgaataaactttccgtgttttaaaactcatgatctcctgaggtcattagatgtatgcaacttctgagcagaatcttcgcaagccagtaagcggttgatatggttctcttttctacccgccacacatggaaatattgccatgttcaaatgagagtttgttctgtcagccttgatctcagatgggtaggaggcagacaacagttgatctgcaacatccatgtactatagaggatgaataagctttccatgttttaaaactcatgatctcctgaggtcattagttatctaacctgctctaatatgggagttgggcaaaaggtgcattaattgagtaaattctgtccattaagcaggtcagaagcagactacactcatcattagagaaaagaaatgattgggccagaactggagtgttggttacttatgactctaagaaaatgtgtaagaaaatttcagattcatgtttactatacttccaaatatgtttagggccaggcctacactcagaagaaggtacaagaaaatgatacaaaaggccaagaaaataatacaaagatagtccttttcttcattatctccctttaactctcaaacattttgcttccttaccctctgtttccaaacccgtaacaaagataaaccccataatagaggtaccatgggcctctattatgagtcacacatgctttaagaacaaataagacaggaatgttatgagagtttatttttttttcccaaaggaaaactttatgttatgacaaattacaattagataatcacctcgtgcagaacaagagactggggaatgttaccaggcttaaaaaagaaatcctactatattgctgcttaggtggaaatcttacctatggtctagagccaaactatccattgtttaaaagacacttgccagtacaccgttgccaaattaaggttaacttggggttcactgctttactacatgacttaaatgtaacaacacagacttcatggcatattagtttaggtatatgaaggaagaggaagagaggtgaatataaattgttaaaataaacatggaactcttgagattccaaggaaatgcttgagtagtttatgacaggtttctatttgtcctattctgctaaataaataaataaataaataaatgtcaatgagcagtaaggaaaaacttaatctataatacattgaggatctgcaaaaagctcaaggtgtgtgacaatggtagaaatataaatataaatttcaagacatttttaagaagtaaagtgcagcattaagttagaaaaaaaacgtgtatgtgtatgataaaaaaagagggactcttactaagagcagtcttcatgaaaaaatacttaagaattgttcctcacaactcgatattaatgaacagtgtgagattcttgccagaaagttagaggaatcttagtttgcattgtgctcagaataaaggatgtaaaattaatgaataaaaccatatctgttaatacggctttttgttcagttctgaattccaatgacaaattgagattattcctagaagatgaaaaatggttaagggtttagaaattttgtgaaataaagagtcatcttttcatttctaagatatttatttacaatctaagaaaatgagaatattaaatttacagaaataaaaaagcaaagaagatatgatagttgtaggcaaatacctgaaggctgacctagtagaggcagtaggcctccagagagaaagaataaatatttcagcacaagacaatatcatgtttgggttttttttttgttttgttttgtttttttgtttttttttttcagaaaagtggaaaataaaaaaaaattcaaaataagtaagagtgatgttaatattagagatgttatttcttacactcttcaactttgtgatacactgagctcctagtcactggaaacagaaattaaataatcaatactaaattgtataaaggagaggattcttcatcaggtacaacatttgacaagcttaccgctaaattgtctgtctgtcagttttaacaattgaggcaagacttcatgcttcaatagtgtttggggaaatttatcttgttattctctgtgttaacttgcatagccagtgcgacaaatttggtcaacctttctagcctgatgcttgttcagagttcacacaacacaactacctgacaacctgacataacaccacacgtttgttttgctgccaattaactccgagatctttacactagcactttgtcaattccttaaatgaagtactgatttttgccaacagcagggttattttttctttaaagctggctgttaagatcatactagcaacataacaaaaattaaatgagactctcagtgacaggccatttagcctcatgtcagttgctatgtgcatgctatataggtgtcactagaagagaatggagaaggtcgaaaggacattgttcaaacaaaaagaaatatatattttacaaacagatttaataattgctatgagtcatgtggctacacttcacaaagtttccatttacaaatgcatataaaatattgaattacataatgataatgaacaaattgatttttagaagagatacagacatgttattgttaaaattagtattacagcctagattatgatccttaaaagtaactcacagccttgataagaagttgatagcaaatattaaccgtgactgaaggcatcttgtatagagttgaactcgctctaggtaaaatgtgtaatacatattgtgtaatacatattgggttgtttgcttgtttgagacagggtctcgctgtgtcacccaagctggagtgcagctcactgcaacctccgcctcctgggctcaagggatattcacaccttagccttccaagtagctaggactacaggtaagcactactacacctggttaatttttttttttattttttttatttttgtaaaggctaggggactcactatgtttccctggtcttgaactcctggactcaagctatccacccaacacggctgcccaaagtgctggcattacaggtgtgagccactgtgcccggccctgtaatacatactcttatatcatgtgtttttgtgcactgcctacatatatttatttttatcatgaggcattaatgataacctctggatcagaacatgccactacttaatgcatgcagagatattaagagatataaaaagcaggtaagggttttccttatgtaataatagcactttattaaagaggtccacatggtgtgagaaccatgtactttatttatttatttgtttgtttatttatttatttattttttgagacagtctcttgctctgtcacccaggttgaagtgctgtggcaaaatcgcagctcactgcaacaacctctgtctcccggttcaagcgtttcttgatcctcagcttccctagaagctgttactacaggcacacaccaccatgcccagctaatttttgtatttttagtagagacgggatttcaccatgtggcccaggctggactctaactcctggactcaattgatctgaccgccttggcctctcaatgtgctggaattacaggcatgagccaccatgcccaatcagaaccacctacttttgtatgagctcaaatcctggctttattacttaatatatctattgtacaagtcacttaacatgtgttagccctagctttcttatctttaaagtaaaaaaaaatacaatcataacattaacactttgaaggattactttaaagtataaatggggtaatgcctaaaatgtcctttaaacttgatccattataagtggttcattacagtttcattaaactccttatattatgcaattggaaaatacagtaaatatttactatgatttttttgtagaaaatcaaacttaaattttcataatgttactgttttactgaataaataaattataatcaccaatctgttttactcacagtgaaagagaaagcttaatcttcttatacataattcagtatagactagttttgccaaagtaacaaacacaaccaaagtgttttctgatttcaaccacaactaaaaagttctaggtttcaactcacattatttatctacctaaggttggctgagtggctctgctttcctttgtcctatctcagtaacacaaacagtgagttttcaacatctagaacatcatcagttgctttggctgaggaagtacaccaagcatatcatgcctgccaggttcataaagccttcctctagacagtgatacatacagttttttctcaagcttcctttatcaaaacaagtcacatggccatacctaacttcaaatgtgctggaaggtcgactttcttatgtgtctgtaagaatgagaaccagtaatatttgctgaagagcatgagtgacaactttgtattatgtatcaatttcatttgacgttcataaaatatttgctcagtactttaaatctttaaatatctgctttgagagatctgataatcaaatagaaaatatttcacataatatatcttgactttgaattaatttctaatggtctaaaatccaaaagttcagtcatgcatccaaaactttaggtccaaattctatagattgctgtctttatttttcagtgcaataattggcaaagcagtttatataaattacacattaattctgcacctataagaatagtccacttgtatgctttagtagaaaaatgaagtttgaaaaatagtacatttctttgaaaatgaatgtgtacttggtactttaactacttgttagtttgtcattataaggtagtattgcttaaaagttaaatttatatacacatggaagaagtaatacacaaactactgggtatacaacattagaggattttaacaaagtctatgtgaccattatgaggttactgtaaaaggtatgaatgtactcagtattgataacccttgtcatggcttctaagagtttgtgtttgatgtgaataagtatttttatcaaaattatccaaatagtaatataaagtatacacaatttagtgaagtcatcacatatatttttgtaaaactgacaatagagtatcaagtaaaaattctctgaatatattgtattatttattgatatctcttcactatagcatgtgtatgaaaaaagcaaacaaaaaagttatcaaagtcactttttgttttgattttatgatgctgaatcaaagactttaatgtttttcagattaaactgaatctttgagtgaattatgagttcaaataaatacaaactatattagacaaacaggcacatttataatgaaaacaatcctttacaataaataaattgaaaccaatagaaaaagcatttgtgtgttccggtataaatatatattctatcatcttattatgaagactatggcagggcagtcattcatgctcttcttcatacctgaatgacaaagaataatacaaaacaaaagctctcaaaatacctgtataaaaatttaaaataacaatgagttagtgtgatggttaatactgattgtcaacttgattggcaaagtattgttcctgggtatgtctgtgagagtgttgccaaaggggattatcatttgagtcagcggactgggagaggcagacccaccctcaatctgggtgggcaccatctaattagctgccctgcatggctagaataaagcaggcagaagaatgcggaaggactacgcttgttgagtcttccagcctccatctttctcctgtgccgggtgctttctgccctcgaatattagactccaagttcttcagcttttggactcttggatttataccagtgatttgccaggggctctcgggcctttggccacactgaaggctacactgtcagcttccctacttttgaggtttttggactcggactgacccaccactgcttttctagctcctcgacttgcagacggcctattgtgggactttaccttgtgctcatgtgagtcaattctcctcaaaaaactgcctttaagaggtggaggttgcagtgatctgagatcgtgccactgcactccatcctgggtgacagagcaagactccatctcaaaaacaagcaagcaaacaaacaaaaaaccttcctttaatatattcatatatcctacaagttctgcccctctagagaaccctggataatacaggtagtatttttgttttttaaaattgatctttagactgtgcctattgaaaaggtgaataggattacagttacaatgacattcttagagacacttaatgaagtaaatcaaatcgaatgtatagacaatgtctggacacagatatattttgttatctcattcatcactcaatcaggatataatatgataggtaatgtatcttctatatatagcacattgcaatagcttttatgtaacaatgcaaataaatatgttgttctctgccatcaaaaaatgtcaaactcttttctgatagttggaatgatggcactgatctaaacagagaaaaaacatcaggccaactggaacagggagaaggcatttggcaaaaattcatttgagatctaaatcagaaatcattatataaaacacctgtttggcactccatagccatctatgtcagatgatgttaaaaattaattgaagttcagagcaaaatttggtaatggcaaggatgatattcataatattttaaacactggtacagtcaggcattgataagtcataatggaaacggtgaccaatcaaaacaaatagcagcagaaatcaaactggttttgcataacaatcttggagctaaataccctccctggtactggagatagctacaaattacagtatagtgcaatgagcatatcatcacaataaattaaaaccataacgatatcatgtaaatcaagattgagactgttgttacaaaaagtttgttttatttcctttacttttatattccaactaccaattcctttaaaagagctatgttataaatacaagcatgattgtcaaaaacctttacccatgagaaggcaattatatgactgttaatttagaattagacttttatatccagttcatcaagtctaaataaagttactgaatgacaaatgaagtagccaaaattttaagagattaaatgactttctaatgatcacaatgcttccttctagtaaagcttggtttatcttattttcagctatttagtttggaaaaaatgatacataccctggattgaatgcctcaaaggtcacttaaactacagatacatctcattttcccgcaagtatagaagactggaaaacatgagatagcaagagaaaaatttatatatcctcatctgagattatatggatagatgatacagattatgatgttttcagtttcttgtatctgaaaagtcaactgtggctgacattctaactgtttgcaaatattctgaatcatcttctcctccaggcaatgtgaagtggcatttctctgtttcctttcaaattagatttggccataaaatgtgatcataagtaatgcgaattagctagacacacattacataagagccagtgacgattatctgtatgctttcccattgcctccattaccaaatcattcaagatagtgatgtttccatcagcctgagtccaggagtgaagtcaatgctgagaagagactccagctaacctgtggtgggcacgtaatgtgagctagaaatgacatttgattatattattttaagattttatggttgtttattattgcaaattgattttaacttatatagaaattggacccaggaaaggagggaggggatagtgttaagaaaagcaaaaccctacagttgtggcatggattcagtggatcatgaaggtgtcaagtaccctttagaagaggctgaaatgggaatgataacaatccatattaggccatgaggaaacagctgggaaactgttaccagcagtaactaggaaataatactgtatacccaacacactcagatgtcagaaaaaagaatgctagttcttttgctggtaactgtttatgccaaagtatggcaaggtattgcactctgtcatagtgacacatagctccagatgatggctgcaccgtgagcccccatcctgtagtgagaacacatagagaagatttcacaaccaatacacaacagacaagtgatatgaacaaagtgaacttcagtgtcctcatccaaagataatatttcaaggtgtgcttctgtggaattacctatattacttgtctgacatacgacctcaaacttagaaaataattgctgaatttgacagcatgaataaaagagaattgagagactatgaatcaggtagagttaaaagaggcaactgcttctcaactgccagtaataaaattacgaactgagttacaatggccaattaaaattcagtctcatagcaaggatggtacgtggttggctttcatgccccttgccatgatcatgaataaattaatttgttggacattagggataatgtccaataaaagttgtggtacccagaaaagactctccattgaactccaaagcccaagtaaaactctaataaaattgcacaattgaaatgagagagaaaggagggaggaataggtggaaaaacagcaaatgggggaacatatttaggaaagactgtgggtgtggctattggcataaactgactaaactcagtcaaaagatcagttaatttttacatgagttatactgctaaaaataatgaagtttaaaatttaaaatgacgtgtgagtcccagtgtttgggcagaaagcaacctgagaaaactatcccccaggcatattctccaattctcatctcccatgtggctaaggaggataatgggatggaaagaatcactcataggttggagcttgagtccccgaaaaacagaagacaagagagccactctcagaaataaaaactgaggaatcttcaaagagcattccccaccttcaggttcaggccttcaaaatttcagaactgctccaacttgagtttgttttgtgtgtcctgttttctttcttctgactggaagtgcttattatagttaagctgagaaattctcacttggtatataatatgtctgggataaataacttgcttttggttcatgacttgatatcaaaagaaactatatctggatttgatgaggaggccgtcaagcctcactcattgtgctggactcagttattcatgggagttttgttctgtttatcttggggatgaggtgaatgcgtcctgcatctgggaagagaagtaaactgaatatcttgtgatttagaacagtgcactgtagagtcattggaacttctcacatattttcaggttttctttcagggaaaaaagccctccttgaattaactatgagttgtttgttttggccaatggaatcctggcaggtgtggcatatgtcatttttctggctgaaactttaagacttagtgtatgcattgtttgtggtgttttctccttctgccatcgtgatcacttttgcctttaggggttgctgtcagcctgagtgttggaagaagacatagcaaaactcacagcaaacttacaaggaacaaattaggaagaagtcaatggtataactcacgctgtaactcaaggatttggggaattctttactactgcaggattacctagcctgtccttaatgacagaccatctcagattgacttaacagtgaaggacatttattgtctaatgtaattgaaactctagaggcaaggtaaacttgaagcaggagtgattcaacaactcactgacataaccaaagaaacatttttctatcttgaatgccttacaactctcataaatgcaagaaagctcattaatgcttttataagtatgttcttcttttccatttaagaagaaaagataatagcaatccatgtagctattatgaaaaaaaaaaaaaaagaaatgaaatcttgcgtctcccccaaatacccctaggaaatatatttctaggcctcattgacctgattttttatatatcttgaaccgatcttcatagacatggaaacagattattgtgcttgtcttacattaatcagagagtaattctggatatcaatataagctcaatcccatactttgtgcattactaaaacttaaatgtaggttttactccccaaaaatatgggatactttactgtcaaagaaggagaatgaacattgagcaaccgacagcagattttattaaagattataacatgtaaagtagcatgttagttaaaattcaaatattttatttggatatacttattttccctagaaaatgtcctctttccataaactgatggtcaaatatcatctgagagaaaaactatttttgataaagaaaattaatagtttacataaaatttaaaaaaatttattttttcttgcaaaacagtttgtaaatctagctaacccaatctttgcaatactgcagtattcaaattatttggctttgtagcattagaaagattatctattttcagatgtagtgtcaaaatggatagtgttctctaacagttacacctagatgattgccaatacaagatggccgccaactgtcattcttagatcatcaaataaatgtctctacatttaataggacacgatgctgataaagacatatgttgacagcatacaatacaccttagatattctatatgccaagtggtaacacattttttccaaagagtaaaatgtcatgccaaaacatttgtaaaatatccgttctttatatagaccaatctctttatttttccttaggattattaattgcatgaagattgctgtatttcataattataagtaatgaagttttttatttatccaaaaaaaaaaacaactggggataactcagaaagttatttggaaaagataatttatttttaactatgtagtagttattcattttttctggcaattttggtaattatttgcacaagtcttttggttttaatcattaaaatatgcatgcaaaactgtatttctagctttctcattaagtttgaatccttgatccacatctgggtagacattgtctaagtaatgtccaacaaaattgtgatctttgtctaattaattgtaacacataaattggtttttatgtggttactactattgtgaggttttgtgtgtttcattttttctccctctatatttttatatatctttattctatactatttttattgtaattaatgttatgtatatgctaccaatatttcttattaaacaacataaatttattttctaaaaatgtaaagttagagataaattgatttctataaatattgttattagagtgagaaattttctcaggttgcaagacatgaaaagagaaatatttctattttaaaattcgctgacacttttatttgcaggctgtaacaggtgggttttccaggacttgcccattacagaacaaaatgaatcaaatataatcaaatataaaatggcttagcattctgtgctaatcctatctactgactgaattttatattcagtgaaaataggaaacatacacaacagaaagtcatttacaaacaggttatcttgacctaatgaaatatgcaaattacttccttctttttgtatggtaccagttattagcattctctattattgtggaatgcactctgacacacttcatgttgctacttacatttaaggaagatttcctaaattcaaatgaatattctcttttaataaaatagcaaacataaactgattttttttctgttttaataaaaataacttttagataagttatttacttgcatttgtttaatttttcacattacattgaatcagcctttgaaagtaacctaaaactccattccaatttttattgtctatgtagagtataacaggatttgaatttcaagcctgtagataagaatagacaaattagtatgtcttgcacctaaaagtgaagaattcccagcagaaacatgtaaagagtgcacttgcacataattccaaagctttcccaaccatcagggaaatgaaataagctggtgcatttccttacaatcatggtacttagaataaagaccatcaacttacaagagcctgtgagtggtgataatattttagaattattttcccaatgtaatagctgcctcattacttcttatattttgtttatctgttatgaggcaaaaaaaaaatgtttctcttaaccaaaagcttttctcaaaactattacatgtgctctttcatatatcttactagttttaaaaagagtccaatataaatacagtattttaccaattgtttagttccaagaaaagtgaatgtggttttactgaagatataatttatgaataaaatgtttgggttcattatttagctatctataccctgaaattaaaaataatataaatatttttctgtgatgaattcttaagtttacagcaaagtagggcaacttctcaagtgaaatatgaatcagctaaatacatttgaccactgattacagcaaataattcaatgttgtaattttcaatattagaaatagtttcagggatactatatcagaaaatagatttattctgtagatcactgttttcccaatatcgacataacggcatccactatggcaagagcctttggttataaacctaagatgaacagtccaaatgtgagataagattaagaagtctgacttttgttaggactggcttctaatcagtacttcaaaatctctggtcaatgaatgttccagatcaaatatttaccaatttgctactaatttaaacacataacatgtagtgagctttgaaaatattaatctattcaattattctgtcagtatgtccttcagagtatttagttgccaaagtgctaattttttattttattaaattacacgaatacagaaaaatataaatattgtaagtgtataactcagaattttcaaaaactatatacaccatatagccgggctcctagataaagaaataatacatttttggtaccaaaagagcctcccagactctcatccatcacatcagcccttgcttaggcaaaggcatcattgccctgattcataatagtacaggtaagctttgcttgttttatacttaatataaatggaatcatatatgtatttttaagtttggcttcttttgttcaatgtgatatttcagagatttattcatattttggatagtccattccttcaagctttatacaattccattgtgtaaatataccatgattttaaaatcatttttaattgatgtgtattttattgtaatttgaagaattataattgtatacatttatgaggtaacactggatgttattatatatgtatataatgaagaatgagtaattcaaactaattaacatatctaccacctcaaatacttatttttttatggtgagaatatttgaaatatattagaaatatattctgttggcaattttgaaacatacattttattaacaagtcaacatgctatgctatagatctcaaaacctatttttccggtctaactgaaactttgcaacatttgatgatcacatcctcatacctccccccaccctccttgtcccctctattcaccaatgtctgcttccattattttggttgtttttaatgctctattttgatcaaataaatcttaagggagcctacatttactaactcttcctaaatctatttaccctttcattgtgtaatttgtgttatttccaacaacaacaacaaaagcaaaatattttgttgaagccatcattgtgttttctcttgtctggaacatgttttgtcaccttcacacagtactaggataattcctttgggaccaactccattcaggactgccagtgctctcattatttacaacggcaatgcaaataggggattcaggcacaactaagagccaagaataaagcagacctagcagtaaagaatcacggagcaagcatatttaactataaatgaaaaaaattggacagataaaactggaattaataattaatccttcaatgcaattcacagacatttacccataagaaacaacagcaaacaggaaaccatgacctcctcaaaaagacagaacaaaaattgagtgactgacccaaacaagatgctgatttgtgagctctctgaccaagaattcaaaacagcagttttcaggaaactcagtgatctctaagataacacagaaaagcaattctgaaatttattagagaaatttaacaaagatattaaaataataaaaaatcaaacagaaatcatggaatagagaaatacatttcctgaactgaacaattcattagaggtctcaacagtagaatggaccaagcagagaaaagaatcagtgagctaaaagactggctatttgaaaatacatagtcagggccaggaatggtggctcacgcctgtaatcccagcactttgggaggccgaggtgggtggatcacgaggtcaagagatcgagaccatcctggccaacatggtgaaaccctgtctctactaaaaatacaaaaattagctggatgtggtggcggatgtctgtagtcccagctactcaggaagctgaggcaggagaatcgcttgaacctgggaggtggaggtttcagtgagccaagatctcaccactgcactccagcctgggtgacagagtgagactccaaaaaaaaaattaaaataataataataataataaattttaaaaaaagggaaatacacagtcagagggaaacaaacaagcaaacaaatgaaaaacatgaaaaggaacaaagaccacctataagatacagaaaattacctcaaaagaccaaattgaagaattattggtattcaaaagtgagctgagcaagatcaaggagtggaaattttagtcaaataaataatgaaaaactgtgcaaagcttgagaaatattcaggtatagaacgatctgggaatactagtcagattcaatcccgataagactacctccaaggcatataataaccaaactccctaagatcaatgaaaaagagagaatcctaaaagcagcaagagaaaagaagcaaaaaggatgagttcatgtcctttacagggacatgggtgaagctggaaaccatcattctcagctaactatcgtaagatcagaaaaccaaacactgcatgttctcaatcatatgtgggagttgaacaatgagatcacacggacacagggagaggaacatcacacatcagggcctgtcaggggttgggggctaggggagggttaacattaggagaaatacctaatgttggtgacgggttgatgggtgtagcaaaccaccatggcccgtgtatacctatgtaacaaaactgcacgttctgcacatgtaacgcagaacttaaagtataattttttttaaaaaagaagcaaataacataaaagacataaaaggagcttcaatttgtctggcgacaaacttctcaatggcattttcaatgtgttcaaagataaaaaaaattgcaactcaaaaatattgtattaggcaaaatcatccttaaaacatgaaggagagataaactatttcccaaataaacaaaaatggagagaatttaccaccaccagactcatcttacaagaaatgataaaggaagctcttcagtctgaaagtaaaaacatacaaatatgccaaaaaaaagttttcaaggcataaatcccactggtaaaattaagtacaaggacaaactcagaatactctgtcactttaattttggtgtgcaattctcttgtaacctcatatgaagcccaaaagtaaaatctgtcaaaaacagtaatagctatagcaactttctaagagatagtataaaaatctgtaaacagaggagttcgagaccagcctggccaacatggtgaaaccctgtctctactacaaacacaaaaattagtcgggcatggtggcagatgcctgtaatcccaactacttgggtggctgaagcaagagaatcgcttgaacccgggaggcagaggttgcagtgagctgagatcgcaccactacactccagcctaggcgacagagtgagactccatctcaaacaaacaaacaacaaaaaaagtaaactggggcaactaaaagtaaacatgtgggtgagtggagttaaagtgtaaaattttttgtgtgctttttgtctttgttgtttctgttcttagtttgttatccaaggtaagttgtcttctctttagcataacttactatatctataagatgatttttgtaagcctcataacttgagataaattcatggaaaatgaaaagcaacaaattaaaacacactaccaatgaaaatcacttaatcacaaagaaagacagtaagaagagaagaagagactaaaacgaaccagaaaacaagccacaaaatggcagtagtgtgcacttatttatcaataataacactgaatgtaaatgatctcacttccccaattataacgtgtatagtggctgaatgaataaagaagtaagacccaactatatgttgccttcaaaaaatccacttaatgtagaaagatacacatagactgagcgtgaaggggtggaaaaagatactcgatgcaactggaaaacaaaggagcaggagtagctatacctatatcagacaaaatagattaaaaatctaagatttaaaaagacataggaggtcaatataaaatgataaaggggtcaatacagcaagataatataacaattatcaatagttttatgcccaacaacagagtttcctataagtatataaagcacacattagtagagctaaaaatatatataagactataataaaataacagcaggggaatttaacaccctcgtatcagtaatgaacatatcatccagacagaaaatcaagaaagaaagagcacagttaaactacgcactagatctaatgggccctagatgacattaacaaaacatttcacccaactgctgcagaatatacattctttccttcagtgcatggaacattcttcagaataggtcatatcttaagcaacaaaaaagtctgaataaattaaaaaataaaaatcttatcaagtaacttttctgaccacaatggaataaaaaccacaaattgaaaacaagaggaaccttggaaaatacacaaacacatagaaataaaacatcctactggacagctaatgagtcaattaaaaaaataagaaggcaattaaaaaaaacaaatgaaaacaaaaatacaacaaaccaaaacttgagatacaataacatctatatcaagcgggatgtttatagtaataaatgcctaaattaaaagagtataaagacttcaaataacctaacaatgaacctcaacgaacgagaaaagcaagaataaaccaaaccccaaattaatagaagaaataataaaaatcacagcagatatgaataaagttgagacaaaaaaatacataagatcaacaaaaggaaaagctgcatgtttgaaaagatattaacaaacccttagccagattaagaataaaggaagaagaggcaaataaataaaataagaaatgaaaaagggaaataaatgaaatttatactagaaaaatacataagatcaatgatagaaaaagttgggtttttgaaaagataatcaaaactgacaaattctttgtctaagaaaaaaaagacctaattaaataaaatcagaaatgaaaaaggagacataacaactgagaacccagaagcacaaagaatcgttagagactattgtgaacaactgcatgccaacaaattggaaaacttggaagaaatgaataaattcctggacacacacaacttaccaagattgaacaatgaagaaataaaaaaaaaattaacaagccaaaaatcaatatggctatcaaagagataattcaaagtcttccatcaaaatgaagctcaggatcattggcttcactgctaactctaccaaaatttaaagaagaaccaatatcagttctacccaaattctccaaaaatttggaaggaaggtaatactccaaactcattatatgaggtcagcattaccctgatactaaaaccagacaaaaacatgacaagaaaccaataagaacactacagatcaatatcactgatgagcagagatgcaaagataatcaacaaaacactagcaaaccaaattcaacaacacattaacatgatcaagtgaaattcatcctagggatacaaagatggttcaacacatgcaaatcaacaaacgtgatgcatcacattagcagaatcaagaaaataaacatatcattatttcaatagatgccaaaaaagcacttgataaaattgaacaacagttcatgataaaaactctcatcaaaatgggtatagagagaatacacttcaaaattataaaggccatgtatgacaaacccacagttaacactgtgctgaatgagaaaaataattttttcttatgagaaaggccttttctttaaagactggaacaagataagaatgcttactttcaccacttttattcaacatgacatggaaagtcctctccagaacaagtagggaaaagaactaaataaaaagcataaaaactggaaagaagaagtcaaattagcgttgtttgtagacaacacaatttcatacctagaaaaaacctcaataaaaacaatgttaaaattgataaaaacattcagtaaagttgcgggatacaaaataaactacagaaatcaacaaataatctgaaaaaacaagaaagcaacctcatttactatggctacaactgtataaaatacctcaaagcaatcaaaccaaataatggaaagatctatataagaaaaactatgaaattcttatgcaaaaagtacaagaaaacacacaaataatgtaaagatatttcatatgtatggattggaatatttaatgttgttaaaatgacaatactactaaagcaatttacggattcagcacaatccccatcaaaacagtggcattcttcacagaaatagaaaaaaaaaattataaaatatgtgcaggacatcaaaagatacccaaataactaaagtaatcatgagcaaaaaagaacaaagctagaatcatcacaccacctgacttcaaatttactacaaagctatcacaatcaaaacagcatagtactgggataaaagcagacacatagaccaatggaatagaatagagaaccatatatatatccacacatttacagccaactcaactttgacaaagactacacatacgttggggaaaagaaaatcttttaaataaatattgctggaaaaaatggataattttatgcagaaaaaatctagacccctatctctcaccatacacaaaaatcaaataaaaataaattatagacttaaatctaaaacttaaaaatataaaactaaaaacgaaattatttaggaaacactacaggacattggtctgggcaaagatttttttgtttgtaaaacctcaacattacagacaactaaagcaaaaaatagacaaatggaattatatcaagctaaaaagcctctgtacagtaaacaatcagcaaagtgaagagataacccacagaatgggagaaaatatttacaaaccattcatctgtccagggattaataaccagaatacataaggagctcaaacaactaaataaccaaaacaaaatactaaaaaccaaaactaataacccaattaaagactgggcagaatatctgaatacatatttctcataagaagacataaagatggcaaacagatatatgaaataatgctcaacatcactaattatcagagaaatgcaagtcaaaactacaatttaaaatgggttgtatcaaaagacaggcaataacaggtgctggtgaggatgcagagaaaggggaacccttctacactgttggtggaaatatagattagtagagccactaaggagaactctatggagtttgctcaaacacctaaagtagaagtaccatattattaatctcactactgaatatatatacaaaataaaggaaatcagtatattgaatatatagctgcactcccttatttattgcagcactattcccaataaccaaatacggattcaatttaactgcccatcagtggatgaatagattaagagaatgtgttatatatacacaatggaatattattcagccataaaatagaatgaaatcttgtcatctgcaacaacatggatggaacaagaggcctttatattaagtgaaataagtcaatcacagaaagacaaatattctaacccacatgttcccactcatatgtggaagctaaaaaaagtagaactcatgaagatagagagtagaacggtggtttccagaggccaggaagggtagtgggggctgggagaaaatgcagggaaaataaaagaataaaaatgtatttattaagtgtgcttaaaaatcgcaaagatagtaaattttatatgtatgttttaaccaagtaaaaataaaacaatcataacaaaactcacaaaacactataaaattaaaatttagataacttcattgtagaaataagtgaagtgaaaataagcactaatgagaatcatgttgaaaaaggtatagaacaaatgctgtcttcattttgctgcacaagagaaaagcagacactagaaaagtagagaaaaacctcagaggtatcagatgataacttaaaatttcttgtactgagaaaagcaagaactttatttattaagtgactaatacatcaacttaggatcaggctaaactctaatgccaatagtacatagcaatacacaaagcactagttaataaccagtagtaaaagcaatgaaaatgtccatttgaaagaataaaaaaatgaaaatctttccaactatgtaatagtttcttgaaaaaggacaaattagccatttcaatatattttttgtcaatatttaaaagtgttatattaaaatacatgtcttacctgattcctcaaagtcactgttgtaagctttccaggtttcagttattcgaagaagattctcttccatggcttgaatgtccatggaggggcagttgcattctggaaatttgggaccacagtgacaccagcagtcattttccttgcagataaactctccctctgaattgcaagcaatgtagctcaaagctgcttgtacaaaacgttcctgaagatagtctgggagaagtacttgaagcccttgaagaacaaacaaagaaattaacaaatttactttgttaaagaaaaaattaaaatacttatttataatattcaatcaaaacagtaaataatttagtgtattaaattttgaattatgtatttttaaactatcagaaaaatatctaagtctatatgctgcaaatatttataactctttcaacatattctgactccatgaatatgaaacttcagaaatagagatgattaatcatggagatgattgaaaactcagactatttgatgtaatttatcacaatatttggttatttttacataatatagatggagcctatctttctaaacctttgaaaatacacatatgcatttattttctaccagttgatttcaaatggttttcaatattttcattttgtttgcagactatcagcccacatcaatgtaaatatcatataatgggttgtgccattgataaaatacatattgaatgttgatggtaaggcttatctcatgccattaacaacatataagttatataattctatttttcaagagtgagtaccaaaaataactacaggaatcagatggactgatttagttatttcacagtttattttttgccatgtgtcaacagtcctagtgatataactcattagttttctagaaacatgtttagtaaagttgctatctcttaaaaaactgtccaaaatattgtaaaattaagatttgggcttttctcagggtgtagcatttattacgatatttcaaaaatgtagtttttcagtatgtctggctacttaagaatacttaaatactaaatatttaaacaaataagtaggtaaaaatgaatacaaagctaaggaaaaatctggtaatagcaaagtgttacttaccagaaaactgaatttttataatttcacatgttttctgtttaacaaaaaaatcaatgttgacccttgactattatcttagaggttgatttaataaaaatcattgattaacatttagaaaaaaattaatttacaaatatgttgacaaattgcaaaatttcctttgcaaattgttggaaaaagtactcttagaacttatatattcgatttcatattaattttcatttcacctggaataaatatttattgaacagtctcattttgaataaaattgctaggtaagatacaaatatgagggtgactgagaaatttatttgtcacagagatatctgcagtatatttaagaaaaataaaagatgcaactatataagatacatgtgattcaataaatataattaattggctaaacaattatattaagttcacaaaagtaaaaaaactttttattaaaaagttaggcattgaacattatttgacagatgtatagttttcaatattgagtgactgtgctgaagagtgatacattaacagcatcacacacagataaaaagctgggttatatattaatatattttggaaatgaaagtagtaatattgtttcattgcaaatgggctataagaatacaatgaaagaggtgcttacacacataaatgaggagtcatgttgttgggattcctatgtcagggaatatagaattaattcatttagatttaaattaattttaccatgtgggatactaagagtggtacccatttggaagtagaaggtaaagaaatatattagagttgactaatttttaagattagatttaagatctttaagaagactgaaaaaatccacactagggaaagaaattaaggtaatagaggaatagtgagaatctgctagatagtactgtatttgatctaaggcaagtaaaaagtgttaaaatacttagaggcataaaatgatacattcagaaattttcttaatcgtctagtcctatggtttaccaaattactgcacatttcagatacacctagtgatttttttttttctgaaaacttaaagtgctaaaaacaatttgaataattcagagtctttgctcaaggaactcaggaatcagtatatatttattaaaagacctaaggtaacagtaattgagtgtggactagatacttgtaaactacttatccattttaatcttaatttcacacacaaaaaaaccaaagaactcgcgtaccattttcatagtcataaagcacatcattgcattacaacgttgaatctgtaagacggtagtgcttttggagaaatagagaaggcaggagaagtaatttggggaggaatgattggtggcaagaaatggtgagttccgctttagaaacacaaatactcctgctatgatgatacatacatacactgctaaaagaaggaaactcacattctgtaaaaccattataaaattaaagagttttgagaaaagaggtttagggacgcagcgctcaaaacacttgaattttataaccagaccaccgataagaactagttggttcctagagagatagcttggcctgctctgacaaacaactcggagtggttcagggctggccacggaattttctttttttttctgctatgtacagaaacaggaaagcaggaatactgacagcactatatttagaccaggtctacctagtgctggaacaatgcttaacaaagcttagttttgagcctatgtgcttcctgtaaaagccaggatgtgagggcaactgctacaagctgagaaccacagagtaaaatatgaatgtttccggtgtgaaaggactagtttgttttcaacccaccttctcatggaaccaactaggaaatctaggtaaagtattaaaaataatctgaagagataacaaggacaaaaatgaagtgagaatttctggggttaacctggaaataaggtaatcctacaggcagagtgagcccaatattgggttatatggtttggctctgtgtcccccacaaaatctcactttgaactgtaataatccccacatgtcgtgggagggacccagtgggaggtaatagaatcatggaggaaggttttctcatgatagtgaataagtctcagaagatgtgatggttttataaatgggacctcccctgcacaaactctctcttgtctgcccccatataagatgtgactttgctcctccttgcctctgtcatgattgtgaggcatcctcggccatgtggaactggagtaaattaaacctattctctttagaaattacccagtctcaagtatgtctttattagcagcataagaacagactaatatgttgggcatatcttttccattagagttctgcccagaacaaagtacaaattgacatttataccaaccatgacagagatagtaacttcctcaggatttagttactagatgagctacatacccagagtaaagaaaaacaaaacaaaacacacacacacacacacacacacacacacacacacacacacacaaagaaaccactagctttcaccagatctgaagtatagttccaactggcatatttcaaaattaattaaaatagcattgaaactaaatcttctctgaaggaaaatgcaccatcaataattttaaaatatttttataaattttcactcaaaacagaattcaataaaatatgatgaacatataaaaagacaagggatggtatagagggtgtcaaacaagaatgataaattaatttcaatcacatgatcaaaaatttaataacaaaacagacaatatggcaaggaactagaaattataaagaaaaatcaagtggctattttacaaataaaaatgcataatttgaaattaagaaccaatggatagctttaacagcagcatagacatttaagagataattagggaactgaaatattgcagaagaatacgtttaaaaggaataaaagggcaaaaagatatgaaatacagaaaatagcataaaagatttgtgttatgatggaaaggcctaaaccacatttaaatataacacagaatgagaggaaagaaaggaaataaatgatatttgttaaacaaatataaaataatattagaaaattgatgaggaacgtaaaaaattgtaaattaatttgcagcatatcaccatatgttatggcaagacaaatagctaagtaaaaatgaccagctggtcaatgttcttcaatgctattttgctcatgaactaccttaaatagttttgaaaacataagcactactttggacatgagtaagctcctgtttaaaattttcgttatacataaaagaggcccaaagctggtaaactgtggtattattaatatgcatattttacaataaaaatattactctgcttctatatatgtacaaatgaaatataattcctgttgatttggtaactaatacatcttttaaaaataaaatttgaacaagatatacaaatataaaaaaagtatatatgtatgtatagtgagtgtatagatatatgtttgtgtgaattatgagtttttagtaatgaccttctttttcatacatcttctcaagtggaaaaagaattgttcctgaaataaaattcttcaaacactcacacacacacaggcacacacatatctctttcctccaagtcattatttcattcgactatccctaaatatttttattcaaatataatatatttgattaatcaatgtgttttcttaatcacagtcatacttatcttctataaaagtaaatagcttgaaatgtaaatatgtatacatatatttactgaaaatttaaataatattaattatcatatagtataatgtatggtatatatgatttcttgatactaaaaattttaaaaatatttctgacaaattataactatcatatgtaatatgcagttcaatagaagtacacttattataagtatgaagaaatatttttttaaagcaaatataatcagctttttgaaaacacatggcttgaaggacttaataggactttttttgtctagagtgacccttccttcagcataaattattatctgtcttcatttttaagtatgtaagcactgagaacatgtgattcaataaattaataaacaggaacaaaaacagttttttgaagcagcatcattcaatttttattataagccaaaacactcatgaaccatcattaaaaattacatttaatcatccaccttaaaatagcctagtcctgtgtcaaattcatttaaataaaatattgggaactagctaatatggaaaagtgcttgtaattcagtcctttaaattattcattttctcaaggtctgccaattttaccaaaaaattactaccaaaacttaataaatgacttttcattattctggttatactttcactcagaggcaccttgtttgatgtgttatactcagaaggcattgaaaaaaattgaagtattatttcaatatgcatttgccaatattttcttataactactttttattatctaccttaaatatattttcatcaataaattgaagttgtagctatggctcttttaatttttgaaaaatgcctgctctgtaatcttatcagcaaaacgagatctcaaagtccatcttttatatatcttattttttaaaatactgattcatataccaatggttaaatcttagagttctgttctgaattagttgtctaatccagttgacttcaacaattactggtgctttatttgctttgcttagatacaattccacttcaggaacaatttttctttttctaatgaaagaggagagtttcagaagttctttattaaaaaactgtgataatttcaggattctctcaataatatatctaaattcagaagattccaaaatgggccaaacgctctgattctaaaacttcaacatgtacttagaaagaaaacacaacacacaagcaactatctatatctatttatctatcatctatacctatatccatccatttatcagaccaaatatctaactagctaaccccaaaagacatgaagatctctgttgttaccttagtaaaatattcttcagtgattccagtgttttcaattgccacatacagtgacccagaaatatctatacccttcaaaggaatgcaccatggtaacattgatccagaattaacaaattgttcccattagtttataaggtagatgaggggtagtacaaaaggagaggtttaaaagttagccaacattatacttggattgtaaataccaattaaatttaagaaagagtgcatgaaatattgagggtcttgaaattgacttcctaatagtattttcagaaaggactttgtaccgataggtgtataaataaagttgtaatagacaattaaaaatacagacatggaaaacagaaaaaaagtgaaagagatggaggtttctgagttacgcacattagttgaagagaatagaaataattatacaaaagagaaatgttgcttcatttattccttgtgttaattatttttccagagagataggggactgaaggattttaaaaataatttaatattttgaaaactgaacatagtaattcagacacaaatcaataaatcttgttagtaaataatttttataataaactgattgaagtagtcatacaaattggtataaacgtgctgtcatttttattgcaattcatattctgagggaaggttaatccatacattaaaaaggagtaagcagtagagaattgcaagaaacattggtggacaacatttttatttcaattagagaaaatgttttaataaatgtaaatctataattgatattgataaattggataacatttaaattgttaaagtatttaagaactttgtacttttaatacaactcaaaataaaaggcattcattcactatttaggataaatttaaacaattcaatgttattacatttttcttttaattaattaatttttttttaattttttagagacagggtctcactgtcacccaggctggagtaacatgatgtgcagtgtcgcatggacagtgatgtgcggtgtggacagcgatgtccaggctggagtgacagtggagtgcggtggtgtggtcatagctcactgcaaccttgaactcttaggtgcagcaatcctcctgcctcagcctcctgagtagctgggactgcaggcctgcaacaccagcgcccagataatattgttttttaggtctcactatgttgcccaggctggtcttgaactcctggcttcaactgatcttcctgcctcagcctcccaaagggttaggattgcaggcataagccaccacgtggggacactgatacatttttcaagattgcaaagttaagggaaaaaatggtagcatttctgaaacttttaagcatttttatgtaaaactgaataatgtaaatattcagctctaagttatgcaattcaaaaaggcatactagagaataacaactcaaaattacctctttgatcagtcaacttaattttgacagaaagtgtcatcacaaagacttctctgaacttgttcaactagtagtgtttaaacgtgtgtattcataacctgttcctgcctataagaatgagcatgtatgcataattattgtatttttaaaagttcttgtgaataaaatactctttattgaatatctaaactatgtagtaatagaaaatagcaaattatttttataaaatctatctttaaaatggaaatcatatgaatataaatattttgttaatatatccttaagtacatttctatttaccaggagaaaaatacagtcttgactgccacattaggttatatataaaatgtcaacagttcattttataccatgcataaatatggttacaactttcacaagaatctttaagtaaaaagtcaaagctcaggcaagcatatgaagaaactgctacataatgacacaatgattactatacgtaagaaaaatattattaggacagattttcaattgctatagcttagttaatttgagaagaaaagaaaatttttgatattttattcatatggtctagaatttcatattttcttgtatcagttaaattatgaaattagcctttaatgagagtttttaatagcctgtatgtatatgcagtttactttaaaaaatggaaaagaaatcacgactggataattgctattcaggcttgtagagaattaatgaaattttaccaacataccttgcaactgaatcttattctcaggactctgaaccagaacagaactgacagaatctaggttgtcatagttactgcagccaagaggaccagtccgtgtttctgttacctggcaaacaaaacatcaactttattatctaaatcagactttacaatgtccttttggttcactgtagttgtcacacactaatattatacgtttgacagtaaatatcactgaaaggtccaggatctcatacacaccagcaatacacccacctaaacatagcggaaagcagtaagtccctttgtctttaattcattttctttcctttggttgggcataaatatcccaggaaaataatgcatgccatctttgttcaaaagcataactcataaagtcactgatttcacccaagatataaaaaaggcccactccttatggaagacagcgagttctgacttatatgagaattgtttgtgtttgtttttactcaataaatcagagccatctgccaggctactctctcaaaactgattttattattttcttttacttaaaaatctatatttttcccatttttatgttggcatgaaattctaaactctctgtttgccttccatctggtccagttctttccaatatgccagtatctccctgttcagtttgacattcattctgtgcctttgcttatacaacatcctccactcccacctcacttggattagaaacttctcctttctcaactttgactaatcagttttatctatcctcaaaattaagctcatgttcaaacatttacacaaagtattccttgatgatttctacctgtgttattttaccatttccatccaattttggtctgcagcacacaggtttagtacttaaatatgtaatctcatatgtggactgattttttcatggatgtcttgggatggatagtattaggagatgaggagactaaatttaatgaattttatgaggctgaaaatgtatcctgaagatttaatcctgaagatttaaaactatttaaagcagagcagtattgtcagaatcttcaataagatattctttattaataaccagactggtctttgcaaaacacaatttagataacttcattccaatgtttacaatcatttaatggtttcccattcttacttagggtgtgacttagagcctgttataggacaaggaagacaccatattacccagctccgtgttacctccctaaatccgtctcttctcttatttattctgtcttgctgtatctcaaacatacttgacattctgatgccttggggtatttgacttgttgttctagtacctggaacgttcttcctcaaactattttctagcgaatccttcacttccttcaaatttttgctcaaatttcattctcttgggactacttggactaacctacttaaagtgaataccccaaactcttccaacatttttttctttcttacattgttctacctttttcacagtagatatcagcttataaaatgctgtacaatttactcatttgttatgattactgttgacacctctcactagaatgagagctccacattctaaaaatgcgggagtttttgtctattttgttcactcacatatccacagaacatattaagttcttgcatcagctgaggggtattgattaagagaaagaggaggaggaaacataaggagaaacttcgtagtatggagcaggaaagacattaaggccatcatggagatgatgaaagcctaaagtaaataggtacaataaactttatctgaagaagttcaattgtaaaaaacaagacataacaaggttatgaaatgacaacattatgaaacactgcaagtgtttattgatagagagaaaggccactgaggtttccagtattagtgataacattcaaaatatgaagttaagaagctcactgtggaggatatttaaaggagctcagttttgaacatgttgactctctttgatgaaaatatttagtaggagtggcaacacaggtttatgtcttagaagttatgtcaatgacaggactactaatttggaagtcatcaacttagaggcgacaatcaatgatggatacagacacattaactcaaatgcattgagtgtgtgtttaatttgtgtcatgacaactctattatattttctaaatgataactccttgatggtaaccaagattgactatgtgtaaatagccagagttgacagtgtggtttatcatgggcaaagaattactttttccttaacaccccaacaacttttaattattctccacctactattccccactactgatactgaatagaccttactttgtttagagaaataatgtatagtgttgatatgatatgtgtatgtataattaatatttaaatataaattagtgacagcctaagggcaaagggaataataaaagcatcaaagagaatacttagggtttaagataatttaaattttcatattattctatcatgtggtttcactattgccaaccaacacatatcacatgaatataaacacacacacgcctgccttttttagaaagttttctaagtaaaattggcattaagctcatactcattgacatagtgatcttggaaaagggaaggtaaactcctctaacacttcatccttaaaagaaggtaaataatattaccccattacaaagagtctcttatattcacctactctgttgttgtcaattcatgtaagaaaattaaataatagacatacgttttgagaatatttgaatatctctgtccttatatattgctttactttctcatcattcgcaatatacaatgatataaatttagcatatcatatttataattttattttgttctctattcttcacaactgaattcactgatcactgtctggtttaatataaaattttacaaactctcacacattatatgaaataaatctatctttcaattgtattccatttaaggcctccatattccttactaatgtcagcattagtaaatgtgctcatacttatttaattctttaaaataataataaaataaataaaaatgtaaagaaaataaaaataaatttactacagagatgctaactgtgccaaaacacagaatagcagtttacttgtttgttccaacctatcatttttaataataaaagtaacaaattcccatgatggaaatttaagcaatgaaataaaatactttgccagaggagcaattgccattttttctacttttatatgtttcccctatccttttgccagacatgaaaatggttgagactaggagtaattgcacttcaagactattctttattcgcagcacacaaatatcatggcctttaccttttcacactgtatttctcattaattattttatttgtttcctagttacattaggttatatcaaagtaacttctgagtaattttatcagccatcaattatgaacataaaacactggaatactgataagtacaattagctcttttacaatagagttatgcccaaacaggcataatctaagactttccatctgaaatcaattttctcttctagagacctacatctcatctggacaactacaaaatgaatgttaatatttaagaggggattttgcccatcctatattgtaacaagaaaaccacatctgaaatatcaggagttgaggtgggggagtagtgaaatttgttactgatacctgcatcttgacaaactgctataccagttatttaattttatacattttgcccctgtttaccttagatatactctattatactgtccacttcaattgtctccttttccagaaataagtgtttctattttttaatcattcaaaaaactttgggttgagaaggtagaaactatactagagaacaataactatatttggctcgtattcaatttctgatatcttaacatttaatataagaattgatacttattattaaaatagaaataaagatttaatcttacataattagtattaaaaatttattcactacatactctgttttttaaaaatattgattaacatagttgcaattcatatatacagcaaatggctcatatctagaatatataaataaattctacaaactaacaataatatggcaagagcaacactgaaaactcacttgacaaaaaagatatataaacatccagtaattttgaaatagttttcaactttattatcaaagagctggaaattaaaacatagtgagaaactactatccattcaccagaaagtcttataagcatacaaagccagacgatgccaagtggtgacaatacagtggagaaactggaattctcatatgctgctgctgggagtttaactcgtacaatcactttagaaaattctttgaaagtatctacataagtagacacaggcacattatatgagctagatacacagccaacaaaaatgtgaacatgtgtgtacaaaaggcacttgcaatgaggttggtatcaactattcttagtaaccccaaacagaaggatattacattagtgtgttagtccattttcatactggtataaagatgctaccagagactaggtaatttataaaggaaataggtttaatcgacttgcagttccacatggctggggagacctcagacatttaaaatcatggccgaaggcagaaggtgaagggaagcaagacatgtcttacatggtggcaggtgaaagagagcgaggaagtgccacattttaaaaccatcaactctcctgagaacttactatcacgagaacagtttgggggaaaccacacccatgatccaatcacctcctaccagatccctccctcatcatgtggggattacattttgagatgagatttgggtgaagacacagagccaaaccatatcaagtggcaatcagtaatacaatgtggaagtacatagaagatatgaatactgtactacagtaagaataaatttttatgtattctgtccacagaatactgaacatgaacaaatctcacaaatacaatgttgaaggaacaatatataaatgtttcaatattctaacactagaagtttattttgcctaatcttgaacttccattaatataaagctcaaaattaggtaaaataaacttctagtgttagaatacaggatggtggttaccctttcgatatagaaatgaggtaagagggcattaggataaatacttatgttctagaaatatcctattttttaatctaggacatggttgctgaaatgttttcaaatttgaacactttatgtacttcgctgtataaatgttatatgttactaatatttgctaacaataattggttaatattaattttccttgtgaattatatcaaggaaggtaccacatcatctatatctatatttacatatgtatggatatctagacatctatctacttacctgtttttatcaatcatccatgcatatgtaataaaatgcaaatttggattttcatacatatatcctttcaaatgcataaatattctaatatagtttcgcaaaaagaaaatgctgaaatctgacactgaaagattatgaaaaacaaactacttttttcaattactaatatgagtttattttaaaatccaatacaatctattttaaatcatcttagaatacgtcattttttttttatttcaaggctacaattactactgttctataattgaagatatatagatgataaattatcttctatttattagatagataatagactaggaactaacttgactaggaactaacaggttaatatccatatttcatttttaagtatgcactattccaaaccatatatttacctagaatgaaaaaaatagttttttcttgtaagttcacatctaaatagcaataaaaaggatgaataaataagcaagttattttaaatatgcaattcttattattataattactatgcaggtttcctttgcctatagaaatgctttttagagtattttcaaataaatcattatatttaatgagataaaagtttgttaaatttatatagtttatattcaaaacacaaatcctagtgaatataggggtatcagaaaaagaccccataggtctacttgcaaaaaaattttaaagcaaaatttcttttaaaacagtttgtttcaaacagttgtttaaacaaaagcaaaagcactgtttccccagagttaaaaattatctgaggagtagatagatatatgaagaattagggtattaaaactctcaagtgggggtgggtgtgattgctcaagcatgtaatcccagcactttgggaggccgaggaggggtgtatcatctgcagtcaggagtttgagaccagcctgatcaacaaggtgaaactctgtctctactaaaaatacaaaaaattagccgggtgtggtggtgggtgcctgtaatcccagctactctggaggctgaggcaggagaattgcttgaacctgggaggcggagattgcagtgagctgggatcgctctattgcactccatcctgggcaataagagtgaaactctgtctcaaaaaaaaaaaaaaaaaaaaaaaaaaaaccaccctcaaggtattctcagaaatataaaaatatctttaatttattttattttacctcaaagtttccattatgttttattatgcccatcataaaattgcagggcaataatttatttctattatctcctttaattaactataaactctctatgcataattatacacagtactgggcacatggtagaaattaaaaatgtttggattaaattggtggataaatattttaattttagttagaaatatttattacaaaagaaaatttattgaattttttgggaacctcttgaagaaaatgtagaagagacaatatatctaaattttttaagctatcagaagtttgaaatcatctagtttcaccatctcattatataaaagagatgctgtatctggatgaagtagttatcaagctacttcaggatcatttgtatgaaatgagagctagaactgggacttagacctcctaactcataaatcaaatacccattctaaacaacacactggctttccaagctttatagttaacaagttttggaaactttgcttggcttaatcaatgtaattaattctctctctctctctctctctggcaataaagttacaataaaacacaatttaattggtctagattgatgtagaagtcaattacaatggtgtagtatattgggtcattcatgaacaaaaaatattgctatgaatgtactggttaatatgactttgattgaaggccaaatgaattaacttttattctaagtatgaatttattaatgctttgaaatataacatcctgcatattcttatattacttcccactaggattgtgaagagtaaaatacaagtgttgattagtttctattatttcctaaaacagtacaatcttttctgttaccacacatataagatcttttaaaattacatattgctaaatctattaaactaacaaaatgctttataaaattttgatgttaaaaaataagaaaatatatattttcccttcatttctcaactgaagatagtgccttataatattttttcaaatgttaatattgagtttaaaggtaattttaccatttaatatttttcctctgatagtcattaagtcttatttcaacattctattaagtacttaatatcagactgcaattcaatgtagttccacttttttacccagttgaaatatttctgagcttatttttagtaaaaaatgaattttcaaacatattattaattataagatgcattaaaaacaaaatgttcgtctcagaataaacatttcagtagcaaaatgtttcttaattttcaaaattgttttagtatttacagtgtattttgtgggaaaagtgaaaattcacataaaaatgctacatgtcctcaaataaaaaatatatcaatgcaaaattttcttgcatctcaacacaaaagtaagcattatacttagtgtgttatacataattaatatagtgacttaaaatatatttaacattgtcaatattttcttgggccttctccaaacatatagatacagtttaaaatagtgtatgatatattattcatccaggatgactcacatcttcacataaaaagcacaaacacggataaacacattcagtgcaagggaacttataccactgttgaattatgcatctatgcaaattacttgaagctgacaactatattctctaattttattcctcataattttaataaaccaattttttaaaaatattagaagtttatagaactgcatttttaaaaggtagtgtttggtttttttatttgccttttacaggagaaatagtgatactcgaaacataaggatcgaaagtatgattgcaaacaatatcatgtatatccataaagtatatgcagaataactgtgaattataaaatttaaccataggaaaaaaatgtagagcaaaatatatttatttgaagtaaactgaaggttacgtgagaataatacaaaaaacaaagcactctatttaggaacaaaattgagtatgtcttcttgaagagtaattgcttcagtgcagttttcacttgtgtttgttaccatgaggccaggcacgactacaatgattggtctacttcttcatagcctataaattatcctctatcaaaataatacacaagcacaccaccctcaactatccccatgtaaacctagtgagagagactatgctaattctttgagtacacattaaaatataaaactacacagtgactagacaacagaagttttctaaggttcttaaattattgatttagtgtgatatggaataagcaaaactggacacaatttagttaggacaaagttgccaaataacatcaggacccctttgtgcttaaaccatggttgccatggaaattaaatgtgtggcacttgattggtcttggagatgccaagtctgtaaactcactcccacagatgttattttgactttttttttagataacacagagcttaaaatcacagcaactataaaaaatacatgtagccataaaaaagctttcattactttcctaattgcatgaatatacatttagaaaactgacatttttataaaaactacatttgtggcagctataactgatggtgttacaagaatggtaaacttgaacttcattacaggaaatctaaagggatatgttgttactctagctgggctaatgagttttctgaggttttcaatattaataataataaaagtaaagctttattgccacagggagttacaaacaataggtacagtttgcaacctggttcagggctgtggcatttcccttgcactctggtgagagttactaggcagcgacctcagttcttacagccactgtctggcctgaatgccacttttcctgggccagagaaatgatatttcaaggaactcaggagccagggtaattttctgtttctttacattcaaaaagtgtaatctaaagcagtgttgattatattcattttacaaatgaaagctatctgaagaagtaaaacattaaagactgattttactttttaatctttattgtttttctatgcatttcaatctcattgcctttaattgtcactgtctctcatcacccccagatgggactgtctagtggcaggaaaacaagctcagggatcccactaactccacattacagtgaattgtataattatttcattacatattacaatgtaatattaatagaaataaagtgcaccttaatgtaacgaacttgaatcatcctgaaaccattccctccactaagttcgtggaaacaattttcttccatgaaaccagttcctggtgccaaaatggatggggactgtttgcatagactaacttataattgtgcaaatcccactaaagttgcaaaaaaaatatctgttgccaagactgggaagcaaaatgtcacactaaacagaactactccctttattaattcctacttcctactctataattttatttatcaaaacatttctacatctacccaatctgctcgattgatactcacctagcatctcagtcaagcaaactgcaagctgatgctccaaatgatacaaaaacttagaaattgaattatctgttttgctttctttgacagagtaactaaaaatgttcaggtgcaaatgtcaagtgctgaatgaagtaaaagcacctatcaccatcctggaagacgatggcagcagaatccagggcattgacagctaatcacagctagcagtgcacacaaagcaatctgtcactgtcaaaatcccgacgaacagtctttccataagattctctgctatactagggtactaaagcagggaacctcgttagatacacacattttagttgtttaacatttaatacaactatttcattattattacttttaattttctcctactcaatgtaggagccagtatagtatattagaacatatctcaaagtgcccactattttatttcgagtaaatacttctatcaaaaattttcaatttctcctctgaaattccatatttaatattactcttctgaaatatttatttaaacatatcttattgcttaaaacttaaaactttttattatagccgtttgaagtttcagcattatcaaatatttctgaattccttaagcatatcaaaagcttctgtcctaaataataggacaactaatacctgtgcacagactagctaaagttttatactgaggccgtcatattcttacatttgtcacccaattaaacaagcacccgagagaactgataaagcgcagcacactaaaactcaacagactcaagcataattagaaagacagaagtggatttcttgtttcaactggccattatagaaactgttctgtcatttcttttcttttttttttttcagaaaaataaattggctttgctcacaaaaaagttaatacaaatccaaattctttaggaacttattatcagtaaaagtcagcagtaatatgacattaaaagaacaaattaattatataggagaaagaagaaacatatagtgtgcatgaattacaaataattattaaaattctaagtgccaggggaaaaaaacaataaactggcccaaactctctgcaatattataatcatattatgcagtgctgcccactcccccagttttctttaactgaaacatcatcagctatgttaattatttatcttaaaaaataacaaaaatggaaaggacaagaagtttagtgatttttttttctttttttattaaactttaagttttagggtacatgtgcacaacgtgcaagtttgttacatacgtatacatgtgccatgttggtgtgctgcacccatcaactcgtcatttacattaggtatatctcctaatgctatccctcccccctccccccaccccacaacaggccccagtgtgtgatgttccccttcctgtgtccatgtgttctcaatgctcagttcccacctatgagtgagaacatgcggtgtttggtttttttgtccttgcgatagtttgctgagaatgatggtttccagcttcatccatgtccctacaaaggacatgaactcatcattttttatggctgcatagtatttcatggtgtgtatgtgccacattttcttaatccagtttatcattgttcgacatttaggttggttccaagtctttgctattgtgaatagtgccgcaataaacatacgtgtgcatgtgtctttatagcagcatgttttatccttgggtatatacccagtaatgggatttttaaagtatgtatttgttggaaaaacattttaaaaataatttaaaatccaatgtgaaatacaactgcaatttttgtgttcctcttctttctataacttttccactatatcttcatctccttacatcattaccttcttgactatttcctctagagaccagaatcccagaggaactttgtaccttcatggtacctctgggacttcatgaagctttaattggcatcaagggtttcttagattgcagccaatccactaacaatttgctctggggtcattcggttataaaaccccaggtctatgaattttgggtctctagaagttgtctttaaccatacaaccaggtgattgttagctcacttaacactaaaatgcaccaagttagaaaaaaaaaatcagacaggagaaaaatgattcttcactgggtaaatatttcaatttatgtgttttacatttttctatggaacagactacaaactaaaattactattcattcaaatttaatttacttaatattattgagggaaaaacttttgataatatgttgagaatttggctttctgccatgaactaaatgaaacctgatgaaatgtaggagctgttattttagctgttttatgtggcttgcctccttttcctacattaatttaattttacttattgatgtaactgttgtgccttctaccagcagcccttttcatcactctctaaaacttgttacaaatctattatcagtgaagaaaccagataagcaacctaggtagatttgttcctgagtagtttctaaatgaaaaattacaggaatctcacacatctaaaagaatgaaaattatgaagtctctttatattactcaggcaccttctccacttgcctttttgtgttctgacatattaaatatagtttaagctatgaagaataacttgaaaattttttaaaattatatatttcaagttacaaataaccgtattatacataatcctattgttatgctaaattttctagcacagagcatgaagcaattcggttaccaaaaaaaaacacaccatagatttaaaactggtttatattttcaggtttgtcacttactagctgtgtaactagaagtatgaagctcctgagcctcaggagtattctccccagatataaacgttaaaataatttacctgcaatacctgtggaaggaacttatctttacaaatatgcatttttgttttagaaaaaggaagcagactccaaagtgtaattttttcattagtcaacattatggtaacaatgtgccagtattcctagctatcagaaatggtgcattttgtctatgctgatggatgaataactgcacagaagaattgcatttcacagatattggtacttattggatttttgaaaatatacaataaattatagttaagcatattcaccctatagtgctgcagaatgccagaactcatctatcctatctagctgtaacttcgtatcccttaacaaatctatccccatcttccactctcccctatatttcccatacttctcaccctctaatacccacaattctactctctacctctctactttcaggaattccttttttcttttcgtcccacatgtgagtgaaagcatgtagtatttacctttctgtgcctgacaacctgcttaacatgatctcctccaagctattccatgttggcgcgacatgattctacggatttttaaaaaataaattacctacttacatttccaatacacatttccaatatatttcaaggtcacagaccgttggggtcttacatttatgggttccccctagacactctatcttcgacaaagtttgaactttgtcatttgtaccttgagccacatgagaataaaacaaaagtagctcaatccatctgattcagcaaatgctatggagatctcagtgtcccctctttgcatggtttcttttttattctggtttcagaatatccttcctatcaacttatgaatacacagaagaattcttttatttttaatccataattttagttattttagtgggaaatctgtgtcacctcttgctattagattcgtgcaaacgtaattgcggtttttgccattacttttaatggcaaaaaagtacttttgcttttattttcctttgttttttttaaattcattgtattgatttagtcaagttgctatttattttttattataatttaatctaattgcacatctgcctttcattaataattttctcccctttgccaatgctaataattgaaaactcttactctgatataatatgaaaattatatttcaccaaaaaactctattccataatgtgccacctgcccattaagatactatcgtcttaatttttcattctttcattctcctatctctactctccacctacccagggtactttcagaatttttgtatttctattctcccctcctttcaaaaatgtttcaggaaaagacttttgtatgtttattttttttctgattgcatagttctaaactaggatatcaatttttttgcattatgtcacatttgttattatttaaaacatagtacatatattcagagtctgtgagtttatatggagatttgaactctatgactatatttatatacattcaaacacacacacacactcatacactcacaaacacctatatattgtattgcatatgacatcctaaattttcttatatttttctttactttcatcttatggttatgagacagactttctgttcatttttatttgtaacaattctccattaaataatatattattctcaaaagcaaattatttgagactatagttctcaaattttcaagaattttccctatcagctatatttctttagaggcttatagtgatttttctaaaagatattgctttttgtgggatgcctcagagtatgtgttgctatttttttttctttatttgctcatttggactccagttcaactgcaagaatattagaatacttcattggtagcaaccctgagagtactggaagactactagagaaaaccatgccacacagctgtagcttaaatagaacagcagtagcctattagttctcaaataaaaatcatgtcacgttcacttatgtaagcctattccccagcagccctaagcacagcacagacactgaataaaccttcaccaaatatgcaaataaatttggtaaattgtagacctccagacacatttacccttatatggagtactaaatatttttattatttctagcaattacaggatcacttactatgtatacattttgctttaatttctaatattattaatttaggtaagagcaattaaatgttttcactaatcttattaaaacaaaaaaattaatagatttttcaaatgtaaaaaatagcaactgatttctgttataagcatcaagaaaagtaaaatgtgttaacttaagcaaaaatagtaatatattatgtcaaaaatatgataattttataatttccaggtttacatcatcattttcaatggaaaggattccatttggttttcaaactttaacctacaccaaatgtgaacgcgtttgagaatttgaactgaattgtttaagccatttttgagttacgtgaaggtgagagtacatttttcatgcacctagttaaagcaggccccaaacttttctactgatgcatgtcacaaaagactaatgatatatattatatagtcaacagtattattaaatttcttaccaaaacctctaaatttaaaaggaaaaaatcatttttaagatgacaaaatttccatttatgagtccaagaattgctaatagaagattgtagtttaaaaggaaagaaaatacaattaaggtcaactcagatttctgtctaaattagatagaaaatggatataggacaaatatcaaattagtgtagcatttcagggcagaaatgttatgaagttaatgcactttaaaatgtaaaagtaatttaacctcaaccttttacaatccacctagagggaaaagcagaagctgaaatagaaattctatgccaagcacatcctctagtgagttttgatcacttaaaacttgagctcctcttaagcagcataatgggtaaaatatccattatgaagtgacataaaataaatttggaattatatatcacatcactaattatttcttaaacctagctaagttttatttaattccctgagcaaaaagtgttcaaatttaagacggagaaataatatattaaatgtttagaatgttaagggggaaaatatgatgtcttttttaacttgatatttgtaaatggcatgtcatatttttaaactcatttttactccagcttgctgtagtacttttgggtctctactcacttcctttccagttaccaccaacttgataagcctgtcctttatgtcattagtcaaatcagtgatgaaatggttgaataggatggggtcaggggtattgcatcattcatttatagagatcattatctgtcagcattatatgtaataggaaataagagactctccaagtactgagcagctctgtagtatggtttaagatagtatcgtaagaatttagcttggaacagtatgaaggctgcatttgcctgatacgcaatgttccccttgacatatgggaagcagaaccttagaatgttctacaaacctcttttccaaccaccatccagtgattatgggtggaaatacataaattcaccagataacttagcctgtatctcaggttcagtacattttcataagttttaatacaggattcttgtattgtagcgtggttttaataaggagtatacccttaacttggcatggtggcttacacaagtaataccaacaatttgggtggtgaagatgggaggatctcttgaggccaggagtttgagaccaggctggaaaacacactgagaccccatctctataaataataataacaacaacaataataataataaaattttaaaaagtaaaacacccttaatttggttccctttttagcaattggtttcttttggaaagggtaagaggattttgaaatttctactcccttaccaagttatttttctgtgttagagcttattcctgagtcctatgtatttgcttgaacttgtacttataactatgagcataatttttaaaaataacatttataaagcacttaatatgtgccaggtactgttctaagcaccttaaaaatattaactctccctattttcctgacaaccttatgatgtaagtgctattattatctttcttttacagattattaaactgatacatagagatgacagttaattgagcaaaacgacacaatcaatacgtagtgatattgggacaccaacctagggccatgtagctctagaattagagctcttcatttctcttctctttggcctatttctgatatcacatgccatgctgaaccaaggggtatgtacaaattgtgtagagaaatgagaaataaggagatacttctgtcaaacacttaactctctgcctaggaatgcaataaaagaaattgaggaaaagcatgtatatctaataatgactgtgtaacatctactgacaggtagataaatcaaattcagaacaatatgggaggagtagaatgcaaagatgttttttgcatttcacttaatatgatatttaacaatactctttaacaacaacaaccaaaaaaaaaaacataaagagatggctcataaaccatgctcatacatttcaaaaccaacaaatagtttccttatttaccagagatcttatcaaatgtaggcaaactaatccagtttttctttttattcagacaatgatgattaataaaaagatgattttgaaaacattgagttcttattcattcaatagatgagagaacacaagtctctctactaaagatttgtcagatacactataacacagatttaatcaaaagtcactttgtatatagtttgtaaagatatttttttccttctaagaacctttattactggcagctgatatttcacaaattcaccaaaatgcattcaacaaatatttgttgagtgtcagcatgtacaatgctgctgtgttccatgctcagttctgtgagcatttcaaaatgagagagattctgccaaagagctttaccaattagttacactgatgggatttcctagtttagctgtgctgtgatcttgatgcactggagaccatgatgtagaatatacagaattattataaaaatagatagcaactgtgtgttgttaaaaataaggtatttccaaaagagagtactgagttttctttctgcttattgaaagagctattactccactacactgaagcagaagaaatatgaggatatagaaagattaaggcctattgaggattcctgtgaaacttttcaaagctgtttcagcatacatgctaaagttgttaccacttaactaattttagcaatctggaacactgggattgctgcagtttccgattgccacaacatcatcaattctgctcatgctgagttaggttcatttaatttcaattagcatttattgagctcctatcttatactgagctctgattggagagatgagagaataaactacttctgtaataaaataagtgctcgataacattatgttgcatagcactttcagatgctagtttattattattattattattattatactttaacttctagggtacatgtgcacaacatgcaggtttgttacttaggtatacatgtgccatcttggtttgctgcagccattaactcgtcatttacattaggtatttctcttaatgctatccctccccctgtcccacaccccatgacagaccccagggtgtgatgttccctgccctttgtccaagtgttctcattgttcaactaccacctatgagaacatatggtgtttggttttctgtccttgtgacagtttgctcagaatgatggtttccagctggattcatttccctgcaaaggacatgaactcatcattttttatggctgcatagtattccatggtgtatatgtgccacattttcttaatccagtctatcattgatggacatttgggttggttccaagtctttgctattgtgaatagggcctcaataaacacgtgtggatgtgtcttatattagcatgatttaaaattctttgggtatatacccagtaatgggatcactggctcaaatggtatttctagttctggatccttgagcaatcaccacactgtctttcacaatggttgaactagtttacactcccatcaacagtgtaaaagcattcctatttctacacatcctctccagcatctgttgtttcctgactttttaatgattgccattataactggtatgaaatggtatctcaatgtggttttcatttgtgtttctctgatgaccagtggtgatgagcattttttcatgtgtctgttggctgcataaatgtcttcttttgagaagtgtctgttcatatccttggccgagtttttgatggggttgtttgctttttttcttgcaaatttgtttaaattctttgtggattctggatattagccctttgtcagatgggtagattgcaaaaattttctcccattctgtaggttgtctgtttagtctgatagtagtttctttggccttgccgaagttctttagtttaatttgtgtattttggcttttgttgccattgcttttggtgttttagtcatgaagtccttgcccatgcctatgtcctgaatggtattgcctaggttttcttctagggtttctatggttttaggtctaacatttaagtcttcgattcatcttgaattaatttttgtataaggtgtaaggaagggatccagtttcatctttctacatatggctagccagttttcccagcaccatttattaaatatggaatcctttccccatttcttgtttttgtcaggtttgtcaaggatcagatggttttagatgtgtggtgctatttctgaggcctctgttctgttccattggtatatatatctaatttagtaccagtaccatgctgttttggttactgtagacttgtagtatagtttgaagtcaggtagtgtgatgcctccagctttgttctttttgcttaggattgtcttggcaatgcaggctctcttttaattccatatgaactttaaaatagtttttttttttttcaactctgtgaagaaagtcatttgtagattgatggggatgccactgaatctataaattaccttgggcagtatggccattttcacgatattgattcttcctatccatgagcatggaatgttcttccattggtttgtgtcctcttttatttcgttgagcagtggtttgtagttctccttgaagaggtccttcacatcccttgtaagttggattcctaggtattttattctctttttagcaattgtgaataggagttcactcatgatttggctctctgtttgtctcttattggtgtataggaatgcttgtgatttttgcacattgattttgtatcctgagactttgctgaagttgcttatcagcttaaggaaattttgggctgagacgatggggttttctaaatatacaatcatgtcttcagcaacagggacaatttcacttcctcttttcctaatttgataccatttatttctttctcttgcctgattgccctggccagaaattccaacactaagttgaataggagcagtgagagagggcatctctgtcttgtgcctgttttcaaagggaatgcttccagtttttgcccattcagtatgatattgtctgagtttgccataaataactcttattattttgagatacattccatcaatacccagtttattgagagtttttagcatgaagcgttgttgaattttgtcaaatgccttttctgcatcaattgagataatcatgtggttttttttttcattggttctgtttatgtgatggattatggttattgatttgcatatgtcgaaccagccttgcatcccagggtgaagctgacttgattatagtggataagctttttgatgtgctgctggattcggtttgccagtatttcgttgaggattttcacattgatgttcatcagggatattggtctaaaattctctctttttttttttttttgttgtgtctctgtcaggctttggtatcaggatgatgctggcctcataaaatgagttagggaggattccctctttttctattgattggaatggtttcagaaggaatggtaccagctcttctttgtacccctggtataatttggctgggaatccatctggtcctcgactgtttttggttgatatgcaattaattattgtctcaatttcagagcctgttattggtctattcagagattcaacttctcctggtttagtcttgggagggtgtaggtgtccaggaatttgtctatttcttctagattttctagtttatttgtgtagaggtgtttatagtattctcagatggtagtttgtcttcctgtgggattagtggtgatatcccttttgtcattttttattgcatttattttattcttctcttttcttctttattagtcttgctagcgatctatcaattttgtcagtcttttaaaaaaaccagctcctggattgattgattttttgaagggttttttgggtctctctctccttcagttctgctctgatcttagttatttcttgtcttctgctagcttttgaatgtgcttgctcttgcttctctagttcttttaattgtggattttagatctttcctgctttctcttgtgagtatttagtgctataaatttccctctacacactgctttaaatatgtccgagagattctggtatgttgtgcctttgttctcattggtttcaaataacatctttatttctgccttcattttgtcatttacccagtagtcattcaggagccagttgttcagtttccatgtagttgtgtggttttgagtgagtttcttaatcctgagttctaatttgattgcactgtggtctgagagacagtttgttgtgatttctgttcttttccatttgctgaggagttctttacttccaactctgtggtcaactttggaataagtgcgatgtggtgctgagaagaatgtatattctgttgatttgtggtggagagttctctagatgtcgattaggtctgttttatcagagactaggattgcaacccctgcttttttttgctttccatttgcttggtagatcttcctccatccctttattttgagcctatgtgtctctgcacatgagatgggtctcctgaatacagcacactgataggtcttgactctgtatccaatttgccactctgtgtttttaattggggcatttagcccatttatatttaaggttaatattgttatgtgtgaatttgatcttttcattatgatgttagctggttattttgcccgttagttgatgcagtttcttcctagcatcgatggtctttacaatttggcatgttttgcagtggctggtaccggttgttccattccatgtttagtgcttccttcaggaactcttgtaaggcaggcctggtggtgacaaaatctctcaccatttgcttgtctgtaaatgattttatttctccttaaattatgaagcttagtttgagctggatatgaaattttgggttgaaaactcttttctttaagaatgttgactactggcccccactgttttctggcttgtagagtttctgcaggtagaacttcttttagtctgacgtgctaccctttgtgggtaacccgacctttctctctggctgcccttattatttttcccttcatttcaaccttggtgaatctgacaattatgtgtcttgtggttgctcttctagaggagtatctttgtggtgttctctgtattacctgaatttgaatgttggcctgacttgctaggttggggaagttctcctggatgatatcctgaagagtgttttccaacttggttccattctcctgtcagtttcacgtacaccaatcaaacgtagatttagtcttttcacatattcccatatttcttggaggctttgtccgtttctttttactcttttttctctaaacttctcttcttgctttatttcattaatttgatcttcaatcattgataccctttcttccacttgatcaaattggctagtgaagcttgtgcatgtgtcatgtagttctcgtgccatggttttcagctccatcgggtcatttaaggtcttctctacactgtttattctagttagacatttgtctaatcttttttcaaattttttagcttccttgcgatgggttcgaacatcgtcctttagctgggagatgtttgttattactgaccttctgaagcctacttcagagttattctccatctagctttgttctgttgctggtgaggagctgtgatcttttggagaagaagaggtgctctggttttcataatttacagcttttctgctctggtttctccccatctttctagttttatctacctttggtctttgatgttggtaacctacagatggggttttggtgtggatttcctttttggtgatattgatgatattcctttctgtttgttagttttccttctaacagtcagatccctcagctgcaggtctgttggggtttgctcggaggtccactccagaccctgtttgcctgggtatcaccagtggaggctgcagagcagcaaatattgctgcctgttccttcctctggaagcttcgtcccagaggggcacccacctgtatgaggtgtcagttggcctctactgggaggtgtctctcagttaggctacatggggggtcagggacccacttgaggaggcaatctgtccattctctgagctcaaacaccatgctgggggaaccactgctattttcagagctgtcagacagagacgtttaagtctgcagaagtttctgctgccttttgttcagctatgccctgcccccagaggtggagtctacagaggcagtaggccatgctgaactgtggggggctctgcccagttcaagcttccccagctgctttgttcaactactcaagcctcagcaatgacggacgcccctccccctgccaggctactgccttgcaggtcaatctcagtctgctgccctagcagtgagcaaggctccgtgggcatgggacctcactgagccaggcacgggatataatctggtgtgtcatttgctaagaccatacctggaaaaacgggacactcccacccaaatactgcactagttattgttttaagagcttttcaaatattaactcattggaaaaataaaaaaaaacaacaaaatacagaaaattcaataaaactaaaagctcattcttggaaaagatcaacgaagttgaaaaaaaagtttaccttgattgatcaagataaaaagagaaaactcatgtaactaaaagtaaggaaactagaaataactaaaaatcaggaataaattagggatattactactggccttacagaaacacaaagaatattaaagaaatactatgaacaattgcatgccaacaaattgtataatttcaatgaaatggaaacatttctaggaagacagagactttcttaagtgatgaccttgatttcttttatcacatagaatatgaaggtcattgctcaggtttagaagggccaagcctggatagagttggtgaggacagtgataaatgtttggaggagccatgtagccacaagataaagctgaacaagggctaggcatagtggttcaagcctgtaatcttagcacttggggtggccaaagttggaggatctcttaagccccttaagttcttgaaactgaactcaagaagaaatacacagtatgaataaacctagtgaagagattgaactaataaccaaaatctacctacaaagaaaagttcacatctagatggtttcaccactaaattcaaccaaaaactcaaggaagaattaataccaattcttcataaactctttcacaaaatagaagtggaaggaatatttcccgattccttttatgaggccagtattaccgcctaccaaaaccagacagatgtatctcaggaaaatatagtccaatatccactttgaatataggcataccaatcctcagcaaactactggcaaactagatctagccacatataaaagaaatatacacattgaccagatgagatttagcccaaagaatgcaaagtttatgcaacatcctaaaatcaactaatgtaataaatcatgtaaatagaattaaaaaataaaaattacatgcttaatagacataaaatgcatttgacaaaatcaacacattttcatgtaaaaaacactcaccaagctatgaattaaaaagaacttcctccatgtattaaagagcatgtatgaaaaacccacagataacatcctagataataatgagagaaggaacactttcttcctaagagcaggacaaagaaagaatttccattctcaccaccaggagaattaggcaaaaaataaataaataaataaataaataaataaataaataaataaataaataaaataaagtgcaatacagactggacaagaagtacaattgtctctgtttgcagataacattatctaatagaaagtctcaaagaaggccaggcatggtggctcacacctgcaatcccagcactttaggaggctgaggcgggtgaaacacctgaggtcaggagttcaagaccagcttgaccaatatgtgaaacccggtctctacttaaaatacaaaaattagccaggcgtggtggcaggcatcttagtcccagctacttgggaggctgagataggagaactgcttgagcctgggagtcagaggttgcagttagccaacattgagccactgcactccagcctgggcaacagagtgagactccatctcaaaagaaattggaaaaaaaaaaaagaagcaacttaagaaccacaaaaaaaaaaaagaaaaagaaaaggaaagcaaaaacagagtggttactaggatgggagaggtggtagagggaggtcatgaggtcatgacaagatattaggtcaatgagcacaaagttgcagttatataagatgaataaatgtagagatccaatgtatgacatgaagattatagttaaaaatattgtatcacctagtggaaatttgcaaagagaatagattctagctgctctcaccacaaagaaaaaaagtatgtaagatgaaaagatgattggtatggtaatttgcttggctgtagtaaccatttcactatgtttaaatacattaaaacactatgttgtacaccctaaatatatacaatcaaaaagagtaccaaatatgaatctttcctataaatgtaaaatataaaatgtgcaacaattatgaatggtccatatgcatattttcttgggtattcttaaagtaagttttaaaaacatatatatatatagagagagagaggtaaaattaaaaataaatatattatcattttactgattttgcccccaaataacaaataatttacttatcaaaactgcttcttggaaaagtattgtcatgtttaatttcataaatagctttaaaattttaatgtaatgtattttataatttcagaaatgtaaatttagagttagctctagtgccttttcaacatcacctgcaacactcttaagttaactatgcagcagtaaaaactcatttcaagatggatttttttaagctgaaatactgaccttcaagttaattgtaatatactgtttctacttattcctaggtttgctgctcaaaactttccaaacactataattctgaaagctatctgattgtcttttcttttctacatttcaagaatacaagaaacacagtaacatatcagtaattatttttgaaaataattacttttaaaactttttagtagagtcctattataaaaacttaattttactcagtgcattatttctaaaaattaaaataacaagaaaattctctttgaaaatatgtgtgacataatatgtcaggtgatagattaaatatcttttcaaaatatacaatgtattgtgtttttctcatcaccgtcaattatatagcattaacgtttattagactatttaaaaataaaaatatgttagtataattttttgaataacttaagtcaattgaattgagtctcggtagaaaataatgaccaactctagacattacacttcacattttattggactacaaataatattgtgaaataaaatttgatataaacactattaattgcaagagtatagcaattaattaagctatggatgtttgtgtcagtgttttttatttacagattaacaaagtatagtctacatttatattcataattataaaagacaaaacaaacatattgctttattccactttctagaaactggctcatagttaaattgcttaactcctgtgatttgtaagaattagcgtgataaaagctggcatgattttgtagatctaattatatttttgctgttacctgataacagttctgtttactttattttttaccaattatctgtctcctaaattctgtaaatcacagaacaacttcattcaatatttgctctagaaattaaatacctactatatgtcacttaaaacacaacttacattaccaaatcaaagaaattgtgaatcttgttatccttagtttgacaatttaaagcatacaagcaatgcattgaacctttaggtatttagtaaaggaattaagatcttggtttcagagactacaagagcactttacatcgaattgtttattcaactagaaaatatttcagtagttgaatacccttggatccagcctactgaagtcccctcacacatctactcagttcctcatatttacttctaagcacttgcaatcttagtcatacttataaatgaagggggacaccttttacctgtgcagggacacatttgataagtaataaaaataaaagatactctccatacaaaattgcacagacacatcagtgttcatgtaactcagagctgtcgacttcctgcagtgcacatgatcatgggtttctggctccactcttgcttgaacacagcacacaagcacaatgcccttccctggaaccttcataataaccctgagtgcagctaaccttggcctggaaaatcatcagctacttaaaattacagctgcctgagaaggaaattcccctgaggtctaaattaaaccctgaaaggtgtaattgctctccactctttcctattccccgctacctcaccacctcacgcttgcactccctatgaatttccatgcctgtattcttggctatgttgttaccagctggtgcttatcttatttccttttttccttagttacagcacaagatgggtacttctgttcacaatgatatagaccctgtatcattcccactgtttgctgtttcctccacctagtatgaagccccctttccacccatctccagctactctacacacactttaaatcatttttattatgagcactggaactcctttccatggttaacggacaatgggcattccccgtggccctgtcaaggtgagactgttgactcccaaattccagattactctttcttccctctcagaactgcttagatgacacacttcctataagtgtcacttctttgggactcgttttgaccacacagctagattatagacttaatgaatcatcattattcccatttgtattaacagagtctaaatacaatgcctgtatataacagtatgcctcattaaaacatatatatatacatatgtgtgtgtgtgtgtatatatatatatttctttttttgtgccacatacttctcctgtgggagaagagaagtatatgcaaatacccattatgttttgatgtgaaatgtgcctgtatatttcttacttagagtacaaaaactgttgtataatttcacagacacacttggtgctgaacagcaacaacaaaaatcaatagctatataataaaatcatttacaacaatgatttcttctattagaaaatacagtttgaccaaagtttctgtttaaatccttgaaattgatttctggaaaagtttagttttcctcagcaaccacaagctaagtttctctaacaacatcttacaaaatttttaaattaactgaaacatctgcattcatgctggctacatttttatctgtacggcataaatattatttatatacttgttactcaatataacattagtcctagagtcagaagccaactaactatattgcatgatttgtatctactgaagtctgtttcccaacatcatctactagcaacattaggattttgtcatattgtttaagtaacccttaagctaaaggtatttccacatcacctttaattttctccagtacatcccgaacaaaaagatatacttggagcaatcttccgagcattctaacccatttatggatttaagttgaaagttgaagtagtaacttttttttttttttttttttgaaacagagtctcgctctgtcgcccagactggagtgcagtggtgtgatctccgctcactgcaagttctgcctcccaggttcatgccattctcctgcctcagcctcccagtagctgggactacaggttcccggcaccacacccagctaattttttgtatttttagtagagagggtttcactgtgttagccagcatggtctcgatctcccgacctcaagtgatccccccgcctcggcctcccaaagtgctgggataacaggcctgagccaccgtgccaggcctaagtaacttttcaactgacacaacaatgaacacacattaattttagtttcataaagtaatacaacgttacatttaatcattcctttttgtattgactatgaaaggttagatttgaaacactccaaaatgctctctctatattattttgttatggttaacttaggctaggatcatactcttctgactgttaattttacaatggccatttgacaaatgaaattacattgacctaatttgccagagaatatgtctaaaacttattgtttaggagacaacaatttctcctctctgtctctcaatctctttctctcattttcttttttttcttttgaaaatcagaactaaattattctcctcttttctcagttttgataaagtcaaccttagtgtattcaaagtcaaatgactttagtgaacacataatattaatccaccaattctagattatgttatattttgcctcctagaaacccatataaccatgcacctgtacatcttaacatatcttaaaaacattgaggggtcattttctatgaagcaggacttcttaaaaatattttgtgccatggacgactttaagcctgataaagcctctcttctcagaatagtatttttaagtgggtaaaataaattaaggagaattataaaagaaattgatgttattaaaacaaatttgtattcatgtttattttgtgagggagtctgtgtaccccaagataaattcatacaattcaaatatactttaattacatttaaccatgaaaaatcttgacctacttatcaagtaaatattatattgaaatacatacaatttcatcttaaatatattacataactgaaagcaagaaaattgtaaatatatttttataaaataattgtttaaattcatggaataagcaaatacataaaaatgccttttggatatagaggaaacaaacaatggaaggtgataattttagcgtaaactcattcttacctttatggcagtggatgcaatttgaatgtggtgaagtctccgaagggtgctgtccctgtcaatgaaataagaagcggctagctgatgtagcgtctccagagtgaccgaagagctattggtggtggaatcacttccttcagctcgtttgctcaacttccgcttgtccacaaaaattgtgagtgactcctctcctgcattaataatatttcaaattattcaattttccacttaaaatctttttttttaacttatctgcaggtggaaaggtctagcttatgaatatagtaaaacaaaggagtgatatatgccaaaagggcaaggggttttatttttggtcacagatatttctcaagtacctcaaaaagtgcctgggatattggtcactttaaacacgtagttactgaatgtcagatatttagcttttgcagaacagtttctccagattttattgactttctaacaaagtttagcataacactcatatggtccaaaataaaattaatttatggaaaacaaacaagtgaggggcataaaatgaaactgtattttactcagggccgggcacggtggctcacgcctgtaatcccagcactatggaaggccgaggtgggcggatcatgagggcaggagatcgagactatcctggctaacacggtgaaaccccgtctctactaaatatatatatatatatatatataaattagccgggcgtggtggcgggcgccagtagttccagctactccggaggctgtggcagaagaatggcgtgaacccgggaggcggagcttgcagtgagcggaggttcccgccactgcactccagcctgggcgacagagcgagactccgtctcaaaaataaataaataaataaataaaaagaaagaaattgcatttactcagaaatttttaccatagaatagaatatccaaatggaaatatgacaaagcactagttttcatctgcacctttaaaattcagataaagcatgtgtatgcatatacaggtatgtatatatatgtaataaattcagaatttccctgcataggatatattgaaacattgtgtgttaatacactgtgtgaaaaacactgaaatctatgtaggatttaggtagtagcaattggttctcaaacgtaaaacgtaaagtgtattacaattaagctgaacttttcaatgtccaaaagacaaaaatccatgtcattgaagttagacattaagaacttgtgatcctccgacaaacatattatcggatactcatctagcacataattgtcaaacttgctgttttcattctttcagcaacccttttgtttgggtagtattgtgcccatttataaactaataagtcacttttatgaaaaggcaaataagtttgtctaatagaatagtttgcatttcctctctttcttacaataatatcaattttaaaatgacatagcccaggtgacaatccaatcttaagtaagagctcttacatgtctaccagagatcagttcagcttctctcagaaatagatttcaacaaatattatttctaaaactcacatttcttgttggtatttggaccccaacatgcatattagaaatcagttagaggaaggagaatagtttaagaaaaaacatatatctcaagaataaataggtgggtcaaatcatcaacaatattaggtagtgtaaatgaaaaacagctttggagtagaggcagctaaaagagaaaaagaatacatacataaatgctataaaataaacaaacaaaaaatcccctacaatcattctctccaagaaaaagatcaacaggtgaggaaatttcaggaagtgcatctcagaatgaccaatgaatcagaaaaactcatccacgtgataagtcgtgagagtgccaaaacatacaaataccctgtagatagatgtagaaagaacaccagtggtatggtggtctaagtaagtactcacagtgtagttctgtgaattatgcaagagacatgtctaaataaggaaaattaaaaataaaatgacagagacatcttggtaaatgtagattaaaaataaagctaagaatcttgatattagagaatttaggtgaaaaattattaaatgagaaaaaatagcaatgtagtgctagtaacagaaacttgcaacgttgctttaacagcaacacttttcataaagcacaagatacaggagcaatagacatacactgatattatgagacttcaacacatatttctttctaggtacaaaggggataaaagtaatgatagaaatatatacaacctcaaaataaggtagatcttatcaataaattgtaaaccttatgttaagaatagtgcaaataaaacttactttcaataatacacagaacatttacaaacggtgaccatgtattttgttacaaagaaacctttagtaaattccataaatttgtaagaatatagtatgactcactgatggcaataaaaaacctaaaagttaacagaaaatttaaaaagatattactattacatgtgaaaattccctattgtataatatttgaatgataggctaacttaaggcaaaattacaaattttaaaggaaaatgttatacatcagaatttaaggaacacagctaaagcactgctgagagaaatatctataacatacatgagttaactacatgattctaaaatcaaaaaaatgataaaaaagcttatatccaataaaaataaatacaaaggtaaaagcaggtgttcgttgttttttaaaagagtggaaacgataaacacaaccaaaagtagcttctttcaggagaaaaaacaccgattagttaacctactttttttcttcatggaaaaagaaaattacataacgaattgacagaataaatatataataaaacagagaatagagcatttacttaaaaacagggaagaattattttctaaaccatattgcaaataagattaggtgttacagaacaccttccccacaaccccccaaaaaattaacatacccaaatagttcacagtggatttttgcctgaagtttaaatataaaaaaattgataatactgaaaatgtaaaacttctaaatctatttttataaactgagtgtaagattagcacagatatctaaaaatcatcatatacaatatattttacaattaataaatattgaagcaaaattatgactaaaacaataatgaacaatatccaacagtaactattaaaaatgcttatctcatgaccaataggataattccaatactgcaaaactggctcaatagtaggaaatcattaatataattcagcatattaacacatccagaaacaaaaacgctgctatcctctattacttaaaatacatttatgaataattataactatttatgattaactaagaattaataaattaggaatcaatgaataacaatgttttttcccatagagatggagtctcactgtgttgcccaggctgatctcaaacttctggcctcaagtgatcctcccacctcagcctcccaaagtgctgggattgctgccatgagccactccaccttgtaaatacttctttaaagaagtgaaatataggatcctaagcataaaagccagcaactttcttaatggggaaacacaggaggcatctctattaaaatcagaaccagacaaacatacccacagttgcttctattattcaacatgctaataaatatattaaaatgtaaacctagaagagaatgcagattagaatcacagtgtcagaaaaaacacttaaactatgtttatttcgcagataatatgattatgcaggtgaaaattcaaaatttaatagacaaactactgcacatatacagtaacaaaacttagtaaggtacaagcaaataataaaaatattactatctcaatagactgaaacacacgaatattatctaagcataaataataatggattagatcacaccatttaaacagcacaaaaaatgtgaaacatacatgaaaagatttgtaaatcacttctgaaagttgccataatagaccttattaaatgacatgatcgattttttcttgagcataaatattcaacatcaaaatatatcagtttatattaatattttgtttcctggaagtaggaaaattagtcatgtcagcaatgaattgtaagtgaaaaaagtaagaaagacttaaaaagaataggcaagaatgagaacatcttaccatatctgaatgcaaattgtaaaatctgtataattaaacagtgcaggctgacacatgaataggcagacaaagtagaacaggaaaaatatccataaaataacaagtacatgtggaaacttcgcatgtaataagagtgggatagtaattccttgggaaaagatagactttttactaagtgacacctaaatagcaatttggaaaacaagggagatgattctatcaaaggataaactccaaacagattagagacatgattatttaatgaaatgaaaccatttgagtactagaggaaagttcatgaaaatacaaaggaaggaaataattcataactaaaaatccaacagtaaggacataaaacattcatgaattagaacaagtaaaaccagattttttcagcacaaaatcacaaataaaacaaattgcattgatacggaatatttacaacttatataacggacaaatggttaattcctctaacattccaagaactcctagaaatcaaggaaaaggaaaacaagaatcagacagaaaaacaggaataaataggaaaagagtgttcagacaaaaacagataaaactagcccacatagatttgaaaatatattcaatctaagtcatagcatgagaaatacaaattaaaagtaattgctatattactttgcaatgacagaatttgctaaaatccatactttgacaacttgggcaaatctattggaaaagtagaaataaacaggccttctgatgtattgttggtgggattgcaaaatgatacaacttacatacagggaacattggcaatatatatcaataatctactccacaatcctactttttagaatgtatttcaaaggatgactgactaaaacatgcaaaacatgtctcactgtggctttattattgacatttggcaacaacataaatgcccatcggtaggaataaactaggttacaaccatacggtagaacactgtgcagccagaagaaggcagcaaagattatttctacggagatctcataaagtggataaaaattgtttctgaaaagttttttataagaaaagggtagatacaagtataaagatatatgtatttgtttctttttatttggaaaaaagcatcaaacactggaaggattaaccaaaagtatttatgaatatttacctacaggaacaggaaaatcaacatagatagaaatatgatatttaaagaaacacttttggaagaaagtttcctctgaacatattttatcatgttgtttaggcactagaaacatttttaaaattatttattatttatttataaaaataaaattatatcaaattttaaaagccatccctaaaaaataaaaacagaatccagtgatactaattgtatatcatgtttgtaaaaataagtgacttaagaacacattattttgaatgtaaatcaatttttggaatatattctgaagacgaataaaggtacaaagaatcaataaactttatacctggtgcatgagcagcatactcatagtagtacggttttatgcagtatgttgttacatatgagtatatgggtattcattgtacaaatatctctattttgggtatctttgaaaagtcattgaagacaaaatcataatgggacgagtattcataactcctgttctacatctggcccaggtttaaaatatattgttttataataaaaatatcctgaagtaattggtaagttcataaccaatactatagctaaaataaagctctaaaggattcggctattcccagatgattacacttggaaaatgcattaaaatgttgaagaagcatccaagatcaaccctcatgcattcaatgttttatacacattcttgtatttggaaggagacttccacgtttttaaaaacataataattatatcaaatattttcttcaattgagtaatatattaaattcaaaacatttgatccaattaaccaattggacattagttttgcctcctggagatgcaagaaagccattttaaatatgtgaaaagagtcattttcagtaagtctccctttgtatggtagtgaattttcctattactgaaggtgttgcaacattaattgaaaatctatatgttgttgaacagaagagataattagaccaatagaaggcattctttcactggtttatgaggtcctggaagacagaaatgtataatcagttttagtttagatgtaagtgtaccaagttttactgtcaaacagatttgggttctaatgctggtttcaatttagtaactgaatgatcttgaacaacacatcttaggactcagtttccttttatggaacattagcatagtaattattttctcaaagagcagttgtaagctgaaatagatagctgtaaagggtttgtaatatcactggaatctagtaataattcgaaagttgttaatatattattattctcttttattcaccactattattcagagctgcataaatcaactcattccatacctagaagtttctagtaaatttagctagtttatcttatttgtgatgagaagttggcctttctacttttacaaattctttaaccctgtcctatagtctgcaatgatatacagagagtaaagatctcccaccacagttctttaaatatcatattgctatctatgttgattttcagataaatgcttttcagataaataccgcatttctacatatgtctttgcttttcaggtaagtatggtgcatcattaatttcttcttaataggattccaattgagccatacttcaccccccaaaatagctggagcacatgctcattattaaacagtgaattaaaaccaatttgatttaggaatacttcgcacatgttaggttgtcctatgatacaactggaaagtgacacataacaagaagtagggatcaccattttagcatagtccttattgtaaggacatggatgataatacaaacctaatacatgttgaggcaattaaagatgaacatagtaaaatgatggtctaacatcatcatcacaaataagagggatttcatttcctatctacaggagatttaaaagtctttttcagtgtccacatttgcttgtaagttacagattaatatgacttcttacttctgtcgtgaagaatatgtatttcagacaagaaaaatcagatgataatatattggtgtataccataatacacttttattactaattctatattgcttgtgttttaattggcttggcttcaattaaataattctaaaggcaatatgacataatgaaggcaaatgaaacatgaggtttagagtcaggtatgtaagggcaaatcctagtaatagcacatcatctctctacttgttgactgtggggctttggtaaagttgcatatgtacttagcattcccatctctaaaacaaagaaaatattcttctttcaattatctgggaagattaaataatataatccctctacagtacctggtggattatatgagtgcaataaatgttatctttctctcttttcctttttattaagacctaacagttgatgaggaagtttaaattttcataagctaggatttcatagttttttaattttaccacaggaatcaggacatagtcataattgtttctaatggtttttataatcaaaatatataggattactaataatagtagtgggttatcatttctaatagcctgataaagataatccattaataaattgctcatggttcttctctacagtataattttaatccatgtatacaaaagctttccttgtagatatgcatgtaaggcaacttaaatctgcagtttaaatcaccataatagttcttttaatgaatatcctgtttaaaacccttacttacaacagagcacatgactatttgatgtaaacttgttgccttgtgctaaccttcaacttttataaatcatggattgttgaatatttaagaaattttgagaagggcactcaatttacatggagaataggcctttctttcctgtaagagatctgtttttttttttcaattgtgcataactatcatacttttgtaattatcttcttcacagttgtttgagaattttacgacctgagaaaatgtattctcaatttttactgtaacttttccacaagtattaaattataacaattcatcagaacctatgtaaatgacacacaatgttcagattcgaaaactgaaatagtgttattcaatcaactaaatgattgcgttcaaaagtcatttttgttcatttttttaaaccagctgtagctcataagcatgacatgggttccaaaggacatccacacattttgtagaaactaaatgtgattttgaaaatgattcaacattctgagtctgttaggcagcaaaaggattaatgactgtggatataaaaagatgtgattattccacatagaaatcatgcagctgtgtcttgtgcaactaaaattttgtggtggtttatggtcattaaaagcacatattgaaggatgctttcatagaaaatgggaaacaggggacaataaaacaaacaaacaaaaaatcaccattttaatgttataccatggctggctcatagaatttgacattttttataagatatggcccttaaaattatgtatttttccattctgatctttaaatcatctatgttgagtcaatgagaaatagaaattaaagaaccttcatactgtttacttctcacttggattttctcaattggcattctcatatatatagttattgagggtagaaacagactaaaaataatagataaaacaatgatacgaagaatcctacaggtaaatcaacaatgataatgtggtagattattttgttctttgcaactacttacaacaccatcataaatgcaaacatgcatacatagtttcatgatccattgtagagaacaactatgagcagttcatgatgcattatatttattctgatattagaaggaaggagaatgctgtgatcagtgaaatgcaagtgagccagatgttgatataatgcaagtttggacagtcatcacaaaattacacctgttctcttgctttttacccctaccaggaggatggcatgttgcaaaagagtccttcttcattcccaagacacatagatcagaatcacagggtacccacagaaaccaacatataatattggtcagaagcaacaattattgttatgatcaactaaaatttgtgtcttttttttttactaccatgaggctgactcttatgagttggatgtattttattttatttcgcgattgccactgcccttgagttagtccattgtcctataatgtttacattccgcccagaaaaaaaattatgtgcatttatggcagatgtcttcccggtcattcaacttccttacatttgaatatcttactctgaatgactgttttgccttggagtgatttgtagttattaaaaaatgctatttgagtgaaaatccttctcacagaaatatacattgaaaacattgtttaaatgtaattgtttgtaggttttacttttgatgtagccttttgcctcaaaaagatggtccattttttggcaatgataagccatattattacttgtgctaaagccttacaatattttttgttattgctgcccttttgaaattatattgagtttgcagttacatgttgctctcagggctgataatcatccttcttaagctccacatgttaaaggtacacagcctggtgagatctatctactaatctactagtatggtattgtgggggaaaaaagtgttttagaaatagatatacataagaagaaaaaaaacaatcttagagaaataggcttttgccaagaagcagaaccaaacatattaggatagttaagaaatagacatgttggcttaacaccaattggcatctgcaagatattatggggaggaaagagctaaccttatattactttgacaaagaaacataatatgttttgcaaagtatcccaaaggagagcaactgaccttatgattattaagagttaccctcaagaatagactacaaattttctaagcaaatttgaaggtaccatgatactctcgatagtagtacaataacatgaaaataaaggaactggaaataaatcgctctgaggttaggtggcaatgaatctaccctgagtgaaatacaattaagttacttctaattttggagctatttgcaatgatataacaagattttctaaaacatttttggtatgtatagttacaaactcttgctatgatttttttaagattatttctcagaacagttgattataccttaaatttatacagatactttaaacagtgttgtcttaacttaatgtgcatataaatcacctggagatcctgttaaaatgtagattctgattcattaatctgtggtggaatttgagattctgcatttctaacaagcaccaaactgatgctgatgcttttcgttcatggaccacacacaagtaatgaggttctaaaccataataacatttattaccaagttaaatgtctgtctttatcattgacctgaatgttcatttaaggaagatcttgggtgttttgcaccgtcataagtaactcagtatatatttgtcaaaaaagtagacaagtaatttatctaccttatcaatgtgctatataaaagaaccagaaaaaatataataaaatgtccaatgttctagaacttaacatttatcttttaccttggttgccacgaacacctttactaagatcaactgacacagaaattttaattacattttgctcttgtttattcttattatttacataagtgatttttaaaattgctttagtagataactgccttgtaaacaattaaaaaaagattaacaatattgctttaacttcagatattttattttatttaccagtgaaacatgatatatatatatatagagagagagagacagaaagagaatgagacagagaaactgatataatcttaagaaatatcagtgatcttaagattaattttaataaatatcagtacagcagtccttttctcccttcaatgacatttattttgattatttcctaggataggaatcttcaaaaatatttatttttctttcttttaaaacaatatatattctgagagaaagtaattctatgcatctcaagtaattattcatatttctttaagaaataaattatttatgtgtgtgtatttggtggattaactttattatgttataaactaaaatgaaataaatttgttcttcctaacagaccaagtgaaaatgagaaccacagcagttaaccaactttgaaagaaggtggcatatgacaaataattaaaaactgtctgaatactttatacagaacataattcacatagtgaaaagtgagaattgactatttctgaaattaaatgagcatattcagagttcttattcttatgggaatgcaaataacccaaaaaattataattgatattttatccatattgtatcttactaacttctgacttacactttctttaaaagacacacacacacacacacacacaatattttgtaaaactttttagataagtgaactacattggaggcatagttttacatacacacacacacatacacacacacacacatatatatatactacatgagaattgaggtagcatacattgttttaaatcactattgtatgaagttaatactatttttgcacattgatcatgaattttttattccaacaatgaagagaattttttttgtattgaaacaaaattaaatatctaaaaaatgcttaagtttagccatagagtaatcaaaatgtatattatcttaagaaatactttcagaaaaaaaattaaaaggacttgcaaatgaaaaaagtatattgtaactatttctgctaataatttaattatagctttttaaattgtacattcaataacagtggtcaaactgaacttgcttttatgatgcctagaataaaaactattcttcaaagtttttctaaattaacaaatcttattatattgtctatttgatcctgaaataaattttggttttatatatatatatatatatatatatatatatttatattcagaaaagaaaactttttccctgcattcctctacatgagaaattgttttttgtaaacaatcctcactgttaacatgtgtctgatggcccacagagctgcagtgagttaacagaaaggcatagtgtaggaaagaggctgcccatgaaaactccacctcttactcttcctccttttgtggatgtgcttgtcaggagatcacaggctttgttctgctcctcactgccttagagctgagagagacaagagtactagcggaggaactcacaggtttcctggctactatgactggttggataacgctatataattcaggagatgcggataagggcacatttaaaatttctataaatattttgttataacatttaatacatttttaatgaatattttggtctctatgttccttagtgttttgtcttttaaaattgatccagaacacagttttgttgcattatagtaaactctctttctccccctaattaaagcccaccaattttaaagtcattattttttgtcatattcacttatattttgtattttgtattcagtacacagatacactttaattttagtatttgtcatatattgaattataataaaggtattacaaaaatggtcattaaatatattccatagctagaaatcaatatttcccagaagtgcagtctttttcaagattgattctttcaattgagtagcttattttagatattcaaacagtgatggaatttagatatcattatccaaaatagaagcaaactgaattactatatcgataaacagtctggtagctataaaatgaaataaatggggaaaataatatatattgaagaatgttttttataatttatttttctctatagatagaatgataattcaatcactggctttatctgtcataaaatatcccattaaaggcttcaagtatggtacccaaagttttatgtctacatcaataatatgatatactaaataactcttaggggaaaaagccatttttcatgtatttctttttatgactgtaaaactgatagtgagtattttatagtcaacttgttttgaaaagcattgaaatttttttgaagatttaggtacttaggaagcacctagtcataatacaactggctttttgttaaaaaggtttgcttatatacattacaccctagtgttataagtttttccttggtcttcattaattaagagaaagaagtggagggattagttcaatttaaatgccacaaacctccattttttttaaatggagaaatacaatttcatgttcaatcaggtaaaacagtgaaggttaaatgataaactcacagccactaaaaagattttagtgtaagtacaatagcaataattttaaaattgccaaaatcatttctggtatacattttaatcgcagatatcttatatccttaagctatttaaataatttcatgcatcttaactgaattattaactttaatgaacaaaaattcccgcaggaaaataaagtaatattttgagaagaaaaataattccagcacaaaaaactatgaaaactcaatccaaggaatattcagagattagaaactgagtaaggttgttaattccatctctttccccctttaaggcaatacttgaacaaaactttcaaaaaactgaagtaaaatcatttagagagagcatactgccatcactggaagaatcaacctcaagtgaataatcttacaaattttgaaacatggtgtatacaaaaaaaaaacatgcaaaacaaaaacgaatcttaaggccaaaatgtggcatccaccatatcaacatagtaaaacaattaaatttaaaagtcaccataattttggaactaaggaacaagaatgtctatggaaccattggtgtttttgatctcttctgtctttcctctgtcttttccttcttttcttatctggaaaaatatattttatcttctgaaatacttacaggtgctttgaatcacttatataataataatgaagtatgtgtttcaaaatcactgaactttttcagaggaggagttatagaaataactcaaattttacctttcagattttattgcattaataataattgacattactaagccaaatagacacagctttcacagaatcaatcttcacaattattaaaatattttatatttttggctatctacactaacataatgaaaacaacttcaatgcatcacatacttaaattataccacacactgtgctaagcacagttttcaacatttatactaacctttctatgtcccatcacataggtgttattctccccttttctgttaaataattaaaatgcagaggaattacttaatagattttaaagtctcacagttgcctaaaagacggggagggagaatcaggattcaacaaggatatggctgatctctttctcttcttattttatcactattcatttgtggaacaaggtaatggagaaatagtgtgtatttacagccagacttttccatctgccttagccgcctatatttttcacctttaatgtcttgagattccatgccggagttattttccacaatgtgctcaggcatccactcctttttcaacctgttcatgccttccttatctactcttacttgggtactgattctcatcaattctgaatctttatttgtgaatttgacccagttggctctctggatttgcttgcattcagaattattcctgaattataactcaattatcctctgtttatattataaatgtttacatatatctagttatttggatgacctcaatctcctaagaaagtgtagttttacttgtttattcatttaacaaacagttaatgagaacctactgtaaatgaagggcaattatagccatggggatgaagtggtgaccaatatagctaaggcccttgtttttaagaaaatatgcaagaactacagataataaaccaatagccaaataattaaaataatttcacatgataataaatactgtgataaatgcaaatgtgatcatgaaatagtagagaacaatggggttcactgggcactattgatgaaagagtagtcaggaaaaggcctccctgaaaaaataacatttgggtagaaaaatgtgaacatcattgtgactgtgactgaaaaatagagcatgaggaagaaatgagaagaggcctgagtttaaagctagcattcacagatcattgatgtaaggctttataaaccacagggagacacttagattttattttaagtggccagttctaggtttcagttaaaacagtgaatatgaactgatccaagattttaaaagagctgtgtggagaagggaccatttgagtattgtaggaaaaaaaaaatgatgatgtcttggtctagagatgctggagagcaggtgaggaaagagtttgatatggggtatattctggtgtaaaaaattgacatgacttgctgaaagactgggctggcaggttaaggaaagacaagacatcctctaaggctagaaaatgaacaagctgccttttgtgacaccataccattgctgcgaatcagtccggctatctttggtaaacccattaagaaactgacaagaaagcagggattcactcttttcctggctttcctattcaattttatacagtgttcttcattataagaaaaagtaacatctatttctaaatgcaattgtgggacatgatttgaagtcaaacacaaaattaaatatatgtaattctgggatattttttaattttaggaaaatgtcatatgttgcttattacacattatctcctaaaaggtcatttaagtatattcaaaatgctgaatcacacatcactatgaaaaagccatatttttaaggctaaatagtatttaacaatatcacacaatagcttccttaatttttacaaatgtatacatttacatatacaaagaaagtgacatttattcatttctactttcttattatgcatcataattatttgtttatcactttttccgtaccagctacaatctgtatcaactacaatcagaaacactaaaatggtgctaacaatgtaattgtagttatttaatatgtactcaaagaaatctttccttctctctataactagaattgatgaccccacctgtgacttcttattattcatgtattttaaataaaagtttccatatcaccttacagagtgcaacaattatgtcaaatatttgtatgttattagattgtaaatagctttcatgcagaaacttagtaatattcatctgcttcacaactgtgaacactgtgtgggacatttaataatcactcaaaatgtgttgggtaaatgaatgaatgagttctataactattcatactgtagctatcttgattaattaacacttttctgcgatttatacggttttaggcacaagcacacacaggcacaaataggttcaaagagccgtacctcccagagtagcagatagcaagaaatgtgtcccatatttcttgataaggttttctgtgatttgctgaagggtaggtcgacgtcccaaaagtcttatgttgcggaagaattcaggggcaagaggcagaggagagccaaggaaatttcttctctcaactgcaaggttatttactttccagcggccaaactccctgaaaagcaaatttatttttattcataaatgcataatctatctgaatgttttcatttgagttcacttggtagctggggtcagtacattacaatgtctcttgcttgtaatactaggttgtgtgctatgagtaggagaagcaatatttataatttatttaactggagtgaatactctaaaaccaagtcatgtaaaggaaaaataagccacctaaagtgtacagcttccactgagatttttttccccaagaaaatatattttcataaaaacgactttattatgcctagaatatgaatatagagttactaaacagtaacaaaacaacttaagggcaatttttttcattttctaaggtatattggaaaaaaagaatgatttatattcatcaccctaatgattccctttctctattcactttagagtgggaacataaaaaacctcaggaatattaaggagacgcagaactttaaaaacaacaaaaaagaaatcagttttcttctttttttttttaataatcatggtttacaacatatttggaaacccaaattcagctattgcaatttctcaagatgcaaagtgattttatggatgaatttggccaagttagaaaaatgaaagatatgtctataaaagatttatacattttttaaagaatgtatacatttacattgagataaaatcaatctgataataaattagaaaagaattatagcaaactgcatctgataatttttctgagaagtggtccaataaaattctcaaatatcacccacagggaagaacactcttcattaggcttaatacttcaaagtgtgttaattcatatttataaaataatcaaataaaatgttaattaaacactttatacacatgtgcaatctttatttctatttttctccaaaaaatgcttgctatgtgccaggatcagtgcatgataagagattcatctactgatgagacccacactgtccatctgcaagtagccttctccttttggagaaatgtttaggaataaataaaataaagacagaaaattaaattttttaaagttttaaattctgatatgtactgagagatacacatacagaccactttgatgagaaatatgactatatgaagtgtggccatattttacattacatggccaaggagggtaactctgccgagacaacaattaggcaatatgtgaaaaaataataataaattgcttggtgcaaggaggcaggaaaaggactgaagcagaataatgaggaacagtgtacatacttccaggacaaagggacatgacactgacagtttctaactatggatatttagtacttgtggcacatatttgacaaacagcccatttttgtcactaattatatgatcagaatcacttttgaatctagggaagactttggcctgaacataaattagaaattctttcatctttgagaaattcttgctatctcctgtaagaatcagctcatctaaagttttaattagtgtttttcctcgaagggttctcaaacttcagcacctatcagaatcacctggaaacttcacaacagagattctgattcattaggtattagataggagttagaatctgcattttaaacagacatgctagtgctgctcttctggtgaccatactttgaataaaacaaccgatctacataatttgctatattgtctttcagatctcttcaaagtgtcatcttttcagtaaatatagggcttttataggctgaatttattataatgttccctcaaaatagagtaagaatgtctttatctttccaaacctaagttgatatcaataaatttttatgttagtcacttctacaataaatttacttaaatctgaattgtaggtacataatgtatgtatatgtataatatataaaatatataatattaaatataggatatataaataaaaatttaaacattgacaaaagatcatttgaaatcaaatatttaagtcctaaatttgatgatatatctcaggatatatagtaatacaaaacttctaagaagttatttttataccatgatcaaaataatagttgctcattaattccaaaatttataggcttatgctcaaacatttaattttttaactcctgaaaaatgcttgtaatttaatcaatagagtaacataacttgaccttaaagctgtgacatgtatttttcagtggtttacagtgctaaatttgttaactcaaatgtatttatagattaagatacaatctaagtgaaataattagactaaaaaatccaagatgattgattcaatggtaatattttatatcctgtataaatgctttctaaaatgctgaaagattttcgatacatgactgagagtaaacacatgctagaaaagtgcaattctatgttttttaacaattagtaaatatgcaaatataaatccatgatctattctgacctgatgtatttatgacttccttcattttgttcctcttaaataagaacaatagacatattacaaaacaactaaaacaaattatgtatcttatgaaatcaatttataaggctctataatactgtagaatcagctattcaaagaaaatattgtttactctttattatcaactaatattattgtccatgttgctggcaatacagatgaacataagaaaatctatgacctcgagggctcaaaaattatacaaagataaaatatgaatgaataaattgccattcaaaggctttagagtatttttctgtgtaaaaatacaattgtatagtagcttagttagcccaactcctctacccatttatcattgttctttgatatgaatggatctaatccaactcactttggatatgttttctctgaatagcctaagaaggcttcctggacaactttccagagagcttccttcagctatcaggtactttttactcactcaatatgttaaatttgtagtctcacttcaccttctaatatttcaaatgataaaacactttgacaccccatctattaatctattatctctgtcatgcaaaaaacaaaaagaaagaaactctttggggatatcaccaaactaaaactaattaaataactaaataattatagttattgttaataactaaagaaaaatattttcttaatttcaagaaacttaatcttccagttttctccccatattttcatataaagaataaagcaaaatactacaccattgtgtatatccaaaagaataaagcaaaatactacaccattttgtatatccaacaaggttagtttgtgtagacaacataaatttcaaattgaaatctaagagagctcttatttcctctccacatttggtttgtactgtcgtgaaatatgatcactgttataatctttataaagtttttctggaaactgagataaaacaacaaaataatcctaagaagtggtgataagagcgctttaagtaaagacagtcatctctggagaaccacactgtgagtagtaaacattagatatgaatcgaaattcccagtgtccctttttcccgaatacaagataagacattactgatgacattttaagtcaccgtggccatgtggcttactttgacagatgaattgtgagcatgtatgtataacctggtccataagcccggacattgattagcaactataatcagaattgctatggtccacatatatccctaacgcttaacaggatgaacaagtgaatgaactgaaagtaaattttgtcatgtaaagtcatcaagattatgggaggctgaggtgggagaatcacttgaacccaggaggcggaggtggcagtgaaccgagatcatgccactgccctccagcaaagattatgggattatttgatttgcttattttctagtagtataatctagtatatcattattgatgtaaagttttttgactctgggaaatcttaggaaggtaataaggagctaatgtctgtatataaattggaatctaaggggtgagggtttgttttttttttccttgtttcctgaagacaagattcacctcagttacaactagatcatgcattcattaaatgttggaaaaacaaagcaatggagcgctgaattaaaaacatgctgttggatgtaattaccataatgagaacattttacctaaggcatctcaggatttcatccagatgctttatgtttatattaaataagaacattgttgtatctaactaagtgttgtattctacttggagccttcacagaacgtaactatcttcccatcataacgtttgcaagtctttcaattaaataggcacaatcgttagtttaatgtaactcagtccttttcaagacaccactgtgatatagaacacacatatgggctgtaaccagtttaaccagaacattactttgaaaatatttttggggatcatactctaaggagcctctatttgtttattagagttttatgtttgtctgctaaaaactctgatgtgcaatcatctactatgtatgtccatacaacgttaatttttctacaatgtttattataattttatccctactcagctcataaaaaggctagaaaataagaatgacatcatcaaatttcagttaaatgctggtcacataattgccacattgccattaacctttcttattagcatttaaatatatacaaatacacaaatgtactcagtatatttaaaagatattaactgtcatgatttctttaaaagtacacacatatgtttggctttcccaaaacacagaatttgccactcttcatattagaaattttggattaaataccaatgaaaaagaaacccaaaatatattgacaaaagcagatgatgcagtagctgaaaagatttacctttaactgttaatttccattaaatgaagttgtctaaagtcctaaatgctattattacattacttttcacattactatatttgttggctagtaattttatcaataaccattaaaattttcagacacaatagaatcttaaaataaatatattacctaagcattcatgtctactggaacaaattcaaaacaaaaatcacaaattaacttgccaaactttaataacgataacattctaattacatctgtaaaatcatatggatcttaagaaatggcactaatgtcaatattggctccccataattttattgagaaactgtgatatataaaattgactttaaaagcatttttactggctgggcacagtggctcatgcctgtaatccaagcactttgggaggctgaggcggacggatcacttcaggtcaggagttcgagaccagcctggccaacatggtgaaaccctgtctctactaaaaaaaaaaagaaaaaaaaaatagccgactgtggtggtgtgtgcctgtaatcccagctactcaggaggctgaggcaggaggatcacttgacctgggaggcagaggttgcagtgagccaaaattgtgccactgtaccccagcctgggccgcagagcgagactccatctcaaaaaacaaaaacaaaaacattcttaccatatagcttcaacatctcacaaatgacactgttttccatttggctggtaaaaggaaaatgttttaaatggcctggatgcctgtaccactgaagctagtgtttataaaacagctaaatgctcagcaattggcaagataaaaaagtccactctccctttagccccttgatacatcaaactttttaaaataaatttaatagtagtagagtttaattttttttttaagcttgggaaaaatttttggatgatgctggaaatttagcagaatgaatctattccaataaaatactggggataaaagtccaatcacaaatacaacttatgtaaagtgtttatatgtaggatttctgataagcactgattaatgactgttgtattttgaaaaagctgccaaactcaaagtagactacagaagacaattggcatgactgcaacaaaaacaattgccatctcagtagaacaacaagaattaattgtagctgtaacctcatgactatcattgaaacaaaaaagatgaaggtggggctattgagaaatttttaaaggatggtctggtttatggctagttatgcacacttcagatttttaaaatatgttatattttagggctttgaaattactgaaaataatttaattttatgttacatagttttaaatcactttcatagcttaatagggttttatgcaaactaagagaaatacaacacaaatgcaggtatatatgataatacagaaattgattaagcttgtttaaattaaatcacattttgaacacttgttagcaaaagctttctgtaaaaacatacaaacatgctgttaatgatcttctcatttgaataaaggaaaatatgtaagaattttgcttaaattttgctttctaaagtttgaaagtatagtttaatttctatcacaaatattatatcaacttatcaaaattactccttaattacattcatataataatacagattaggtaactattgataagtgtagacaagtcaagaggcatagacatatctgagctaaaataaaataaaataaaatatttagtctgtttctgataaaaagagatacatggaatgtttttattttagcatttatacttacagaagtaattcattatcttcattaatagatataaatatttgcatttgtgaatatattttattattttagatagggaattttaatttttaaaaggaaatggaatttggagtgaaacaactgaagtttcaaatcctatactcaccaatttaattcacaaaatgtaaagctttcagaatttttgcaagttcataacctcggtgatataaacacacctcatctatgatcatgggtgtaataaaactgatacaggagacattttgaagtaaaatttgtaaaacttaactacagtagtacagataacatggattacttcttagtaatttttggtacatgtaaatttgtgaagtgggttttttgtgccaggatgttaatttttaaaaatgtataaatattattgattaaggtaatgcgattttgtggaattaataagtaaaaatttacaaaagaatttataaataaaatcacttaaagaatatgcaccacaccagtgttgttccaggtatagactaataagtttaatgctcataaagataggtaaatgtgaaatagatatctgttaatgaaaaaataatgtttgctgacaatttcttcaattatttaggcaacatttccactgagatttctttatgatgatacaacatctaccttaaattaaacattggatttttttttaaaccatggattatgtgaaggtaactaaccaattatatatctgagattacaataaattacaacttcacatattgcttcatttcaagttacatgaagtaagaaggcaaaatgaaggattttttaaagaataactgcatttctagtgacaataaatataaattgcccatcttttaaagaaaatttttcataataaagatgagttttgaataataactcaattcagtagaatttacatttttcctgaaatatgtcttaaaatgtcttaaagggaattccttttaaaatgttagatgatttttcccacatagttgaggcaaatgaaaatgtgttgctgcaggtcataggctttaatatacaaataatttatttcaacatgctcttaattttatgtctttcatatatacatcagatagggagactgaatatggtactttgtgacaaaataaattttcagaaaaagtataaacttaagtttacaaggtataaattttttattccccaaattataacctttcagtatgaatcaggcttgattgttagaatacaattttacacacaaacactttataaaatattaacaggtaatttcatctttctgtggataccactgtcttgtatggattacaaattgaaacttgttatctagcaagcacttggtcttaccatcttcttttggggatttatataatataaacttcttaaatattacctgcttcatatgaacttcaaagacactaacaatatgtgggaactgccatcttttctgctctaccatacctgtctccaattaattcaggtcctcttgttatatgcactcgtggcacaattttcttttccttctgtgaacttacttgtgtcactctttgattcatgtttcatgtagatgtgaattattttttcttataaccattgtatttttaagactcaaatgaatgacccatagtagtcactcattaaatacactcggaatcatgaaatgagtaaatattctcatgtgagctaaaatgaaatagctacctaagtatgaaaaagaatgaggtttcctactagttagtatacaccctgactaaagttcacagaaaatcaaactcagtagaggaatatatttctcaattatcctctttgagtgttcatgtgactagggcaaattaaaagttaactatttgctctaaactgagaaacactaaccgtatgtaaaaacctactcccactgatatctaaaatatatgtttggaagtttagaaatatgctatcatttcctgctagggcagtaaaatgtatagttgtggtactccaagcatcttacggttaatacactttgagaacagcaatccagatatttcagctataaaaagatttttaatttctctaatctatgccagccataaggcaggggaagcacattgatatagacaaattcagttttcatcttttatgggcgaaataaatatatttgactagttttctcctataaactttaaaatgtaatttttcactgattagcagtcaataagtttatacgtttggtaggcaaaaacaactttcatactagtgttcattaaacattttctgccagataacttttacttcatcattgaaattgaaatgataatttaattagacttgtttctaagcgatcaacctatgaattttaaactatggcactgaggtgtgtgctctttttatctccttgtgataaatgagagaagattgttagaaataaattctccgaggctgtatatctagcaagaatttgaatctagggggtgagacctcaaacttaatgacattaactcatttacagattgatagcaactttgattgaaaggtggctgttactggtaatgtatatctgtgagtgtttgtgtgtgtgtgtgcacgtgtgtgtgtgtgtatttgtgggaagcatggaggatgcatgggagagacagaaaaagatatggagtatagagagagagaggaaagagaagaaacagacaaggttgagagaagtttatccattaaatggggaggaatgtgagaaatactaatatatatcaaacagaagcaaaaagccaagtatagattaatcttttattgtcctgactagctacccaggaaacagagaatgtaaacctctacatggtagaaggacttaaagggcctttgagagtatttcacatttcttaaaagatgaattgtaggaagtgaatgattaaagaggtttataatcagttactttaataggtgatatagtatagtccaaactctgagctcagggtgcagagaacacaagcacagacaacaaatgcatatatagatgcattggattacaacaaagttaaaagcttccaaacaacaaaggaaataatatacagaatgggagaaaataaggggttcatatccaaaatatataaggtgctaaaataaatcaataataaaaagtaaaacaaataaaaataccctgatttgaaaatgaaagaaggacctgaatagatatttctcaaaagaagatctaaaagtggccaccattttaataaaaaatattcaacatcactaatcatcagggaaatgcaaattgaaaccacaatgagatatcacttcactcctgctagaatagttacaattaaaaagacaaaagttaacaaactttggcaaggatatggagaaaaggtaacccttgcacacagttggtgagaacgtaaattgaaacagccattgtggagaacagtttggagatttttcaaaaaataaaaatagaactaccatatgatttggcaatcccaccactgggtatatatacgtatttatatgttgaagagatatctgcacttccatgtttattgcagcataattcacagtagccaagacatagacccaacctgtgaccattggtgaaagaatggattttaaaaggtgttatatgtacacaatggagtacttatcagccataataaagaatgaaatactgtcatttgtggcaatatggatgaacctggaggagaggacattatgttaagtgaaataagccaggtatagaaagaaaaattccacttgacctttctcatatgtgaaatctgaaaaagttgatcccataaaagcagagagtagactggtagctaccagaggatggggatatggagccatgggagggtttggaaaatgctggccaaatgatacaaaatgacagaaggaagaagttcaagaggtccattgtagagcatggcaattatagttaatggccatatattgtattcttgaaaaggaagtgatcagcaaacctaaaatactgatgaactgtaaaacttattatgaagagtcactctacatgacaagaaaaaatataaaataaaaaaaatgacaactgggcacagtcgctcatgcctgtaatcctgaaactttggaaggctgaggctggaagattgcttgggcccaggagttcgagagaagcatgggcaacatagcttgctctctacaaaaaaataaaaaatagcttactctggtggcatttgcctgtagtcctatctactcaagaggctgagaagggaagggagaatcacttgagcccaggaagtctagtctaccttgatctgtgattgcaccactgcacctcagcctgggtgacagagcaagatcctgtctctaaataaataaataaacagaagagtaaagtctatttttgatgggagaaattttggtacttctttaatctttgtactcactattggtttattcaggttttcatgtaattcgtgattcagtataggtaagttgtatttttccaagaatgtatccattttttctaggttttccaatttgttagcatataggaattcatagtagtctctaacaatcttttgtatttttgtgttatttattgtaatgtcttctttttatctgtgattttgcttatatgtgtcttcttccttcttatactagataaatgtttgttcatctttttaaaaatattatttttgatttgttgatcttttgtaatattttaatctcactttcatttatttctgctctaatctttactatttcttttcttttactaattttgggattggtttgcatttacttctctacatttcttgaggtgcatcattaagtttttatgtgaagtctttttgttgtcttaggcatttattgtgatattcttcttattcctgctttatctatatttcatatgtattgttatgttttgatttcctttttatgcattttaagacattttaaatttttcttttttaatttttttatcaatacataagtcattcagtagcatgttgttttattcccatgtatttgtacagtttccatcattcctcttgttactgatttctagttttagtccattatggtcagaaaagatacttgatatgatttcaatttttttgaatctcttgaaattgttttgtgtctttacatatcatctatcctgaagatattccatgtgttgatgagaagattgtttattctgcagcagtttgagtgaaatgttctggaaatgtcagcttgatccatttggtctggagcatagtttaactttgatgtttccttgttggttttctgcctgaataatctaaacattgctgaaaatggggttttgaagtcccctattatcattgcattgaagtgtatctttcccttgagatctattaaatttgctttacatatttgggtgttgtggtattagtacacaaacatttactatcattatatcctgttactgaattgatgcttttatcattatacagtgaacttcgctcacgctttttacagtttttgatttaatgtctattttatataatgtaagcatagctactcctgctcttttttggttttcattttcatagaatatatatttccacctcttcaatttcaatctatgtatgtctttataggtaaagtggattgtttgtaggcaccatacagtcagatttagctttttgttcttttttaattcattcagccacaaaattttaattggaacatttagtctatttatattcagtgttgttattggtaggtaaggacttgatactgccattttgttactagatgttctgtagctcctctcttcctctcttcacttcttactgttttcctttcctgttaagttatttcctctggtggtatttttaattccttaagttttacttttagggtatttattatagtttttggcattgtggttgtcattaactttacaaaaacatcttatagctatcagaagtacctcaaaataccttttttttttttttgagtcagggtctcactctgttgcctagactagtctgcagttgcacaatcatggctcactgcagactcgatttcccaggtctcaagtgatcctcccagctcagcctcctgagtagctgagactccaggcatgtgttaccatgcctgactaattttttgtagagatagggtctcactttgttgcccatgctggtcattaactcttaggctcaagtgatcctcctgccttggcctctcaaagagcttggattatagggatgagccacttcacctggccctcaaaacagctattttcagttcctggctgagagggcaaacctcacctctccaggtctggtgactggcactttatttaatcaattttgttaggttatatttccttgaatattttggatacttggaggcatgcatcaataactaggcattgaaaaattaggtatttatttcagtcttgccttgtttgtacctgtccttcttcagagagtcttccagtagtttaaaggggactgcctgttgagctccgtaagccagtggttgctcttggcattttagcactaaagggtgccctgaccctaggtttgttgtaagtcttgcaaactgctagctcaccaaccctccaacctgaacatggaaaagacatgggacagttccctgggtttctaggcaaagtcctttgctctcctcccactttccctcaagcagaaggattctctctctactctgtactttctgtagttgaagaaggggtgacgcaggccaccagtagcctctgcagcttgtaaggtactgaattgcacccaaagcctctttgaccagcacagtgtaggggcttggtcaaggcctgtagtcactgctgcctgactgacactgacacttattcaaggcctgaggctacgttaggcagccagtagagaagagggccagaactccggtttgttctgccaggatggtggattcccttctggcccaggatggatctagaagtgccaagcagctcacttggttctgtcctttgttgttttaagtggtggggttcgtacttgggtcttaggcaaagcccctgtactcttccctcttcttttcccaacacagggattctctctccacactgcactgcctggggttgggggaggagtgatctgggcactctaatggctgccacaacttacatgatgctaggttgctccccaagccatcagcctcccagaccagtgcagtactgggacttgcccaaagccatggtcactacagcctgcttgccactgaaatttactgagggcccgaggccactgtagtcaggtagtggtgaagcaggctgggactcaggtttctgttacttgggtggcagattcctctctggtgcagagacgtctaaatgcctcttctgtgggcgccagtctagaatcaaggactatgagggccctgccctgtgttgtattccactgtggcagggccagcactaagttccaatgcaaattcccacactcacttccctttccctccccaagcagccagtttctctctccacactgctctccctggtatcaagaaggggtggtttagacaatgtggtactgtcctttctaaagtcttcaattcccctcttttggttattataccaaaatcaggcactgtgattaattttgttcttttgaatgtgatttttaatctgtatagttattcaatgtaatgtacctgcaaggtaacaatcactgggaacttctaattggccatcatgatctggctcctcatttgtctatatttttgtttgtttgtttgtttgcttttgtggttttttttttgggggggggctgggcttttggtgttatatttaaaaaatttttgccaaaaccagttttaaggatcttttcccctatattttattcttgaagttttacagtttcatgttatatttaagtctttaatattcctaggatgtacccacaaacattaaaaattaaaaaaaaacatgggatgtaaggatgatttgatatacatggataataaatatgacccatctcattaacagaatgaaggacaaaatcaatataattatctcaatagacgcagataaagggtttcacaaaattcaacattcttttatgataaaaactctcaacatattaggtatagaaaaaatgtacctcaagataataaggattatatatgacaatcctacagctaacatactcaatggtgaaaaatgaaaagcttttcctttttaagatcaggaacaacacaaggctgcccacactcaccatttctattcagcatagtactggaaattctagccagagaatttaggcaagaaaaataaataaaatacatccaaactggaaaggaagctaaactgtctctattgcagatgacgtaatcttacacaaagaaaaccctaaagactccactaaaccaaaaaataaagtcagtgaagttgtaggatacaaactcaacatacaaaaatcagtaccattcctatacactaacaaagaactatccacaaaaggaattaagaaaacaaccccatttgcgatagcataaaaaagaataaaaggcttaggagtaaatttaaccaaataagtaaaaaatttgtacactggaaatcataaggcactgatgaaagaaattgaagaacacataaaaaaatgaaaaattatccaatgtttatggattagaagaattattattgttaaaatgttcatgctatccaaaatgatccacagatttaatgtaattcctgtaaaaatttcaatggcatttttcacaaaagtagaaaagagaatcctaaaatttatgtaaaatcacaaaagacttaaaatagatgaaacaatattaaaaaaaccccagcaaacctagagactttatacctcctgatttcaaactacattacaaagttacagtaataaaaataatatggtacttgtataacaagacacataatagagaggccagaataaacctattcatatatggttatctaatttttgacaatggtgtgaagaacacacaatcaggaaataaacagtgttgagaaaactggatattcataagtgaaggattaaaattggacctttgtctcatacaatacacaaaaaaaaaactcaaaaaagattaaagacttaaatgtaagaactgaaatcataaaactcctaaaagaaaactgtggagagaaaagctccttgtttacaaccttaatgggaaaacactatttttcaccattaagtgtaatgtcagctgtggaatttcatagatgcaatttatgaagttgaggaatttttccttgattcctatttttctcagatttttttctcataaataaatgttgaatttcaccaaatgccttttttctggaagaacaggtatgatcattttattttttcttctttacaccgttcatattatggattattctaattttaaaatgttgaaccaaacttacaatgctagaataaactccacctggtcatggcgtaaattccttttatatgtagctgaattctgttttctcgtgtgtgtgtgtgtgtgtgtgtgtgcgtgtgtgtacctgtgtgtgtgtgcatgctttttcttctggtttgttatcagggtaacagtagattgaaaaaaaaatgaactggaagtgttattttctgggaaatagtctgtaaaattattgttaattcttattcaaatatttgttagaattttccagtgaaatcatctgggcctgaagatttatttggagtttttaaaattgcaaccacaaggttttcaataattatagggctagtcaatgatataatctgtggtcgtttgtgctttttaagaaattggtcagcttaatatgagttgtcaaatataagtgtatagagttttcacggtattcctaagtatcctcttaattaattctttatatccacgagttgtgtagtgctaaccactgttaagagttctgactttggtaatttgtctactgtctttttttcttgctagaatattgccaattttatttttattgttattattttcaaagaactaggtttttgttcattgatttaatctattgtttctcttttttcaacttcattgatttttgctattatctttatgttttcttcatttgtgtgggttaattttgctttttaaagatctttgaggagggagcatattattggtttgattttttttttcttttctacatgaaagttttttgtgctatacatttctctctcagcactgcttaaatcatgttccacaatttttgatatttgtgttttcatttttactcatttctgggttttttaaaaaattggtcttgggactttgtctttaacctatagtaagtttcgaagtgtgtggtttggtttccaagtgtttggaaatttccttgtcattctagtattgctttcttgtatgcttgaattatggtcatagaatatactctgtgtgatcattattagttgagatttgtctcatgactcttaatatgctctatttcatgtgacccgggggccctgaaaatgtctgtgcatttggttaaagagttctatatatatatattgactagatcatgtttgttgacattgttgtgttcctctatatccttgctgacttttcatcaagttgttctagcaactgacgacagaggtgttgaaatatccatcaatagttgtgaattattttagttcttccttcaattctattaaattttgcttacaatatcctgcagcccagttgtttggtgcatgcacatttaaggctaatatgtgttcatgttgtattaatcctttatcattatagtaagtgactgtctctgttagatttctttgctctgaattctgctttaccttatactaatatagtcactacttctttttctgaaattaatgtttacctattatgtcattttccagtctttacttctacctaacctatattgttatatttgaagtgtgtttttttcatagacagcttacataggagctaagttttcttgatctattccaccaatgtctgtattttaattagtgtatgtataccatctctatttaaagtaatgattaacattataaaacttaagtacaatgctttcttttgtttctgttttccattctctttctcttttttcctatcctcttgagttacttgaatagttttttttcctaaaacatatatatatttatttatttattattattatactttaagttttagggtacatgtgcacaatgtgcaggttagttacatatgtatccatgtgccatgctggtgcgctgcacccactaactcgtcatctagcattaggtatatctcccaatgctatcccacccccctccccccaccccacaacagtccccagagtgtgatgttccccttcctgtgtccatgtgttctcattgttcaattcccacctatgagtgagaatatgccaccgcatattgttgttcctttccatgtttagcgcttccttcaggagctcttttagggcaggcctggtggtgacaaattctctcagcatttgcttgtctgtaaagtattttatttctccttcacttatgaagcttagtttggctggatatgaaattctgggttgaaaattcttttctttaagaatgttgaatattggccccactctcttctggcttgtagagtttctgccgagacatctgcttttagtctgatgggcttccctttgaggttaacctgacccttctctctggctgcccttaactttttttccttcatttcaactttggtgaatctgacaattatgtgtcttgttgttgcccttctcgaggagtatctttgtggcgttctctgtatttcctgaatctgaatgttggcctgccttgctagattgtggaagttctcctggataatatcctgcagagtgttttccaacttggttccattctccccatcactttcaggtacaccaatcagacatagatttggtcttttcacatagtcccatatttcttggaggctttgcttgtttctttttattcttttttctctaaactacccttctcacttcctttcattcatttcatcttccatcgctgataccctttcttccagttgatcgcatcggctcctgaggcttctgcattcttcacgtagttctcaagacttggttttcagctccatcagctcctttaagcacttctctgtattggttattctagttatacattcttctaaggctccacctctgggggcagggcacagacaaacaaaaagacagcagtaacctctgcagacttaaatgtccctgtctgacagatttgaagagagcagtggttctcccagcacgcagctggagatctgagaacgggcagactgcctcctcaagtgggtacctgacctctgacccccgagcagcctaactgggaggcaccccccagcaggggcagactgacacctcacacggccaggtagtccaacagacctgcagctgagggtcctgtctgttagaaggaaaactaaccagcagaaaggacatccacaccaaaaacccatctgtacttcaccatcatcaaagaccaaaagtagataaaaccacaaagatggggaaaaaacagagcagaaaaactggaaactctaaaaagcagagcacctctcctcctccaaaggaacgcagttcctcaccagcaacgaaacaaagctggatggagaatgactttgacgagctgagagaagaaggcttcagatgatcaaattactctgagctacgggaggacattcaaagcaaaggcaaagaagttgaaaactttgaaaaaaatttaaagagttacttgaatagtttttaaaattccatttttatgtatctatagtaatgttgattatatctgtgtatatattttattgatggctttacatacatatatatatacacacatacatatatatatacatatatatacatatatatatgtatatatatacacatacatatatatatatatatatatatatatatatacacacatacatatatatatatatcttatcacagtccactggggtcaatattttaccagttcccatagaaacattacctccctttacttcattttatctctgccatttataatataattgtgtttaatatttcctctaaattccttttgaacagtgaaaatagtgttatattttcacttcacctgtcaaaatactttggaaaactgtagtgaaaagaaaaagttttatatttatcatatttttcctttttccattctttcttaattcctgttattccataattccttcatttatctctttccttccttccaaacaattttatgtaatgtcctgaaaatgtatgaaataaaaatttttaaagtatatacaatattgaaaagttttctagagttttggaatatacagatatattaaagaagttgttgagaaaacaaagcaaggtgagaaaactatttctgtgtaattacataactatctctgtgttcatttaaaggtagagttttctaagactacagagaaagattacataactatacaaaagtgttatttgttgagagaaaaagtggacagtaaaaccaagcattatttgacaaaatttatcatttaatcataaataatatttaaacagatatatagttatagaaaaacattttttcagcaaatatttatagatacaatttatatgtctatagttccctatatttctttgctgaaagtgttttggtactacttgtatatagatagaagcattttttaacatactttattttctgagtacttttatgttaaaagcaaaactgggagaaaaatatagagttaatccacatactcccaaactccacagatgcacagcctcctaaattatcaatatctcccaccaggtagcacatttgttacaattattgaaagcaaatgacacattattattccccaaagaccacagtgtatgttacagtccaccttggtgttgcacatttatgagtttggacaagaagtgtatatatatacataaatttatatatatattttatatatatataaatgtatatatatatattttaagtgatggaatgttgtagaagttgtcaaacacacctctataactctaaatgtatcacactgtgatttaaaaagataatgtctatgacaaatatatcaaaacccagttacaactaaaataatttttagttaatagtaaatacaataaatatttaaaatgataataaaaatccaaactagcagcaccagtagtaactgttcggtatgttaattttggatttgtatgaactctcactgcagaatattggacacctctcagttacacatgattattcatatttgatctaactttgtccaacttaattattcaacctttccttaaaaatcccctcataaatattttatgcagtacatgcaccatggcttacttgtttctgctcatattttaaaagtcccatgtcttctgcaggttagttttgggttgctgagagcataaatgtgaaaataggcaggagttacagaattacagagttcctctacattaagaataactttcaggtaagtgctgtatatatttaaatagaatgcgaatattttcacagaatatagaaaatatttatttagcttctgtctagtgaatactattatatgtccttgttataaaacataattaatgatgataataataataatctttaaagtatagacatttatagttgtgtttcacttcggcaaaaagataaaaatattagtttaaaatttagcatttataacaagttggtatatcaccttcaaaatgaatgggggatgctaaggccttattttacacttataaaaacataacgataattcttataattagataacatattttaattttccaagtttctgaatatagagcagatggaaatcaactttttaaaaatttaaaggaaagataatctcaagatgatctccaaagagtaattaaaattaaattttgtagaaacagtaatgctttgatatcaatgtaaacataaattaaatgatataatgactcttatagtgataatttaaatccaatgttttatagaaaagaaataattcagatagggatggggtgactatgaagatgagggtaatcattctttttgtaaaataaatatattgtaatcagaagactccaaataggcaatacagaagtaatattcaataaagattgaaaaaggagagagtaaaagctataaattaaatattgagaaatcaggctgctatatgacataattatctgacaatgaaaataaataagcttttaagcatcagtcatttatttcatttgttccatttttaataaaattgcaattaagtattctgtcaaatagccttacttattctggtttaggcttgagtaaatattttataaattaagtatgaggacacttctgaaagaactaggtcagttaaaagtcagtaaagccagaagtccagatggcactgaattcactcaactaaaattaactactttgaatttggctcagtctcaatattcaattattaatgtgatatatgtgaaaatctggcaaattggaaaatggaagatgattcagttcttctaattacagggttagataaagtaaatatttttattttccccctaggtatttaaaaatacaactgatggtttaataaaaaatttaacaatcaacataaaatcataaataatttattttttccattaggtagtacttcaaattgccattcatataaaagttagtcatctaatgaagaaaaaacactatacatcaaataaaataaatgtttaattttaaaaaaatggaaacctgaagaaagtaagaattctacacttatgcaagtctgccactaactcgttttatgaacttgaagaaattactttgtcatttgtattctttattttccatgctataaaaccaagaacctaggcttaaatcattaaaatgtttcttttttagatttttggctttcaattatataacatctataatagaagaatatcatgcatttacacttttcaataaacatataaacatatccctaggtagctagtatgtgattcaccatattattttatgaagacttacatattaaaaattatccttcacaaatcatcacactatatgacttcaaagcatactacgaagatatattaacccaaactgatactggtataagaacagacacatagaccaatgaaacagaagagagagctcagaaataaatccatgtagttatagccaactgatttttaacaaaggtgctaagaacacactgaaaggacagtttcttcaaaaaatggcactgggaaaacgatattatcatgcagatatatgaaattagatatttatctcccaccatatgcaaaaacaacacaaaatggatcaaagatttaaatttaagacttgaaactaggagaaaaagcataggaaaaaagctccatgttactggtctaggttaggatgttttggataaaacctcaaaagcacagacaataaaggcaaatatagatagataagattacatgaaagtaaaaagcttctgcacagcaaaggaaacttccgacaaagtgaagagacaacccacagaatgggagaaaatatctgcaaaccatccacctggcaaaggattaataaccgaaatatacaaggagctcaaacagctcaacagcaaaaaatcaaataatccagttaaaaactgggcaaaaaatttgaagagacatttctcaaaagaagacatacaaatggccaataggcatctggaaaaattctcaacattattaatcatcagagaaacacaaatcaaaacaataatgagatatcacctcactccagttagaatggctgttataaaaaataaaaaaataaaaagtgtaagtaaagatgtggtgaaaagggaacccttatatactgctggcattagtatagcaattgtagaaaaaatttggaggttcctcaaaaaattaaaaatcaaactacaatatcatccagcaattccactcctgggtaactatctgaatgaaatgaaatcagtgtgtgggagagagatttgcattctttagtttatggcagcactattgacaatatccaagatatggaatcaatccaaatgtccattaattgatgaatgaataaagacagtatggcatttatacacagtagaatactattcaggcataaaaaaactcctgtcatttgcaacaatatgaatgaacctggagtatattacattaagtgagctatgccaggcacagaaacgcatatactgcattatctcactaatatatggaatcaaagaagttattctcatgaaagaagaatagtgattattagaaagcaaggagaagagggggagatgggggtaaactggtcaattgctacaacaccccagcttcataggagcaataagttctgatgttctattgcatagtaggatgactagttaacaatgatgttaacatagagatattttgaaatatacagatatttgtaaatataaacatattttgaaatatctgtagatttcaaaaaagctagaagagaggttttaaaacctcattagaaaaaaatgataaatgtttaagataatggatatgctaattatcctgatttgatcattacataatgtgtacatatatcaaacataatattgtatcccataaatatgtacaattatgtgttaatcataaattaacgaagaaaaatattttatactatatgtcctatcacatgcacatacttataacaataaaatattgtttcttttctgttttgttggcaatattcaactgacaccctgtaaaaacaatgataactatattcagccataactttatatcaatgttctcattctttgaagactcataataatttgtaatgcatctataaatacaatcatcactcttgtagagatgataaaacaaagacttaatgagataaagatatctgcccaatatgaaacatttcataaattagtgctgtccaaaaaaaaaaattgtgaaccaaaaatgttattttaatttctgagcagaagagcaacatactctaaaggaaatgaaagaagtttgtgagctggcactgtggttgaaaaggagtatctgaatttaaataagcgattttggagggcactgaaacattttgattgtaagagtagggtgtccaagggccataaagacagaaatgaaaggagttttagagaaaataaaactatatatttttaatatttatttgaaatattaactaatgaaaactgtatattacctcttcaaggtaatagaattatttgttgaattaaagactaaactaggtgtggaggtgggggtataactttagataaaatggccatgacctagacctagttgttataaggattaagtttgaaacatatcaacattctctgtagtctagctggatggatcagttttttttttaattccatgtcctagagcgcaactattttagcacagataatcaagatttattgtacagcaggcacatttacagttagacacaagaatgaggttaaagagaccagggaaaagtgggttatataaatgtaacatctcaaaggtagatggagtaattcttatgcataaaattcattgaatagtttagaatatttaaataaaagatactattgtaaaacaatatagtacctcaatatttacaattgttcaaattttatagctttgattagcagtaaaaattacaattgacactactagtttctccaaaaataaatcatttccatgaaactcgtgtagttctgaggagcacatattgtttaaactcttgagtgtctactgagtgcaaaatactctgtcttgtatagtgcgttttgtcactttacagatttggaaacaaaatcctagttgggattggttcagtgacattgctaaagttaaagagtaataattaggaatgaaattaaaaattaaaacatacaatatttattaaatattttaagttttttttaatgccctatgacgaactgagctcctcatttaaaacattgttttttttttttttttttttttttttttgagacagagtctcgctctgccacccaggctggagtgcagtagagctatcttggctcactgtaacctctgcctcccaggttcaaattattctcatgactcagcctctcaaatagctggaattacaggcttgcaccaccacacctggctaattaaagcatctttaagttgtctctacaaatctaaggcaaatctaagaaaagtctgggctattagtatttcatgctcttatttccatttgtgtacacaaatagctttgtgcatagatgcacttaatatatgttaatagaaagcaaggccatattttcactcaaactagttaagttattctagtctatcattcagtcttactgctttttaatttttttcaaagtgtagattttgctcatcagtaatgtgaagcactgttcaccacctccctcgaaaaaaagagcttccatattaagaagtaactttctttttttcattttccttccatctgtactttacaacactaacaaaagacaaaaataatgaacaagcttccatttcctgcaagatggtggattgtcctaccataaaaataattaaatgtgtgactaaaataaacatttcaaaatacgttgaactggcaagaaaattaggaaactttagaagcaaaaatctgagaaagctaagtcataggaatgtgaaccaaacactgaagcaagatttgctctgatgacatttgcctaacccagatgaacttaaacttcagtttgtatgacctttctgtttgatatggtataaacatatatcaaaggagtcaaggtaatagggaacctctaactccttccacaccctcacctacacctaaaactgtggcttcgatagttttcaattctatttaagggcaacgtagacataattttgcttttgagaagacataagaacacttgtatatagttttcaattatatttaacggcaacctaaacataattttgcttttgagaagacataagaacacttgtatatcttgaattttagcactagataaaagaaaatctctcatgaatggcaaaactgaaagtgtaaaagagtaatgattgtgtaagtattgttgttcttgcgacagtttgctgagaatgatggtttccagcttcatccttgtctccacaaaggaggtgggaattgaacaatgagaacacatggacacaggaaggggaacatcacacactggggactgttgtagggtgggggaaggggggagggatagcattaggtgatatacctaatgctaaatgacgagttaatgggtgcagcacaccagcatagcacatgtatacatatgtaacaaacctgcacattgtgcacatgtaccctaaaacttaaagtataataataataaaaaaaggattgttgttaatacaattaaaacaactaaacaatagacatataattaaggaggagaggaaatgtagttaaaagattctgaagtccttgaattttctgaagaaagatattaacaaaggttagactttatagcattgccatatgttaaaatgtatatatgtttatatgtgttaatatttctaaagttacaactaaaatggtgcagacactgtggaaaacagtatggcagtttggggacataaaattaaaaacagaattaccatatgatccagcaattccacttctagatatatatgtaaaataattgaaagcagggtgtcaaataaatatttgtatacccatgttcatagcagcataatttacaatatctcaaaggtctaagcaacccaagtgtacatcaacagattaatgaataagcaaagtgtggtatcgatacaaaataaaatattattcagcctcgaaagtatgtttgaactcatactacggcatgtgtgaatcttgaggacattatgctaagtgtaataagtccacaataaaaaaaaaactgctaaaaatattgtatgattccacctatatgagttgtttagagtaccccaaaatttgagagacagagtagaatggtagttgtcgggagacaggagaaggagaaatggaaagtcattttttaataaatagattttcacatttgaaggtgaacagatttctgaaaatgtatagtattgatagttgtacaatatggatatatttaatacaattgacatatacacttaaaaatggttaagatgataaattttatgatacgtctattttactgtaattttttaaatttaaaaacatgatttcggcatatattgaatagttttagagaagtgtgattaactttctatagttccaacaaaaataattttcaaatgactggtattaacctcatgatcgaagatttttattttacaagtctcattgtgttatactctatattgaaccctaagaaaattcacactgggtatgacaattttgcttaaagttgattcataatgccaaagaatcatttgtgagaaatccaattttattttccctgattatttatataaggaagaataatcccattttacttaggaaataattctttccaggagtgtacaccactctaatttataatttgctaatctgaaaatattacttggttaattctagttataaaaataacatttaaatctcaaagattcagaatgaaatccctaaaattaatctaatttattttattttaatcttctactgtaatggttttggaaacttcaattaccagatttcatagagatcccttcagagtctgcagctggaatacatggagtaggctacaatggccaatctctagtgtctgtatattttcccttatttgtaagttttgtgttttagtatatatggactcacctcttttgtggttgttgttttttttttttttaagtgcagttctaacaaactaaactgatgtttcccctttcaaataacaccaaggaaagaacccacaggaaacagataaggaagaggattatgtattgaatgcaaaacatttgcagttaattgcatgaaaaatgttctgcactttcttgactttcagtgtaccgagaaaagcttttaacagctcatattcatgtttactgaaaatattccaccataaggcatacaggctttctgaaaatactaatttgtgatcaagattaattcaagtgctagtcaaatacaacaaagttaaactacatattttctggtatttctaaggctaatatgtttttatatatgcttagaaatgattacaacagcattctgaattgaccaaaatttctttctggaaaaaatatgatagattatgtaaaatatccagcatactgcatgccattttttaaataaatgagctcctctaaaagccaagatcatcagttatggccaacttaatgcattattatcatcttctcatatgtaattatcataactttctccctttgttactgtttactcaatctccctccctttctccagtttctctaactcattaattatatattcatagaacagttccctttgaaatacctaagcctccaccttttctccaaggcttttaattgctcatctttcaaaatcagagtcacttattacatatttcttcattctataattatccaaatccatgaggtaagaataaattaaattaatagattagcccatgatgcataacaaagcagctatttaattttaaacaaaaacaatataattcaagtgagtgaatacctgctagtgcatgttacttaattccataaccagcatgtagggtttcatattccctagataaatcattattgaatgctagagccaggtttgaaaccctgataactattacttaaaaacccaagtattttaaattatgttgtactttctttctgactctgggttggagtcagaattctagcaagagtgccaatgaactgaaacagcaagcacaaggtcccatgtgcttttatcataaatgactgcagtttgaaaaagtagaacatttattttaatttcaattatcaagaaaggcttcatagaagacacagcatttaaactttgccttgaaaactgacaatgatttttatatatgagaaatatgaggaaagcatccaaggctacagaaaagacctgagcacagacatggataaatgaaagtgaggagaatgtttatgaaacaaagattagtcctagtgtgaaaggcagaatgtaaggagatatataatcaattttgaaaaacagtggttggcagcagagtataatgattaagaatttgacgttagtagccaaaaaaaagtagaaattaaatagaaataatgatatgggtttgaggattcaaaaagtaatattaataaaaatttgatcatagaatctgggaagtgatataaaccaaatgccaaccaaaaatacttattttaatgttatcttcagttaatatggaggttaattttttctgtgggaaagtttatatcatcacagtgttataaaaaacttttcctatatgaaaagaagttgattagatcttctaaattgtataagagtaaaataactggtgacactaaagatagagaagaagaaagaaaagctgcgtctaaagagagagtggagaaataaaacaatcgtaaagtctatttgcacagatgaaaaagagtttataaagtttaaaaacaacacaacttataagaatagtgccaggagagtaaatactcacatacctagaggcatgttgatcatattattaatataaattcaaaacatgttatcttaattagacaaaatatttaaactcaacactgtctagaaaatataaaaaatacatgatatttgaaaagtcaaatatatatatatatatatatatatatatatatatatatatgtatttctaaggtcaccttgtagataaaaacatttaaaaattaaagtatatttatattgaagtaactggcaacatttgaagtggtgccaaaactcaatagcaaatgatgatctttcgtaaattgcgaatttatgttattgcaaagttcaatataaaaaactcctaaaattcttacatagttgaaaatgagctgtcatttagaaatattgttacagagaatatgcatgtatctgaaaaagccaaaataaattttgaatgacactaaagcatcaagaaaagtcaaaatacagcatttctaacaatatatttatgatctcagtgatatttgaaagaaaaaatactttatccttcccagtgatctcctaaaatatatctattctaccctgacatattgaaatgaatagagcaggctttcccaagagttcagagtacctcagttgtggatccagttatattacaagttgtctttctgcctcaaaataggaaatgaaatagaccttaagatgtgttatcaatattcgcaggctttcttatgatttttttcccaaagttactgaaagctttcaaatatgagtggttcaaaggttttgaaaagaagatcaagataaaatttcttaaattaaagttccaaaatagtaagaccaaatcttaaattaaatctcattttgcatcatccgataataggagatagctaaggatatgggtgatatttttcaggaaatgtcatgtcatatgtgatgggttatttctttcatagtctcaaacatttaattggaaatctttgccaatttgtggttataataacctgttctgggaatatgtggcttatttcttgagcaagattgtcattctattcaatttgattttaaacatgcatttcaaattcttcaatgtatccttataatagctaccattaatgtcatcaactacaaactacactgcacaataagttttaatttacaaattacttttaaccaatacattcttaagatgacgactacaaattacaagtaatttagagcaatttgaaaaaaaataagtaaaattataattgaatggacctatttcagaacactacaattaaatatgatagataaaattggctaactacataaattcaggggattggtacctgcagatttttatgcctttttaagagaagctgataaggtgctgagtaaatcagaccaacaaaatttggtaatgccttttttttgatgcatgtatatcatgttaataggaaacatgtaagttaaagaaatagatagcatagatgatacaggaagaagaaaggaaagcagaagtcagcgtgaagggtggtggggcaggcagtatcctgcaagtggtaaaaatggtaaaagcattagcaggaatttaaatttgtatttagtagggaagcctccctaagtatagagtactattaaagcaaaattctgcaacctatgtgattttaacaataatcacatgtaatgtgtaagtatctgttcagttttacattttgcaaatttttattcttacaacatcatcaacaataatcaacacttactgagatctcaataagttctgggcactctgataagtactgtctgcattatcttgttttatcctcaaaacaacccttgagatagctacttggattcttcttatatttcaaatgagaaaactaaggtttaaagaaataaatgaattatacagacatatagctattaagacagacagaattctaacccatattgacctgaccttggtgctttcattgcttcagctttgtcctcctcttatgtggataattggtgaactaagtaggtaaaatatatttcaacttatattttcaaaattagaaaaactacaaataggtattttaatgtcttgactaatctttcatacatcaaatgcaattcaacaaaataaaatatggctgaaagagatgtgaggagtcacccagcacacttaagggctttgtattttttcgcaaaattatctaatttattttcaaaatataatgagtgacttgtatatgtagagtactatgatagatattttgagattaaaaaaatacttcatagaccttgatgtctatcaagggatcaatctgtaccaaaaattgtaattttttaatggagaataatagaaaagtaggaacagctttggaaacatattggaaaaataataacgtagcctggggagtaaaagaaggtttcctggagaagtaaatattgggtaagcagaataattgccttccccaaaatgcctacatcctactccttagaatccatgaatgtcttgggttacgggacaaaggggaattatagttgctaattacctgactttagaatactgaggttatcctggattaactaggtgggctcaatataatccaaacagtcatttgaagtagaggaaaggaacaaaagagagaagcagagacattgcaaaataagaaggaatcagcttaaccatgctgtctgaaagctggactaatgggggcattagccaagagatgtcagtggcctctagaagctgaaaagttaggaaactatttctcttctaaagcctccagaaggaattcagcactgacatattgattttagcccagtgagcctcctgttggacttctggcccccaaaactataagataataaatctgtgttgtgttaagccactaagcttgtggtaatttgttagtacagcaatcaaaacaaatcaaatccctaaacggagaccttgaatgcacgcataagaattatataatatggagactcttgtcaccagtacaaggaaacatatgtgcaagacccagagctgagagtatgctgaaggtaaaacaaaaacaagaagtacttcctataggggcttgttattcatggtcaggttgatggactttatcagggggctaaaatagaagttaaaatcagataagtgacataaggtatgtgtttaagacaggtgacactagcattatggtgaagttttataaactcagattgaagggagagggtaaacaagactgaagggcatattaacaatgagttgcctatgaagaaagttattgaagactttgataaaattaaaaacagagtcacataagattatgtgcaagaaaatgtaataaaggaagcacagatatacaggaaacagggaggactgaatttaagattagatgccatggaaatactttgagaaacagtgatgtttgagcttaaaacagcccccagagtccaaattaaaataagcaagtggcctctggaagctgtggtgttcccaaggaggaaattcgacctagtggaatggccattgcagatatggtcacagagagcaatggataagaacaaactttcaaaaggcaggggtcaaggactgcagataacaccagacaactaatttcctcacagagagcacagccaaagcctaatcaagagacatgccctacccataaattcggaagtcttcagcatgcataatatttttatcaagaattgctttgtgtcttctattcttccctcttctacacgagaaatgcagttattgtggctatcatctgtctgggctggaaaatgttgttgctttaagttcattcattgatagatgtgaggaaccaatccagaattgatggacataactctgctagatccaaagatcttgggtacaatgattggagggaactttggtttgtctctcatgcagtggatgtaagtatattccatattttaaaagaaaattacatttatattttcatgtcccaaatagtagaattttacagaaattgcaaactcatcacctacctcatttcctcttttttctaaacacacaggcaaacaatacttcccagcctctcatgttgttagaagtagatttgtgacagttttagcaaacagatgatatatgggaaaacatgagaaacatttccaagcatgatacatcaaaactcgttatggttgatcccccatgatcaatccccccaccccaaacaactggacaccggtgcagctgaggatgacagagctgtcagcaacgtggggcccagaatgactgagaggtcagtcctatcacctccaactctgaagaccaggaaaatcagcattggaaagttcagaatgacaaaaaaaggttgactttattttgttactgaaacttcgtggtttgtttgttacagtagctaatgtaaccctaactcagacattcttacaatccaatgaggtagattcaattattgacttcattttagaggtgagaaatctgaggcactaagaaattatgttacttgtccaaggttacactagttaatgtgtggcagagtcagaattgagccaaagaagtgtggctacagatgctcttctctcaattgctattctgagacaaaattattgggtttgaacaagaataagttgctgctgaccctggaaaggtgtatttcaaagtagcagtgggaataagttatgattatacacagataatattaatatggttaatataaactatcacagtattttactaaatctctctaaaactctcaatattttactaaatgagatttataattttcacacattctgacagcctcagtgctataatgcataagggttgcagagacctgtgggacctctaaaatctcaaatccatttcaattctaaacaaaaacacatcaataatattcatgctgaatctaagtcctgaaagaattgttgagtttacattaaactagttttgaattcaccaatttaagcattcatgaattcaagacaaccaagaaaaagagtatgaaggacttctagattttataaaggttggattatcatttattatgctaaaaatgtggccgggtgtggtggctcatgcctgtaaccctagcattttttaaggctgaggtgggcggatcacctgaggtcaggagttcaagaccagcctggccaacatggtgaaaccccatctctactaaaatagaaaaattagccgggcatgatggtgggtgcctataatcccagctactcgggaggctgagatgggagaatcacttgaacccaggagagggtggtttcaatgagccgagattgggccactgcgctccagagtgggtggctgagcgagagtccatctcaaaaaaaaaaaaaaaaaaaaagtctctaaaataccttgccttaaaaaacaacaattactctcagcagcagctgatgtaaggggtcttcttgagaagaaatggggcacgtaattgctgctaacacctaccccaaactcagccattaccaagggcagctattcagtttctgtcactcacatcaaacctccatgaatggccttgtcttcaatttcatggtataaactgaggccattatggagaaagttcttcaaatttttgatctccatctctcaagttgtctgcaatacatcccatatgtcccttcttccctcttgccaaagggaaagtgttgatgtcattttatgttgcacattatgcttgagacccaattccctgtctcatattcatcattccctttctcttggattttcagttatgctttttctaatttattataatagtttcccagttcttaagaaagtcacattgaaaaaaaaatcacaatgaacaattatcatattccaaataagcatatattttttcatacatctatgcctttacccgtattgtttcccctgctagaactccctgttaattattttagcctgttgaactcacacttatgctgtaagatttttactttatctccttcttggtaaaatctctactagtttgaatgagtagaattgttcatccatgttatgcactctagctgcaattgattgatctctaggttacttgtgtaaaaaataaatttatctgttacatgttgattttcctctttgactaaaggcaaaattcgtgtgtaagcataatcagttcctgagcacaaaaactagcatttaaaagttcaatatatatttgaatgaataaataaaaatactattccaaggaaagaagcaaatcagatacacctttcctctttctttatattggtaaataattgaacaaggaaaggtatgctcaaattcactgttttaagtttaatcttaatagtagcccaaactaccttacatttcaggtttataatcaatgtagaattataatacctgtatttgcatctcttcctaagaatagtctcatttatttatttcctcctgagatcccatttccattctagttttattaaactttatctaatattttcagcattgggggcatgtaatgattcttgatttgattcttttatttctataaagaacttagatgcaatagtttgatttgtaccaatttccctttcacttgattacaggagttagactatggaaagcaatatatctcaagtattctttatcccatctagttcttgaaaaataggtgcttgcatgttggcagcccatataactcaatctcccaaactgcttctcagggtaatgcacttataggctaaagcttcttctgaagtctggtgataaatgcaggattagggaaaggttttgattattataatgggtccctattttttttcctcttgtttaaaaagtaaagacaaatagtagctcagaattaaatttcacagagattttttttttccacttgatccctgaattatgaagctgggacatactcctgactggttcctcatccctaaaatgattatatcagatgtagatctatataattcattctgtctttcacttattttgtaaaataaacagctttaattactttatcttcttaaatgagtgaaaattaataatgcgaataagtgaaacacttttctgcttagtatgtaataacaaagcgcagatgtagatctatatattttgttcggatgtagatctatatatttcattctatctttcacttattttatgaattgaacagctttaattaccttatcttcatgaatgagtgaaagctaataacaggaacaagtgaaacacttttctgcttagtatgtaataataaagctcagacctggttgtgcttattcaccttaatatttcatgctcctactcactagcagaactttaggatattccttacatgtgcctgactcaaatatcgcaccttcatctaaatccatcctttaggatctaaacccaggatatttatcttcacattctcttctgaagcttggaataccttacgctcccttattcccctttctcctctttacatggttatgtccttctcctctggcatatcttcttccttcactggcctcattttgggttttggcactttttcacactgtgtattcctgtgttatagctcttatcccaaagttgttgttgtgtttttgttttaaattacttccctgtttccattattagagaataggcttctgtattagttcattcttgcactgatataaagaaacatttgaggctgggtaatttatataaaaaataggtttaattggctcactgttccacaggctgtacagaaagcatgatggcttctgcttcttgggaggcatcaaaaagcttcaaatcatggtggaaggcaaagggagagccagcatgtcttacatggcccgagcaagagcaagagattgagggaagaggtgccacagcttttaaacaaccagatctaattagaactcactatcacaacaacagcaccaagggggatgatgtgtgtcaaaccatgagaaactacccccttgatccaatcacctcccagcagaccccacctccagcattggggattacatttaacatgggatttggatggggacaaagatccaaatcctatcagcttcctagtaagtgctatattgtatttatctttgcacatttgacgcctagcactaaatctatcacttataaagatgtcatttttaaattttaaaaatagaaaatggaataaagaatattctataagttttttgtttaaattttgatctttgtgatatacgtgtgtgtgtgtgtgtaaatgtatgtgctcacttaacttggtggataggttcttggtaactttgactttaagcaatacaatgtataataatgaaacaaattttaacacagggtgattgatatacacagggttaacttcctacagtatatttctggtcataaaaacaccaccaaacttccaaataaatacccaaaacactcctaatattaaacactgaaataaatatcatctatgcatacaggtaagaaagattaataataaataagataattatttactcgatttttagtgaaccagtgagtgatggtagttgtaattgtggtgagttaaatcaagtgaagtttacacaatgaacattgttaggagaccctcctaccactacacagttcaaaagcaaacaattactaataggagatcccactgggcacttttataccacattgcttattgttgtgcatttgtataattatcgtatacttcatgaatatttgttttataacaatttgtatttattcattcattcattcattttctaactcacttattcctatttagggtggtgggtggccagagaccatcacaacagctcagggcacaagataagaaccagccctggacaggacaccattccatcacaggtcatagtcactcccaccccccaacacacacacacacactcactcactcatactgggaccatttaggcaggccagtgaacctaatgtgcatatctttggggtgtgggaggaaactgaattacctagataaaacccatgcagatatgagcatgtacatacatgctcatgatatgagaacgtacaaactccacacagacagtggccctggccaaaaattgattttgttaatcatcaacattttcatgaaacaatattatctgatgtcctgctgtgtgtgtgtttgtatatatgtatatatgttatatatatatacacacacacacacgtatgtatatgtctgtatatacgcacatttccagattaaaatggagttttataataaataatcctttaaaataagagacagatgttaagaaaaataatgaatgatcttacattttttatgctgtataggggcagggccagactagttagttaggcaacacgaccctaccatctagtggtcagaacactgaagaatagagttgagtcagcagacagggaagaattaatcaaagctaatctctaccataaatccaatacccaatagcatgcatcagaaatggaaagaattcattaccactctatttattatcctgaactgaacacataactgtaatttgaattaagttaaaaatcatatacctcctaaagtaccattcatgtatgtttctaattctcttcgataactatttataaaccatgcataaaagaggaagcaaagggagaaatattttgaacatgaagtgaaaattataagattctgatttatagaaataaaaatgagacttctatatatttcaaaaattttttaaagtttgtagaaccaagtcaatgtaataaatgttttattaagtaataaaattagccaaaaggtctcttgattaggaaacaacaaaagcttttcagtttcactggctttatattttgactgattaaacaaatttgggtattatttactcatcatcattattcattaattgacgttttattatctttgctttggaaacatcatgatggcaaagaatcgcctcaatgtatttgtttttgaaaattattatactgcatattttcatctgaagttgatagaacaggtaatatttaaatatagttggtttttaccttgtggtatgcaaacctcacaccatttggaaaaatggttgctcaacataacaagaagtagtctttgttttaaaaatgatgttgttgttcatgttacatgcaagaaaaagtataagcctacaattattaagtgagttttctctaaaattaatgaaatgatttttaaaactattgaaatatatataagattttttcataaatctatttttatatatgtgtgcatatatatgtgtgcatatatatatgattatttctcatacatatatgggaaataatagtattttaaatgaaaggtagttcatataataaaccaagagattacatataatggatcaaaaagctgaagaatatggtatttccagtaaatacagtagttgatcctaaaaatttgttttgcaccttatctctagagacaagttcaggaaggggctgggaaatgagaagaagataaagtcctgataggtttgtgcatctgagaagaaaaccagttctttgtctttaaatacagtccaaaaatattacaaggcctgaggattgctttgctctcagttttgcctgagaacaaaataatagtctgcaccctgtgttaagaccggtaggcctaaatgtgctccacagagatgtagaatatttctcacttgtgacagaacaccatggattgcgtatacacatgattgagtacacagacagacctgaagaaaaagtgcggctgagaaacgggaatatcctagaatattcatcacctaagacagggtagtgatgaagacattgcaaaggccgtgaacttgaataaaaaatgaatccgaggaccagaaatggtttgacaaacccttgccaaagccaacatgtcaatcttcccaacatacttctcagaaaggatggaggaatcttgaattagggaatttacatgtctaccatccaaccaaatagatatgcatataaatattaaattttctaataaatataaagttacattccttttagttctacactgtatgatttttaaccaaatcaccatcatcatcattatcaatgttctgagtactcattaagtttcaagcagtaatgatttccttcacattaattatctcgtttaatttgatcagctcttttaaagagcgggtgatgcaactcacatttttacacattcaaagcgcagaaggattatgtaacttgaccatattgtactttgaggattcaaggtcttaactggggttgtattaattcaaagtgtaggctacaccaaaagcttcttatttaaaatataaattagttatgggtgtctgggttctctaccaattgaagtatatgcataaataataggctatcatatgatagtgacatctttcacatacctggtctaggtagtgcaaatttaataaggaacaaataaggagaaaagtgatttccaccacaaatttatatgttaagttgtcaaatttttattattataatttttcttgttagcataactggatagacaatagagaggttactgggtctgctttttctcagtctcaaaaaatgttgcataccaaaatgatgacttgattttcaaatatagttgtcatatttagtggtcaaatgagaacaaaggagatgatcattaagaatcataacatttacaaaagaagatatgaaaaccctttaacgattgtaattcttctcttgaggaatgaagtgcattgtacctgtttaattttttcatctaatgagagttatccatcggaacgaataaaataataatttaatgtctacctcagaaacatgcttaagaaaatacaaaaaaaaaaaaataagaatttttttcttattttgcattaaggctgcttatttcacagttctctgtggttgaatatgataacttatactctgagattacatgggaaagcaagacaaacatgacaagcatgacatgatcatgagataggtgcacaattactgcaaatgaaaagctttcagttacaccaaagatattgtaagagaaaaatcccttttcagcttcatagcttgaaagcataggagtgatgagtgataaagtcttagtcttttattttttaaatctacagttataaaacctgaatctctctaaaactaaataaattgttgttgaaaagaaaacaaataaaatattggaaaggtatgcttctggcattacagagaggaacactagataaaaaatagaaaaatatcaatgactgctttttgtccatttacagggtaagaacaattaaaactgttttaaacctgtttcagattgcaaaaagtaggaagaacactagacattttgaagaaatttctagatccagtcaaaccatggtcttaattgtaatgcaagcttctaacttgttttggtaagtagcaaaaaagaaagatcattttctaagacctatagctatacaacgtgtgtgttgtctcggaacacgaaagctcaatgagaaagaggacttaaaaataagttgaaaattaatatggcagtttccaaaattatgttccatcataattttggagattgagatcacacatgcctgtctccaatacataaagctgggttcagaaccagtgaattcaccacaagccactgaacacagacatttccccctacaaaaattcccaaattttatcaataatcaataataagttaccttgggagaaaatgtagcgttaataaatcactgataaatgaatataaataggtaaacatactgatatggtccttcattctgtttatacaatatgatgaccaatattgctctggaaatatttgcttaagtttggtaagtgttcttcctgacttattttggggaaaattatttaaatggttttattaataatgattactgctactaagaatcaaatttgtctaaaatattatttgtaatattttaaataatagatatccatgtttatataatgagataaatagaaatactttataatcacaaagcaatgattgtcatgaggatatttttgtcataagtttagtgaaataaattacccgtaattaattgagggtagatgtatggaagcagaaaagcaatattgattaccttaaaataagtgtgataccttgtaatcattatgattctcagagggagtaagagtcaaaaacttgtggagctcgataaacaaaaatctaataaaaatgttttcatagatgactaaaccaaaagattataaccttaataaatttatatttcttcaaagtgcttgaattttcaaataaatattaaaaactaaataatcggcagcatagtaggacaaatacaagacagttacaaacagccagcattgaaggttgaaagactgatacccagaaaaaaagcttgctcatataaaatgctgaagggaataaaataaattgtgtattttctgtaataaaaaatagattaattgctccagacagtaaaatttttgatttgattataattaccttaaaatgatatttaaataaataatttgtagattcaagagaggattaagctcagaaaagtaagcaagaacttagctactttacattttagatctggaatatcgctgcctatactagtgataaattgactgacagaaagttaaaaccatatttagcatacattgaaaaatgataaaagtcagcaaacttaccagaaaggattaagaagaaacttagccttattttaaatgtaggagaagtcatcggaagtagatattgaaattacatactgaagagttcatatcaatttttatgaaaatgtacttgtaagtgatagctgatgtgtggaaaaggagcactcatcaagggttgacagaaagcctggaccactcgataaggttgtcttgagttacttgacaatattaaaatatttaggtatgtaactattcagaagacagttgtataatatgtctgtataactggcagaccaacaataacacttcatatgctgatctgacacaatctttgtcatttgcactgcccttatccaaaaatatttttatcatttctgcatgtacataacaattataaaatgatttgtcattttcacatgttgtgatatctaatttatactgctcaagtggatcctattacattaatatgttaaaaaccaataataactgttttataaaattcacctgtgtgagttccctgaaggtcaaataactcattaaaaataatgtattcaaacaataaattgcaaggaagctcaatgagatccaagacaaggttgaaaattgacacaaagaaacttctaaagtaatccaggaaattaaggaaggtctaaacatctttaaaaaaaatcaattggagcttctgggattgaaaaactcacttaggaaatttcaaaatacaattcaaagctttatcaatagaccagaccataacagaagcatttctgcacttggaagtcaggtcttttgaaataatccagtcagacaaaaataaagaaaacagaatttttaaaaatgaacaaagtatttgagaaatatggagttatgtaaagtgaccaaagcaatgaattattggcattcctgagagagaaggagaaaaagcatatttgaatatgccactttgaatatgaaaaatatatttgagggaataacacaggaaaacttccctaatcttgctagagaggtagacagtcagatagaggaaatcaggagaccacctacaaaatactatacaaaataatcatcaccatgacatcaccagattgtccaaggtcaccaatacagaaaaaaatcttaaaagcagctagaaagtaaggccagatcacatataaagggaacgctgttaggctaacaacggacttctcagcagaaacattagaagtcaggagagatttgggggcttatttgaaagatttacaaggaaaagaaaatccaatcaagaatttcatatcctgtcaaactaagcttcataagcaaataacaaataaaatattttccagacaaacaagcactaaaataatctgttactattaaacccatcttacaagagatacttcaaggagtaccaaacatgtaaacaaaagaatgatagccactactgcaaaaacacgcttaagtacatagcccacagaccctaaaaagaaaccacacattagaaactacgaaacaaccagctaagaacttcacaataggttcaaaacctcacatatcagtatcaaccttgaatgtaaaaggtctaaatgcctgatgtaaaacagacagtgtcaagttagaaaaaaaaaaaaaaatacacaagcctggcacggtgtctcatgcctgtaatctcagcgctttgggaggccaaggcgggtggatcacttgaggtcaggagtttgagaccagcttggccaatatggagaagccccatctctattaaaatacaaaaattagacaggcgttttgttgggcacctgtaatcccggctacttggaaggctgaggtaggagactcacttgaacccaggaggcggaggttgcagggagtcaagatcacgccattgtactctggcctgggcaacagagcgaggctccatctcaaaaaaaagaacaaaaaaaaaaaaaaaaaaaaaaaaggaaaaaaaaaaaagaaagaaagaaaagaaaagaagaccaatctgtctgctgtattcaagagacccatctcacacataataacaaccataggctcaaaggaaaaagttggagagagatcaaggacacaaacaaaaagaaaaaaaaaaaaaagcgagcagagattgctattcctatatctgataaaacaggctgtaaaccaacaacagtaaaaaaggaaaaaatataaagaattcaatttaacaattagaatttgctatctaaacatatacacatctaatattggagcacagaaatttataaaactacttttttacttacaaagacttacacagctacacagtaatagtgggggacttcaatactccactgacagcattagacagatcatataggcagaaaacaaacaaaacaatgtttgctgaatttaaactgaccactttagcaactggatctaatagacatgtacagaataatccacccgtcaaccacagaatacacattcttcttagctgcacatttagcatactcaaagattgattacattctcagccataaggcaagtctccataaattcaaaaaaaatcaaaatcatacaaaccatactcttggagtaaaaacagaaatcaataccaagaagatatctcgaaaccacacaattacatggaaattaaacaacttgcccctgaatgatttttgggtaaacaatgaaattaaagcagaaagtttttagcactaaatgcctacatcaaaaagttagagagatctcaaactgatgaattaacaacacagctaggggaactagaaaaagaaacaaagtgaccccaaagctagcaaaagaaaagaaataactaaaatcggagtggaactgaataaaattgagacccaaaaatccattcaaagaatcaacaaaacaaaagttggttatttgaaaggataagcaacataaacagaccacaagctagattagcaaagaaaaatacacagaagattcaaataagcacaatcagatatgacaaatatgacattgcaattgatcccacagaaatacaaaagatcctctgagactattatgaatacctctacactcagaatctagaaaatctagaggacacataatctcccaggattaaatcagaaaagaatggaaaaactgaacagaataatatctagttcagaaattgaatcattaccaactgaaaaatgccacagggccagttagagtcacagctgaatcataccagatatacaaagaaaactggtactaattcaaatgaaactattccaaaatatcaaagatgggtgattcatctctaactaaatctatgaagccagcattaccctgatataaaaacctggcagagacaatgaagaaaaaaaaaaaaaaaatacaggccaatattcctgatgaacatagacacaaaaatcctcaacaaaatattagcaaattgaatccaacgacacatgaaattcacaacaatcaagcaggctttattttgagatgcaaggttggttcaacatagagaaatcagtaaatgtgattcaccacataaacagaattaaaaataaaaacaacatgatcatctcaatgcctgcagaaaaagcttataaaataatccaacgttgcttcatgataaaaatcctcaagaaattcactgttgaaggcacatacctcgaaataataagagccatacgtgacaaacccacggtaaatataatgctgaccaggcaaaaactggaaacatttccccttgaaaatttgaacaaataaaggatattcactctcacaattcctattcagcatgatactggaagtggtagccagagtagtcaggaaagggaaaataataaaaaagaatccaaataggaaaagaagtcaaactacctctttttgcagacaatgtgatgatttaattctatacctagaaaatcctagagactcttgcaaaattttcctggaatggataaataacttcagtaaagctttaggatataaaatcaacatacaaaaatcagggacacttctatgcaacaataacattcaagctgagagctacatcaataatacaataccatttacaatatctgcacacacacaaaaaaaaaatacctagaaatatgtctaacaaaagaggtgaaagacctctacacagctacaaaatactgctaaaagaaatcatagatgacagaaacaaatgaaaaaacattacatgctcatagattggaataactgatattgttaaaatgaacatattatcgagctaccaatattatttttttcacagaattatgaaatctattccaaaagtcatatgagattaaaaaatgagcctgaatagccaaagcaaccctgagcacaaagaacaaagtcagcggcatcacgttgccaaacttaaaactatactacgaggccacagtaaccaaaacagcatagtactgacacaaaaacagactaatggaacaggttagaaatccagaaataaatccacatacctagagccatctgatcttcaatgaactcattaaaactaagcaaaagataaaggacactctaatatatggtgctgggacacctggctagccatctgcagaagaatgaaactggacccataccattcatcataaaaaaaaagcctcaacgtggattaaaaattaaaatataagatctaaaactataagaatccttgaagaaaacttaggaaatatcattctggtcattttccatgttacagaatttatgactatgttcacaaaagcaattgaaacaaaaataaaaactggcaagtaggacctattaaaacaaaatagcttctgcacagtaaaataaacgatcaacagaataaataaaaaaactacagaatgagagaaaatattcaagaactatgcatgcgacaaaggcctaatagctagaatctataaggaacttaaaccaacaagtaaaatacaagtaaccccattaaaaatgggcaaaatacatgaacagacacctcttaaaagaagacatacaagtggccaacaaatatatgaaaaaatgttccacatcactaatcatcaaagcaatgcaaatcaaaaccgcaatgagataccacttcataccagacataatgagttttattaaacagcaaaaaataacagctgctggcaaggctgtgaagaaagaggaatacttacacactgttggtaggaatgtacattagtttagccactgtggaaagcagtttggatagttctcaaagaacttaaaatagaaacaccattagacccagcaatcccattactgggtatatatccaaaagaaaacaaatcattccaccaaaaagacacatgcactcacatgttcattgtcccactattctcaatagcaaagacatggaatcaacataagtgcccatatggttgattggataaagattatgtggtatatgcaaaccatggaatactataccaccataaaaataaaacaaaattatgtcctttgcagcaatgtggatgtagctggagtctattgtcctaagtaatgcaggaacagaaaaccaaatatggcatgttctcattaataagtgggagatcactgggtattcacggacataaagatggcaacaacagaacctggagactacttaggggagcggggaaggagtgggggaggattgaaaatccatatattgatcactagcatccgaacttcagcatcatgcaacagactcaggtaacaaacatgcatatgtactccctgaaactaaaataaagcaaaataaaatttaaaaactctatatccattagagagtcatctcacattctcctctcctccagctcttgcaagctggcattatggcgttctcatcattctatagcctattaagttttgaaaaaataaaataaaatatttaaaagatatgtaagtatataacatcagaaaaaataatgcaagcttttcctggttgaacaatgtatgtacccaaagacttttttttaacctatgcataataaccacttgaaagcttgaacttagctatgaaaacttactgtcgtcttgatttcacacaccatatttagtccattagaacaatagtttaccaagaactcttcatcatgcttttaacaggtctgattctcatgcagtgtatggtagagtctgttaaatgcttttaaaaagttgtttgctgttgttctgttcatcctcagaaagcacataattatttgtagtacgaggtggccatgtgactgatttttgccatcaagtgtaagcaggagtgatgtgttcctttcagacatggtttgtgaaaacccagcatctgaacttctccataggcttttccagctagcagaaatgggattatacatcagagcaaacataaataccacttaatggaaacagtagatcacctacacagttccaatgcataggtaagaattaactcatacttatatttgaatcattaattgtggcatctattacttgcagcagtgagcctaacacaattaataaattatgcttagcaatgtcactaggctctttccattttatagacatgttgatggcagaaattcccataatctcaaggaaattcattttgttatcaatgcatcactagtattttcttaatatggttgttattattatcttttcgtgctttttataattattaatacattttaaaagttatcagactatttgaatctaattttttgttaatctggccatttacaataagacaaacttacatcaaccctattttaagctattttttccaataattatatatgcctattttgttcacaaattaaatactgatacaatgatacatgtcaagaagaagtatatgaacacgtgtgtgaatttcctgtaaacaatttgcatatatactgccaactcttacttatctttcatttctttgactgatagaaagtaggaatatgtatggtaaatgggtgccaaagggcaaattgccccaatgaagcagcacatcctcaagaaaacttgagggctgttgccgaagaactcatatttggctgaactggtatactgtatggcagccaaacgctaactattcttttctcatatttaccactgcacctgtccattctgacaacttccccaagtattctacatgtatggatttcaaatacctgttcaccttttccagggtcttctcctcagtaggaatggtggccaagctgaaatacatgggtctcagaactcaggcgtgtctaccgttacaatgccagcagaaagacagtctttctcaaaacaacaggctccttctctctgctttcttttattcatatgttccttatttcctttttggcaatacctgactgactggaaataaaggcacatttctacatatgtccaaggcaaggcatgtttgcactgtgatttagagtactacgatttctccaagggcagttgttaagaacaaatcagatgatctttctctgaataaaaacataagagaaagacaataaatatttgtttcctgatttagaaagatacttcaggctattatcaatccgggtgtgtttccatgttgagtggccctccagtgatttatttcacttttctttttcatgcatctatgaacccatatacctattttttaagctttatttcacatctgttttgcacttagaattgtgaaaaaaaaattcagtacaaagatgaaaaacttgcttttcacctccagcaaattttaaatatatttgttgataatagtaacaagtactaccaacatttttggatgcttataatatacctgacccaacactaattgatttgaaaaaatgatcttatttaatttttacaattgctagggtagatttctcccccactgcataaaaatttatagatgagaaaatcaatgtacaaaaaaattaaaaatgatctccaggtatacagccagctactgagtggtgaacctacgattcaatcgtagagagttttctgaagcccttcttctgaagcaaacacatgaagagtataggtatggtgatcacatttgttaataacactaaatttagtggaacatatactgcagtgagtggtcaaatcgtaattttttaagatatcaagagagtgaaaaaaatcaaaatcaaaataaagttaatagagtaaatgaagcatatgcacatcttaataacatcaaactaaatatgcattattaatgatcaaattatgtgttcaaatatattaatgatcaaattatatattaatgatgaaatatatcaaattatggcatcaccttgtaaagacaaaattttaaattttacactatttttatcactctatgaatagcttgtaggactgaaagtgaatttaagttgcatcttgcaaattatttcccagtgtagaaattaccttaacaacatccatactaattgattaccaacatctacttaaacatttcctgggaaaaggagttcaatttcttgtaacagagcccaatctatatcttgtgatctttttgagtcctaggctgctgctttttaactttaactcattgatcctgattctgtcttttgagtaacacataattaatttacttgctcactctacttgacagcccttcaaatattcatagggctcttaatgactccaataagttttctcagttccataatacttccaataactacttagttgagatgcattgcatcaaaatttgcacaacgctatatgagcatgcacttccttcccacattttcacctcacatttatacacataaagagaatcagatctttagttaaataaaatttgtttaaataataaaaaagttaaaaatcatgaaaatttcaggttaagttcagataataagttaattatacaaatgggtggagtggcaaataaagcagcttgattttgtcttctgatttcaatcttttttcaagttttcttgtttttgaaggcccctgcccacgctacgttcaaggaacactcttgtccatttgagtctatgctgaaaaatatgtgaataattatttcctttggtttcccatcataatgtggaattttgcaagtcttggctaaatatgtgtgaatttttttaaaatggaaaaatcaacacgagaaactgaaaaagatgcaatttttttccattcttataattttcaggttttgttgtattttatatattatcgctggagggagatgggtgtatttccccttatttgaggtgcatgactcttatccttgaataaggtgagattatattcactatatatcttataaaaagaaaaatgggctgaaaattgactatgaccctttttgcattctacctaagagcacaattagtttctaaggtaaattatattttgcttagaagatgatttgtctgggtgtttaaatggcatgtaattaggtctctgaaacaaacttaaactgggaagtataaaataaagttctatagattgcagggtattgaaataataaggtgaaaatgctgtagtggttcttgcaatatgaactgatatttgatttcctgtgggcaggctcagatagaaaatttcttaagattaggaacatgcaaaaaaagaagtggtggtagtctctataagaagaaaaaagcatgaaagacaggacacaaatataatctagaaagagacttcttatattgggtgtggtaaatgagcttgatggattttgatgtttgatatctagtttaaagatattgcctattttatattgtaattactccctattgctttttcccttcatttctacaaatctccaggaaaatttagttagccatagttagtactgggaaagcagggagaattcttttaaagacttgggtaaagtggaacaaaaagatcttcatcaatcttgccaaattatgacaaaataggctgaagtgaaaatagaagcagaaatcaacagcatgaactgaagattaaacaactaggaccactaaacacttcctaggcacattttaggatatttcttcagtcacttacccgatagaggctaaagttaaacttttactacttgccttaaaagatggagtgactctagaagaagaggacttctaattcttgaagtcataaataataggatgatgtctttattttataaatactatactaaaaaatgataattttttacttacatgtagatgtttaaaataaatgtttacataattgaaaagtttgaacctcatattgttaaagaaaacattgttaagtttgatgaatatttagtatcaggtggtataaatatatttattttctgaagtttgtataaaatcttaaccccaaatggatgttcagacattttaaagaatatatgactcattaacactttatatataaattcgaatatttttcaaaaaacctcaagatattctcagataaataatctcaatagaagtagatcataacattacctgaaagaaatcatcattacaatggagattttaaagtctgaatgaagctagctcctgtaaacttgtctagtttcatctctaacatgtacattgccagttaaagattttactgtttaatattgtggtagacaaactcaaggaatagtgtaacctattataaaaccttttcttcctctcaaatgtgacatctgataacagaacttatttgtgatccccaacagtaaaaagattataaggtagtgtggtaagcctatcagtgaatttctacaagtgggatgtctggcatttccgtcttttggaatactaccatgtgatatatattaaggcaagtgccttaattcctctgtttcccataacgaaatgaaatggttacaataagtcagtattacaactccttggaacagtcactggttccatcactactctccctcattcttctaattgaaagtattaaagctccagtaatatacaaatgcctaacagttctatttaacaatataattgcagttggtgccttgagatacttggaagattaatctatgttttactaagatcattttgatgttgtgcaaagtttccatatctaccttctttgacaaatgaaattagaatagttacatagttttttgtttgtttgtttataataaactatatatgagtcaaacactgcatggattctagaagaaagccatatagatctatgttaacatcaaaagaattaaaatatcacaatgaaaaaatcccaaaatcaagctactatattggtatgaaaatgcctattcttccactcaagaaaacgtaaatcttatcaaacaccacacacctctaatgagatttttaacccaggacaaatatcactatgtatgttatttacacagggagaatgaattcctgaaagtatgggtgtaaattaaaactggtgtagacaaaatagcatgcatccagcactgcaaaacgtgctctttctacagaatctatggctcatttcttaaagtgaatactaagtaatattccactaaattgaataataattcacatactatctccttccctccctccctcccttccctccttcactccctcccttccctccttccctccctccctccttccttccttccttccctccttccttccttccctccttccttccttccttcctcccttccttcttctgactttacctagaaagatacccaccaagaatactaatgaatatttggtgaaataactaaataactttagaatgtaatgaatatcatcacaaaactatagctacatacaatattatataatactaaactaacctgaggcatcttggaaagagagaaagatccaagtgagaaatcagtcaacatgaaccatatgtttgatgttgaagttatgtttaacactcaagtctgcataccgccatggtagatacctagataatcaaaggaaacccaattttctctatgtaccccactcctactcccagaaaaaaaacggatggaaactgagtagtgttttccagttccctatgctttgttagcttttgttgccttctgttgactttggatttggactctgtgatggttactattgttactcaacttgattggattaaaggatccaaaatattgttcctagttatgtctgtgagggtgtcgccaaaggggattaatatttgagtcactggactgggagaggcagacccaccctcaatttgggtgggcaccatctaatcagctgccagcatggctaggataaaagcaggcagaggaacatggaagggctagactggctgagtcttctggcctccatctttctcccgtgctgaatgcttcctgccctcgaacatcagactccaaattcttcagcttttggactcttaaacctacaccagtcatttgccaggggctctcaggccttcagccacagactgaaaactgagctgtcagcttccctacttttgaggttttgggactcagactgcagatggcctatgatgggatttcaccttgtgatcacgtcagtcaattctccttaataagctccctttcatatatacacctatcctattagtcctgttcttctagagaaccctgactaatacagacatggacttggatactatctaaggccatgcttgggttttattgttgttgttgttgttgttgttctgtgttttttaaactatgatagtgtctacctcttgtcatacttttatacgtgaaatgggtcctgtcacatatgaaagatattttgcttggtgttgacttaatttcttcaactatactttaaaaacttgaagtgtagttattccatttagtctacataatacatccctccctattgcaatgattcaaggataacaaacttgatctgatgtctaggaaaaacgttgcaaatctaaacttgacattttagtaacttaagcaattgaagaagctttcaagaaatcaaatctcagaatgcaatgcgaatgacatcttttcttttgctgtagtatctaaagctagtaggaaactaaatagagcagactatctaagcctagctctagaggtaatttgtcattttgtttacactataacagagttaagaattacttaataaaggaccttatgtcttggatattgaaagaaatgtaaatttgttatttttttctgaatattctaagttgactctattgttgaaaaggtaaactttaagtacatggtaatctaagggctacttatcatttcaactcctattgtccagaggagaaaatagtttatttgtaccggcactgctactagttatgatatgtgcatatattttattaagaaatgtttgtagaccagaatatggaaagaaaacaaatgatgcatatcaaaacataagtgatgttaaacggaaatacactgaacaaattttagacacatgcctgtttttgtctatcaatttataataaaattgctgtaatagtatttttttttcctagtgggctgtgtcttgcttacctgtactatcttatactatccaagacctctgtagaaataatgacagttgatcacattttaatgtaagataatgtaattttagacttagaaaaggtaaggagttttaattaagaaaaactatcatataggaccttcatttcacaaaggactaaaaacatagttatcaatatattcttgttgtcagtaaaagggaatgtttcttatgcatagttacaaggtgtgatggtgtaagcaagtatatatgagaaagtttgcttttcccccacaggcagagtatagctgattgcaaatgcaaaataaataaataaataaataaataaataaataaataaataaataaaacaatcttttttcttcagctttcagtgcagaaactaggcagcacacacataatattgaaagaatgctcagcacaggttaatttgccttaccctctctaggacagtggcctttcaaaagcctcacaaaaatagttaatctactttatcactgttgctcttaaagcttcacaggatactctgcaaagcagtagctgcactgcagatagctctaaagcttcattaaaatcaagaatatctttgaaaaaggattgtaatcctagactagaaaaaaacaaagtcagatttttccctttgtggctggtagaaaccctgataacattgagaactcttacacatctttctacagtatctgtacaagctgcactagaatcacatctcagttcactgagttaatgacctagaagaaaataagtaggtttctcagaaattaatgcttaaatgtaattgaaggtcaggcagataaattacgttaaaccagtaaattaaaatccctgaagaggagatctttttctgtccaaacagaagtaattatggacatattccttgggcaatgatttcattcagagtggctcatacaatgttattcatgtggctcctctagtattgcccacctgccaaccgcctcccgtactatttaaaaaatattaaaacaagccaaaccctttttctaacaatataattcatttaggcatttatttctgttatcgtatgggtgtgttttgagttcttcatatcttatcttcaaaagtgagtttttacttagcagagacacacagtagatcaatactttatagacattgtcctgattttatttgtgaattgtaatttaagattgcaaaagatgttgatttattcttctgtcaaaaggcatatattttcaactaggcttctatgtccatttgtccaatttattagacaggtgccttatgacagcactagtgaaatttgattgattacacttactacctatgactgagtatcaaaaagaggaaagaaaaaatagctatttctatagccacacttaaaactgactcatattttatatattgagcctatacaatgtggggaaatcaaagataaataaaatccttagataagaaaagctttcaattcaatgtatcataggaatctcaaatgacctctgggttatgttatctgctggcagcaaacaggtagtggttttactgacttgaaaagtaatcaaggaatagaaaaatggaggacactccccaaaagacatttgccaaactgggtgaggcttaaaagtctttatttgagctgctcatctgaaagctcatattttccatctcataatcaaatctttgaagactctgctgcagtacaaaatcttttatgacactccttttgggtctagctcagtatatactcttccttcttattgattgatttatctctccatgggtttattatgggtccctggactcaagaggagatagtttaatatctctggaattatgaacaatttatcccaatctttctaatatttcagattgaccaagcaagtctgtgttcctgacacccacatttgaaaaatagaagactatttactggaacttcagtggctataatgagtaacaccacacaagttcttaatttatttccccacatgcatactagaatagaacctttcttatgaatgagaaaacaaaatctcataggccctgtcaaaaaaaaaaatctgtgtaatgtaatgtcagccacacttctcaatgctaagtacttggtcctcagctcaatccttattctctaaaagaggatcaagagtacctggattctaatgtagagaatactctatgtgagcagatataagcaatgaatttgtctgatactcattctttttttttccaagaaatactttttaaggcttaaagatgtatcatttaacaggaaagacaaaattttctgctcttgtgcagtttatactctgttgagtagaacttatattcatcatgttagggacaaagagaaaaactagcactaattatctgcttgagataactgctatgctccagtagtttaagatgaaatccgtggtccagtcatctggaatttagaagatccattaccatcacacttcacagaaaagcaatcagccactagttagtaatttttgttcttcacattggttagttgaacaaacacctctgtctttttcaatgctaatctatggtgaacacacctacagtaatgtcagcaaacaaattaaaatgtagtaggacaaataatcacttttaatgtttttcatgttctgttagtataaaatctctaactacttttattatacatgataatatatgatgtttaatatttcttctatatttatcatgttttatttgcacaagagctttaaaatgtacttttctttcagtgtgtgttccctggtacaaaggcacttcaaaacgcaattttatttttaatgtaaaagtaatgccacccattttgtaagcacatatagcataatacttccaatgaacaaaacaacaaaaaacgtgatctatgagtaaagaccacacatatatttacagaaggaaaccattactctagatttcaaagagttatcttttgactggctttacaagatgacattatttggagatgactataagatgggaaaaagaggcagaaatatcaaagttccatagttgaaaaaaaattacatgcacaaagacaaatacacagatgtaaaaacatacacagacacagacatatatatgtgtgtgacattatcaggaagcaatactaacactttcatgtttctgcagtgtatttgtttcctgtttctacctaacaaattatcacaaatttagtggcttaaacattatacaattatgttaaagttttgcaagtcagaagtctgatggatgtcactatgctacaatcaaaaagtgtcagcaggactgagttcttcctggacactatagtggaggccctatttctgtgtttttttttttgcagtttctagagtaccccacattccttgccatgtgaccccatttctataacttcaaagtcagcagggttgcgatgggtctttttctcagtcttgcatttatctggttctctgtcttctgcctcccatttctacttataagaattactgtgattatgtctgggtcacctggataatccagaatagtctccccattaaggaggctatcatatagtattttttaattagcaaccttaattccatctccaagtttactaagtaacctagcatattcacattttcaagcattaaaatgttgacatttggggggccactattctgcttacatattcatggttagggctttctgtgcaaaaaaaaaaaaaaaaatgatgggttataaagattctgaatgtttttccacaggcccatttgctttttacatcctactggtgtttaacctggagtcttttgctattttacgaagagtattgaaacatgtctctctggagtcaaatatttcatttcaggtaggcacttgcccatatatatatatatatatttccaagtaagatgtttatattagggatgtaagatttttcttcctctctcatgagggctactgttggcaactgggcagcatgtagcctatataaacttccagaatcataattttgggattattctcttgcagacacctccctttatgatgtcaatctaagggctgagctaagggaaataaatgtgattattgtaagtaacaatacttctgatctcagttatataaactacatgtacatttttaggaaaaaaatgaataaatatagatgtttaaacatatgaagtatatctcaaatgataaatgtttgtatttagctgtggcctagaataaatacagaattttcttatgggccaaagacagaaaacggtgttaagatcaagtgatgaaaagctttgaatacaagtttaaggaggtagacttcattcagtaggattcgaagaactatggtggctctttaaacagaactgcggcatagccattaaatgtatctaggaaaaatatctaccatcaatcaaagtacaggttgaagttaagatgaacaggcgatgtatcaattattgatttattaaactgagggaaactgctgcatgtataatgaggaagaaccacccagggttagattttgggaacggaggaagagtgaattaaaaagttgacagaaaaataaaatgagttaggtttgaagaggtaaatatttaaaattctgtggcagatatacttggaagaaggtggctgtttaaggctagagtttgagagagaagttaagactacagatgaataaatgcagaaactttgcacagtaaagtgaaaacaaaaccaaattagcctgattttgaatcttgattctgctatgtactatggtgagctacttgggaaagtcagttatcctttccaaaactcagcttacttaactgtaaaattggaaaataataagcattctgcacaggtattataaaggaaggatgacatataaattaagtgcatatttgaatgccttgtatatagtacatgctcaacaatcatttttacttttattattatcattacaataataaaaaccattactagtattattatatttaatctctaatttgttagaggtgttagattaaagaaaattggtaacatagaccagggagagtacgtcttctaccaatcaataaaccgactctgtatgtacttcaattacactaataaggacagaagaatcataataaaattatttttactcaaaaatgaaatgggctgtatcatactcagatatcaaacagcaagtagatttcttcttataaatatctatagtcataagcttattcctatagacttgttcctaagtccatggtgccaaaaaattgtcttctgaagcattttactgtcataatgtactcataatataaggacaaagcagacagcagcattatacacaatatcatgagtagacctagtgctcatgaaaaaatatacaaaaagtaaatatcagtggagagctatacaacatatatgtgataaaacgaactatgtttattcaccaagataaaatatattgtccttcaatttcagtagaaaaaaatcttcttctattactaatataaaaaataaggctgtttgttgaaatatcattagatagtaactaaattttttgagacctttatatgctaggaactgtgccaattgtttaacatacattaatttcattcccctttgagtctgttacttcaatactttcaatttcgagctcagtaaagtgatagagagaggctgagtaaattctctaaggtcaaatagttagaaagtactaaacttgattattgcctaggcagtttgacgctacagagctgtacttcaactatgattgctgaattggccatcaacaacagtaccctctcaaaacttttcagtgcaaacataagtagcaaagatttgattgtctattactattttcagttcacaattttctactcagtatagctctgaatcattactaaatattaatgtcatcatcatgactttcttagagaacactttttctgataatcatggtttcttcttccattcatcttgaaaaatctgacaagaatcagaccacaaaggaaagaatgtgcataatatcaagtgttcactgataatcagtcatgtttgaatctcttagctaggaggtagttgaaaagtttaacataataaataatctagctaaataatgatagtggtagacacagtattaaattattgctagtcagagtataaagttcaaatatttaaacaatttagcattattttaacctatatgccatcaacgaccttagggaatagacattcagaggagattattactacagaatgatgaacactcgcttaaagcagaagtagtgagcactgtgagaactatataattggctttaatataattgtattgaatatgcattacgtacattgtcaaaaaaactgtcacaaatgattaataaattttaaagtcatggtataaatttcagaacattttattaaatccattaacctgccaagtagtttagtcagggtccttgttcatgtatgcacacctttaatatcagatctactgtaaaagttgtaaacattgagactcattggtctgaaaatgacctcaataagtctactgtctctataccattcataaccagttgtgcatgttcataatcgttccagaaaagagacacagattttctctggaaaggcgatttgaaagatctaaatccagattacttaaaattaaaaaaaattaaattccaatttgcccatgaaattgaagcaatagtttagagctcagaatcgaaataaaaccaagacctggaatcaggaagaacattggaatcagattctctgagcatttctttctgcttcctctcttccttctttatattcttttaatcaatttttgcttggaaatacaatattattagtaatattagtcatatatatctatttcatcatattgttatatgaattaaaatagaaaatgttaatattagaattaggaaaacatgacaaaattatgcaaaatgtgcatgtcaaattatttagaagattattgctaaaactagctagcctaacttgaaaaacctgtcatggaaagaattaaattaccgaaatcaacaaccaaatagccatttaccttcagaaaaaaaaaaaaaaaaagaacacttgttaaaataggtggaactccttattaattgtcttcttaaaatagtaaacagtggaaagacaatctattaaacaaaatatgttctttctttagaacattcattggaaatcattgccaattatctttcagtcctaaaattgattccaaatatagaaagatgcatcctctctgtaaatgatcaaaataaagatagcttaaatagtttaattttaaaatgtctatatttaaataaattataatagtcacaacctgcataagtgaaagattagataaaatggaaaatagtgacattttagagcatcagacatgagaacaataaaagggttaagaaaatgtagcatttctagcaggtctgtcattttaatatgtttgcaaaggcaagtacagatattctgagaataaccatcaactgtagtaaaatgattaaacataaaacaaattttaaagacacttaaaatataccaaaaaactgcaaaagccttattacctaagaggtaagaggatattgccaaaatatataatcaaaaaagtgaagatttatttatatgtgaaatataactaatataggaaaataatgggaacactcaaagctatggcaataggctgctaaactgaaggcaagtgctttgttaatatatagttagttgtatgcaagacattcttacacttttttctctttaaataataatgtatcctttttatctttggtatttctgtactattttctctgaatctcaaacactttttcgtttttaaaaaaactcttaggtcttgagtgttcctgtgcttattccttgccaaaggatgtgcatttcttgccaatatctacctaattgtggttgcaatgaatctgagaaatctagctaatctcacttaatctagatcattttttaatacaaagtgctacctttccttagaatatgcatttatatttttcacccttcttttgccaacaaactgcccctcattcttgagtacccagtttagactttatcctccctaacagcgatctctgaaatgccccagaatagtatacttacatcttcttagttaaccaaaatattttgcatattcttatatcacagcatttgtcacagttttattattttctgttcatttggatatcttccacaagaaatagtgaataccttaaggataaaaagtgtcctatatttttatggttgttctcttagtaactagtactcagaagcctctcaataaatatgattcattaaatcatttttacagtcaaccagtaataagaaaatagcttatggaaggcaggaaaacacagtaacacccctcacacacacacaaagtcaaagtcagtagcagttaccctaataatagctatcatttgagtgcatgttatttatcaaaggcttatagacactataattattattattatctttttctttagacggagtcttgctctgttgccaggctggagtgtagtggtgcaatttcggttcactacaacctctgcctcccaggttcaagggattcctctgcctcagcctccccagtagctgggacttcaggtgcgtgccaccacgccctgccaatttttttgtattttagtagagacggagtttcaccatgttggccaggatggtctcaatctcctgacctcatgatccgcccaccttggcctcccaaagtgctgggattacaggcatgagccaccgcgcccagctgacactataattcttaatattcacaaacattatgcaaaattggaattttatatccgaggaggattgagactttaatggactaatctgtttctccaggattttgtatcttttctgcctaactcacctcatggtctatatgcattcagtaaatacttgcttaaaaataaatgcagaaataccaattttcccaaaaattcacaatttacagaaattggcagaaaatatagtgaatttctcattgtactcactaatgctataaatttttattcttatttttttctccagtaaacataaggatcattgaagtcttgtgttcgtgacccataagatgaccagatgcttggaatagagcttgctttatttcttttctgttacttagaacttttcaattatcaatgaaagaactaacataaacatgtaaaaatgttccctttatcttttacagtaggtggccaaggagctagatcacaaagtaaagaataaggttatgcattgaagactgtctatataaaatataaatgcaatcataagtaggagcataagttgaaacagcaatattttaatatagaaaatggagtagaacaaactacagacttaaacctaggaagcatatgcaaagtattactcacttcacttttcctttatagagcctttgataaaattctaatagggaagagaagcttttgttcaacagataaaacagaagtagctgttcagaaagagtacattcagagaggaaagaaatgactccccatggacctaaaatttagaaagtaaaataaaataaaagatttttatctgagatattattgccttagtcctttttggcctgaagactttataaatgtttgggccatttgctttgaactctgcaaattgagtggagtgctctctctgtgtgaattcaaccaataagtgctatttgattagtgtcaaaatgttctactagtaactaacaaatctgaagagaaagccagtcacctccaaataattcaggtctgtggtcagatcctttacacgaaataaataaaagcctcacaacttcttaaattcagtttgtttctgtctgtgcttatatgtctaaaattatcctgatatatctgaatggttgtataaagaattctaatttatgcacaaatcattgctctgttaacaatgtctcactatggctccatattttcatgatctaaatgaccctggaaatatattaagcacttttacatcttccaaagagtctactattttgacttgcactgcacaggtgtactattaaattgtaggtgcatgtttagtttttgccttcacatacccagagtaggcaatttgtatttattcaggtatagcagacacacttcttcagagttcacattaaccttatttaacacagctacttaggatcaaccttgatttaatccagtgtaaaattcactgcccacagtagatgaaaacaggcacctattttataacacaacgcaacttgttcttcaataaataccagattatctttatttttgtttactcttataatttgttgaggcacattaaagaaattatgaggaacttatacattgagttcataaaacgtagtagctgagcttatggaagcataatactttgatgagatggtatgttgatcggccagtgcatgggatcataaattaaacagcataagcagttctactaagctcgggtatatctggcatgtgagggacaactgacaccagaaaatgacagctgccttagtctagagcttagtttggggctgattcaaattcctcaatttttaaagaacacaccaaaattggatttctctatttttattttcatgagccactaaatttcaccaactttaaatttattattttccaatagtttacagagatagtaggcaaggttaagagtggagagtgagtcagtagggaagtgaagaaggagaaacaggaggtattaatttaaaatgttaattttttgaagtatcttgaggtgaatgaatccaaacccatatgatagagttctaaaaaagttaaaattaaggatataaatctgtttctgcctgggttgacaatgtgctttctattagtcatttaggaaagatcaaaggctattggagattgtaggcatatagaagctaatgtctttttcttagaatgtagtaggatcattgttattagaatttataacagcacagttctaaataggcttctacagccagttttgaattaacactttgcattcttcacataacctacagaagcatgtgacaccatttcttcatacaacattttatggacattctaaaatatgaaaagtaaggatttcatgttttggaaagcaaataaagaaaaatgtatatattccagccttcataaagggataatagaggaagaaagtgcttaccattagatatgcctaatttgaaattatcattttaaaatttagtatgataattatgaaagccagaattagtatctccttgtgtgtggacgagaaaatgcttttttagtacagcacttgttctgctgtgatatagagtagtgttagggtgcagtcaaatagtcttttaggaataaaaggagaatacaaggaaaagtcagaggccagaattaacattagcatttgactagaaaaccaggaggcttccagataaaatggcaaggaggtacaaacaaaaccacgcccttggtcaaaaggattgtgttcattaagcattagagcttataggatcattgaaacacaaggctaaagcagacaaacagatgaaataacatgaatttcattcatcgctctacaaatctccttaaatgtagatccacagctatgttctggaggtaacaggtccagaaaaacagcatatttctcagctaacagtcaccagaggaggtaaatgctgatgacttagattcccagaaaagttcctaaaaagtacaaactactggcaatgctcattttcttctctcaacattcttcattttgatgcttggaataatattattccagccagagctccagttacacaatagaaaataagaagaccttaaaaatggacaccaaatactaaaatgctaaactcaaaagacaaaaggaactaggtcactaataaccatgtgcatccctggattctctagctttactgagagaaagaaaaatgagctagtttttcaaaccactgtgaaattgagtttattttttaaacatggctatgcctaatctaaatctaaatgcctaccttttcttaatagtttagaaaatatggcagaatttgggtctgtataacccaaatgacatagcaggcaggatcctgatggccacctgccagcattcattatgttccccactatagtttaaatgggcttctgcagccagaatcaatcaagttcaccttgttttttttttttttttttagactgtgttttgctctcgttgcctaggctagaatgcaatggtgcaaacttggctcacagcaacctccgtctcccatgttgaagcggttctcctgcctcagcctcccaagtagctgggattacaggcatgtgccatcatgccaggctaattttggggtttttccatgttgtcaggctggtctcaaactcccgaccttgggtgatccacccacatcagcctcccaaagtgctgggattacaggtttgagccactgcgcccagccctcaagttcaccttttttggtattttagtttttcctacatctacgaagtagacaaagaatgtcacttaagagaataaaaaccttttctcattttagagatcttacacattgtgtatgtgtgtgtgtgtgttttgcattgccattactcatcaaatttcagattctcaatccttgcaattggatacagcaggaagagtaatttatactagaaagattgctaacatatgcaaaacttatttggactctcattttgcttacaatataaaaatacttgtaattttttcaatagttagttccactaatggatagtattaacaatttatgaatatttataaattcataggaatgaaattctgacaaagcaaaatctggaagagaggtacccgtatgacataaatttgccatttgcaaatattcatatattgaacactactaacatatcccactacagggcagagaaaatttgaatttataagaaaaatacgctttttgacctgctgaaaatacaatggtcattccaggcttttcaccctgtttagcatctatacaagaaacaatcacagaactaaggtttctattaatttctatgtaggctatcatagattcatgcagtttggttgaagagtttttaaatgggtcagtaatttcttatgatacagatataaattaacaataatatgctttaaaatgtatacttctgtgcttatccaattttcaccatttctaagatgaacaaatcagtataagtaattttttgtaaaaaatgcaactaaattatctttattatgttaatatggttgaaagttctctaggaagagttatttgaatatgctttgaataagttagaggtaaacaatttcaaacattttaaattttatacagaaaaaattctttatttttaaatgccagacgtaaatctttatttttttctgtatccaaccaacataatatacccaataataaaaataattgcattttgctccaaaattcaggacaatgtatcagactagtaatttaaaaaaggaaaaaaaatttgtgtagaaaaaatatatatgttctgtggaaaccataaaagtttagatgatcagggaatttaaaatatggttcatctatcattttgactactgaaaatttgttttagaccaaaaatatagttaaacacaattcacaggaatcagtaaaccttaatctgtttgggtgatcctgttccactgggggaagcttagaaatatgtgagactacttttgagtttcaaatgcgaagggtaaatactagaagagtttaatgtttggttcataggtgctaaatattctgcaatgagaaagacagtatcacacaaagtaaggttttctcataaaatttctatcctgctaagaaaataggaatctaggtattatctatcatgagaatatttaaaattcaatgattaaaaatagagagattgaagctcttaattgaagtaaacatatcatattttcctacttataataaagaattaaaaggatgcagaatgtatttttcaatgctaaaacatatttatatgaaacatctcaagacgttataacctaatgtgtactctgtcccacttaacatattattattttattctatcttattctgaaatctttccatgacatcccgctatacctcacaacaaaacctacccattcattaaattcataagagaaaatactaccataatttttctttcagagtgattatactgcaacagatattctctctctctctctctctctgtgtgtgtatgtgcatgtctctctcacacatgcatgcacacatggaattcatagctatgaaagttagaattgtgtctgtatactattttctgtaacatacagagcttctaccagacacatgggtgtttgctatttaggaaagatgccttatctttgtcatccatcagcaagctggcttaaaaaaaaaaaaggaaaacaaaatcttcatttattaagcattttaacaaaaatgatatatgcaggctctcaccagagaacatgttgtgttttaaatctatttcatgttttacatatttctggcctttttataataagttccttggcttgtcagggtaggaaaaactatagtaatctgagaatcaaaattgtctataattaataatacaaaattcacaaaatgaagagccaaaaggttaccatcttttagtattcctcagcatgatgcagaatgtgggaataatgacattgtaagccaagaattcctcactaatgccactttgattagtgactaagtaaaagtatggtttttgaaagtgagaagatgctagaagtatgtcagcagcatcacttcacattaaatgatacaatttggtttaattaaaatttgactatcactagtatagagaataatcttgaggacttagttaaaattaaactctgtttttaaagctacaactgaaacacgattataaaaataattcaaacaaaattttggctatcaaagtttcttgattatccttgttcaatgcttgtacttatacatgtgtatgtatgtatattttggagcatatcatttctctctctttaaaaaggaagtggatgacacaccaccaatcattagtaatccttcccagaaacctcaacttattgtcactcctccatcatgcctacgtcaccaaatcttgtgtattccaccagacatgactgtcttatatttgcccatattacaccatctccacatacactacctttagtttaatggggtcaagtctctccctttaacatcctctaaataatcaccttgccttctctgttttatcagctgatgctttcactcttagttttgctttctagaacacaaatctgatcgtatactttctttcttggaatccctcaatgacaccttactgctgtcacaacaaagtccaaatttctgaacttaacaagccacttaaacactctgtcttggcttactgatccagtctcatttctctgtcaccatgtccccttccctcaccagatgtttgagttctctgtgatgcttgctaccaatttgactaagctatactttcatggcaggcttcctaagttactattatcaagttatagtattttattgatttgtttattctaatgctttctcttagtggtttgatttagggcagtttagcaatgtttaatgtttaattatcaaagctgaaaatggggtgctagtggcattacataatagaaaccagggactcttctaaacaaactacgatgcacggacagccccactacaaagaattatacagcccaaaatgtcatggtgcaggggttgatacatcttgtttcaggaaagaatggtatcatctatgctggaatttttagcaactagcagagggctcgtcacttaaaaggtgtttcataaatgcatactaaatgaatgtaaataaatatatgttctttgtactacagaaattaaatactacagtgaactatttggttaagaattttaaaattaatttaccacagctcattgtctcctctgttcctaagtgcacaatattttctttgctgagattaattgccaccctttgtacagtcgtgatacctcactaaatattttttgttctacctctaaatacactgcagatctggccatttctcactgtttccactgccaccgtctcttaaaaggtcttctaagtgtttttttttttttttcctatttaaactgttgcaccctttcatccatttttgtacagaaaccagtgatcatttaaaaaatatattgatcctgtatacctctatttaaaatttgacaatttttcccatttcattttagataataacaacttttaataaaattaatatatttgaggctccatatatttggatatctgcttatttctgcgttacctaattcagctacctctatcctagtctttctaaattcttcagattttatgaataagaaatcagaattctcaggaaaactcaggaatcccttaaatcatatatgagtatctaatattttatactttccagccattattatagaaacaatatatacttaataaacagatagtattaagttttgtagcatttctaaagaactataaactatgctaaatattccaacactggaaaacatcagggaacattacagggtagcattcaaataatacaacctttggatctcctagtaatgtaaataagaatgcacagaatcacttacaaaattgccagattaaggatttattttacttccaaacttgacatgtcatggaacaccactcataagatttgtataaagtatgtaaattaacttctttatatagattatatttacaagaatattccaccattagcagtagatgtggccaaaaaccaaaaacaaacattataagtgacaacagctaaaactaagcatgatatttgattgtggcatttcttttttactgctataaacctgtttccccgaaatatagatcttaattcttccacttgcatgtcagtattttctattaagttatgaaaatttttcttaattttttaatttcctgattgttcctagaactaaaattaagaaaaacatttaagtttctcaagaaatttcctggaaataattcatatatgggaacattaagacacatggttattctttctgcaattcctatgtaccaagtttttcccagaacagggaactatttatttgctgctcctcctgcataacatgccatgcctttcaatctttatagaactgacttgactcattcttcaagtttcaggtttcagatagaatgtcctttctttaaaggagtataggattgcatttctaagccaaatccctagtcatataatttatacctagcgagatagctaggtagctagcatctgtctatgcatatgcctatgtcccatcaagatataaagctatatattcgcctacatgtttacttgttcagtatctgttcaataggtgtcagtcactcaaaatgttggccagtaagaatggtctccatttaaactttgattttcacaaacaaaaatgtattctactaatattctgaaccattttaaattttaattgaaaatcatatgtgctctatgaggagtacacattatgattgtttgggttaactctaaatttgagcagaatgcctggaacttgagatgaagtgtatagctattatttaaatgaatggatggtaaataactatcctcttttgtagtctggctataattaaataatagaaaattgaatagtgtcatttttttcctatgacccgataagaagatcagtgtttaacagaaatgactgtaaacaacagtttttccattcaggctctgtgagaaggtattagaaaggtagatgaacagcagtacatcccaaacgtattaatttcctattgaagctataacaaattactagaaacttgtggcttaaaataagacatttctccaatgtcaggaggatagcatcatcaactgcactaactttccctctcttatctctgtttctatggtcacatcttgttctctggttcagacctcctgcctctctttttcatattttgatgagaatgagcctaaccaaataatccagaaaaaaatctcccaatcataaggttcttaatctaattacatcttcaaagtccctcttgccatgtaaggtaacatattcccaaatttagaagattaagacatagacatctgtggggaacaattaccctgtctaccacaccaagtaatccaggtctcccatttgaatgaaaagtaatctctcattcatttaactgttcatttaataaatatgtggttgacttcagtaatttcattaggcaagattcactcaagaagttggaaggagaagggcgactgaggagacaactaggttaacaggtactctacagagggacagagtgacaaatgctttcacagacacatggaaatgatttgggggatgatgattaccacttggcatactgatgttcccccatttctttttcttcctcctttttaaaccccaaggattataatttactttcatgaccaaacttctattttatatcagtcaggttagaagtgataatgtaactataagttttttcagatcagttagttgcaataataaaaggaaaacaggcctatgcatcttttttaaaaagacattttgaaattgaccgccttgagtgaactgccaaacctagattttaatttgactgatgtttgtgcctacaaaggttttgcttgtaaagaaattgaattttaaaaacaatttccagaggaacttcgattatagtattgcttcactactaatttcatttacttaactgtctacatgtgatagaaaattttgattattattagtttaaaattttcacagtttgggtgctgaatttatggctttggtatactgccgaatctgtagtcagtgtggtatcttttaataatatccaaatacaagagctttttgtgtagtaaagaatttaacttgggcctgtagccttgtagtatagtttgaagtcaggtagcatgatgcctccagctttgttcttttggcttaggattgtcttggcgatgcgggatcctttatggttccatatgaactttaaagtagttttttccaattctgtgaagaaagtcattggtagcttgatggggatggcattgaatctataaattaccttgggcagtatagccattttcacgatattgattcttcctatctggtaccaaaacagagatgtagaccaatggaatagaacagagccctcagaaataataccacacatctacaaccatctgatctttgacaaacctgacaaaaacaagaaatggggaaacgattccctatttaataaatggttctgggaaaactggctagccatatggagaaagctgaaactggatcccttccttacaccttatacaaaaattaattcaggatggattaaagacttaactgttagacctaaaaccataaaaaccctagaagaaaacttaggcaataccattcaggacacaggcatgggcaaggacttcatgtctaaaacaccaaaagcaatggcaacaaaagacaaaattgacaaataggatctaattaaactaaagaacttctgcacagcaaaagaaactaccatcagagtgaacaggcaacctactgaatgggagaaaatttttgcaatctactcatctgacaaagggctaatatccagaatctacaatgaactcaaacaaatttacaagaaaaaaagcaaacaatcccatcaacaagtgggcaaaggatatgaacagacaattctcaaaagaagacatttatgcagccaacagacacatgaaaaaatgctcatcaacactggccatcagcaaaatgcaaatcaaaaccacaatgagataacatctcacaccagttagaatcgcgatcattaaaaagtcagggaacaacaggtgctggagaggatgtggagaaataggaacacttttacactgttggtgggactgtaaactagttcaaccattgtggaagtcagtgtggcgattcctcaaggatctagaactagaaataccatttgacccagccatcccattactaggtatatacccaaagaattataaatcatgctgctataaagacacatgacacgtatgcttattgtggcactattcacaatagcaaagacttcggaccaacccaaatgtccaacaatgatagactggattaagaaaatgtggcacatatacaccatggaatactatgcagccataaaaaatgatgagttcatgtcctttgcagggacatggatgcagctggaaaccatcattctcagcaaactatcacagggacaaaaaaccaaacattgcatgttctcattcataggtgggaattgaacaacgagaacacttggacacaggaaggggaacatcacacaccagctcctgttgtggggtggggggagaggggagggatagcattatgaagtatacctaatgtaaatgacaagttaatgggtgcagcaaacgaatatgacacatgtatacatatgtaacaaacttgcacattgcgcacaggtaccctaaaacttaaagtataataacaaataaaaaaataaaaaatgataaaaacaaaagctattaaaacaaacaaacaaaaaagaatttaacttgggccaggaagaggtctagccttttctcatcgctcctgggaggtatttatttcccttggtggtttggactagacagatattaacactgatttaccatggggactgaccatatcagaaagaccaatggtgtgatttaaggtacagacattgaatcatggggtactagtaaacctagagattaaatcaaccatgtagacatttatcaattatgcctatataatgaggccccagtgaaaactttgagcctcgcagggtacgatggcatgcacctgtagtctcaactacttcagatgctaaggtgggatgatctcttgagcacaggagattgggtccagcctgggcaacatggcaagacctgtccctaagaagaaatcaaccaatcaattaatcaatcaatcaatctctgaacctcaaacctgtgggagcttggccatacctcttgcatactgtcatacattgaagctgggaaagtaacaggtactttctcagatttcaccctatgtacttcatcctcctttgtctaattttaatttataaccttttcctttaattaagcatatatatgggtatagtagctgtcagtgagttctttgaattattttgtctaattatcaaactgaggatagttagtttcatagtcagtggtggactgtatccctctaacagaatactgggctaaactcttttcacctcctaatatatgtgtgcgggtgacatacaagcttatttaggtttattattagaacactaaaaagctttcattagcgagaaaaaagactcacttcaggctataaaggattaaatttgaaaaaggcagtgacacaggtgtcaaattgttcatcatttccactatgtaagtggcatctaaactgtaaatttccctcactctactattcagattcttttcaaagccagtaaacatcttcaacagatacaaagtaatcgatggtggttattcagcctttctaaagtgttgtccttcaaaggtctgtgtgacactttatttaaaccactaatgttctctctaattagagaaactgcataattattgtccaaaccagaatacttttgatattgaaaggggatattgttaataatttatactagaaaagcatgtaggaagcaggactatctcaacaaattgtgatatatgtctctagcttgctgtggaggcagatttgcctaggaaaattgttttagacaaaatgaaaacaaaacaagactgaggtgtatcatgagtaagttctataaatcatatctaagtgtgaactttaaaatgtgagagtgcgttacatatgaattctttcattaacttttttctgaataattcaaattgccttttgaaattatgaatttctcaaataatcatattttgcccatgtaacaagaatgtaataccatatgacaattttaactggggaagtcaatggcattgattttttttttaaccaggctttatcgttgccttggtggaaaacatgtgacttgtatttcaatctattcccagctgtgtttttcctgttctcaaaaacaactaggcggtgtgttgagcacagcagttataaagaaaaataatctgcagttttctcagggaacttgcaatctagagaaagatacaaggaagaaaacaaatcattataatttaatgtggcaaaagttatacatctacacaatattaaaggggcatcaataaagacatatctaactctggaagagtagtcagggaaagtgtcaccaaacacttgaaatgtatttgttcagtatgtgggaagagataacaaatatttcaaggatgagaaaatatgtgaaacctttaaaagtcggggtggggaggtggttgaacttgctcagagaatagtgagcagatacatttgactcaagcatagataccatggtggtttgacagggacaagcaggaataagaggcaaggagggctgtaagaaagagactggggtcagtttatgagggcattaaggctcagaggaaccattgaagactttaaagtcaggagatattaatcaagtaggtttttgatgaaataactctaacataatttccgaagagattagagatatcaggagccaggaaccccatggtgtagatcatataagaaatagagaatgaatatgtaatttaggaaaatataagaccagtttttgtttttgtttttgttttttgtttttttgtttttgatgaagtcttgctctgtcaccaggctggagtgcagtggcactatttcagttcactgcaacccccgcctccagggttcaactgattctcctgccttagcctcctgagtagctgggactacagacacacatcaccacgcccagctaatttttgtatttttggtggagacagggttttcaccatgtttgccaggatggtctcaatctcttgacctcgtgatccgcccaccttggcctcccaaagtgctggaattacaggcgtgagccaccatgcctggccaagacccagtttttataataataatattctgaatacagtcaataatattctgaagacttccattaggcatattatgtacaaggcggctacatgcaaacttcatcatccacaaagtaggcactgtagaatttatgcatttcttctatttttgacaggtggtggtaaatgtttgagttctcccaaaattcgtatgttgaaggtgtaaccttcaatgtgtctgtatttggagataaggcctttatagaagtaattagggttagatgagatcatgagcttatggtcttcatgatgaaattagaactcttattaaaaaagataccagataacttggtcactctctttcttttctgcccacacataggttatgagggcatacagtgagatggcagcagcctgtaagccagaaacagaagcatcaccagaaactgaccatgctggtaccctaatctcagacttccagatttctgaagaacttcaaagaaacaaaagtctattgtttaagccacctagtctgtcacattttgttatggcaatgtgagctaactaatacactacctttaaaatataaactaataagcacggtcttaagttaatatgactcatgctaggggacctacagacatagcatactctaacagcagagcagagaaaagcttagccgattttgggaataaaaagaaaacatgtgttttgtaggatattatgcctaagctatatcttaaatggtaagaattcaccaggagcaaaatgttaggaatttcttgtcagaagaaataatgtaagcaaaagcatcactattcacagcaaacccaaactggctgatatctgtgataggcaaaattctaagatggcctctaatgtggtttggctgggtccccactcaaatctcatcttgaattgtacctcccataattccaacatgttgtgggaggaacccggtgggagataattaagtcatggaggttgattcccccatagtgttctcacagtagtgggttaagtctcacaaaatctgatgattgtataagggaaaaccccttttgctttcctctcattctgtcttgtctgctgccatgtaagacatgcctttaggcttccactatgattgtgaggactacccagccacgtggaactgtgagtccattaaatctctttttatttataaattacccagtgatgggtatgtctttatcagcagcatgacaatggactaatacaacctctatttttttaattttaaaataaaatcttgattccagaaagaactgtgatcatgataggatattatttctataaataggttattaatcacttgactttgagttaaatataatgataatatctgagtgaacccaacctaaccagggaatcccttgggaaaaatctgggccctgcctaaaggaagaatgactgatgtttgagagggcctattgggatagtcacatggcagggaactacgagtggccctggaggagctaagagcagaccctggccaacagccaacaacaaaatggaaaccgcaactgcaagaaattaagtactgtctacaatgtaagcttgaaagaggaccctgagattcagagaggaatctagtcaacaccttgatgctagccttgtgttactctgagcagaggacacagttcacccctgcccaaactcctgacacgcagaaatagtgtttgttgttttaggcaaataacttgatgttcattggtagacgacaatagaaactgaatacattattagagatcataaaatatataaccaagagaggcaagatatgaacgagaaagattgaattttcatgaatcgtctgattttttataagaaacttggaatttttatgtgagggatgggaatcctagagtgactataaggaggggcataacaggtgagatttcaagatttcacgtgctcaagattgccctgactgcattttagaggacaaatacgacaatgttgctattgatcatgtaagaggctactgggatcatctgggagatagcaatggagagtctgggctagagtaatcgtagtaggaatggagtaaaaatgaatgcattaaataaaattaggagataaattcactggtgtggagattatttgcatgtggaagatgacagaaaataaacgtctgaatgactcccagatttctactttggatgtcccgaatgatgggctgcaactttcaatgggaatgcaggaggaggtacagatttgaattgatgggtgagagaaaacaaattaaattttggaaatgcagtgtttggagtatctatagaacaaaatatgaagaaaaatgatatcccaaatattagagtacacttttatgtgaaatgcaattcacaatctccttcttagaaaaaaaaaagtagtatctctgataaaattttcaagatatttcaaaagaaatttttaaacttttaataatattcagactgattctgggaaagtaatccccttcccaccctgctgtcagtcaatagtttaataatgtaagatttgtggggtattttttgagttttgtataagtattttataatgtttttttccagagatatctctagtaagcataagttggaactggtctgtatcaggaatctacccttgtatcaagattgaaatgatacttgaatgtgtggtcttatctaaatgttctgaaaattttacttcagataatataaataaatatttctggtaagaagttggtattttcagtctctatatctgatatcagtatcagactatgcaataaacaacgtggagcccaggaaagagacaggaacttggcaatcaaaagctaaggagcagaagaacatcaaacagtcttgccctatgaaaatatggatcaaagtgtaatggttacactttggaacagttataatggtaaattataacaagctatattaaatatatattttatgtaaaattataataaatcatagtaatctaacaaattgctcttccagtaaaggttggataattctaagacatcttgagtaatcttaaacaaatttcaataaaatatagttgaaccataaaataaattttaataatgcttgcaaaactgtctttgctaataacatttataataaagcttaaaaactggaattggactaccaaactagctaagtctaaagatataatttgaaggagagaatggaacaagttactgagtgacaaagagactatgtagagaattaattcgcctctgtatagaatttccaaaaaggaattaactcaagactctatggactgataagaatcaaatttggcctggaatcagttaactggcaagagtttgacctccctaaaatcaaagatgacatgggagggcaggttgtttttatccctaaaatcaaatatgccttgtgaaatattaagacattaaaagatactaactacaaaatcatttctgattgcattatcatctttagtaaatataatttataaaaagttctcaaacaaatcagaatcctgcctgactcctgaacatgaagtgggaccacagcacaacagaaactgagactcctccccagcagagatgaccactgtgaatgaagttttggaaattgtgtaaaagaggcattgtgttcagtcatccagtcatccatccattccgttgtatgcacattcatataagcattgattttactacattctatgcctttaatctgctgggtgctaaacctgcaattctgaacaaactagacagaatcccagctgtcatcaagcttacatttcttcatgggagataggtattaaacaaatattataatattaattataatgttatatgattaatatgataattatattataattataatgtgatgtacatttaattacaatataattatattttagttttgttatgatattaatttaatattataacaattatattaaaatatattaatatattttataattgtaatataatgatatagtaaaaatatattataattaatataatacaatataatacacaatataatattatattataatagtgctataatattaaatgaatattataacattataaaactaaaatgtatattaaaatataaatgctgcgaagagtacaatgagagagcaagtgtatatatatatatatatatatatatatatacacacacacatatataatgtatatatcctgtcaaaatttgagagataagaaaaaatatctttaagaaatacaggtggacctgtaagaaatagaaggaaggtaactggaaaaagagaaataatggctttccaaagaaataacacaaaccttcccctgaggcataaagaatcatggccactgtatcttgcaacacctagacacaaaaatagcttctccttagaaacttagaaaggtaagatgagaaaggatcagatcgaataattggaaatttttctctgttgttactttgtctcagtgtattagtctgttctcatgcttctataaagagctgcctgagactgagtaatttataaacgaaagaagtttaattgaatcacagttctgcagggctgaggaggcctcaggaaactgtcatggcagaagatgaagcaagcatgtctttcttcacaaggtggcagcaaagagaagtgctgagcaaagggggaaaagccccttagaaaataatcagatttcctgagaactcactcactagcacaaaaacagcatgagggtaactgcccccatgattgaattacttcccactgggtccctcccatgacatgtggggattatgggaactacaattcaagatgagatttgggtgaggacacagccaaattatatcattccacctttggcctctcccaaatctcatattctcacatttcaaaacacagtcatctttcaacagccccccaaagtcttaacttcttccaccattaactcgaaagtcctatgccaaagtctcatctgagacaaggcaagttctttccacctatgagactataaaatcaaaagcaaattagttacttcctagatacaatggggggtacagtcattgggtaaatacacccattcgaaatgcaagcaattggccaaaacaaaggggctacagtccccatgcaagtccaaaatataatagtgcagtcattaaacattaaatttccaaaatgatttcctttgactctgtgtctcacatccagggcacactgatgcaagagttaggctccaacagccttgggcagctccatccctgtggctttgcagagtatagccctcctcccagctagtttcatgggctggcattgagtgtatgtggcctttctaggtacacaggtacacggtgcaagctgtcagtggagctaccattctggcatctggaggataatggccctcttctcacagctccactgggtagtgccccagtgtggactctgtgcgggggctccaacctcacatttctctttttcattgccctggcagaggttctccgtgagcattccacccatgtagaacacttctgcctagacatgcaggcatttccacacattctctgaaatctaggcagaggttcctcaacatcaattatttacttctgtggacccacaggcccagtataatgtgaaagctgtctgaagcaatggccctacctgtaccttgaccccttgtagccatggctggagctaaagcagctgggatgcaggacaccatgtcccgaggctgcacaaatcagaggggaccctgggcctcgcccacaaaaccatttttccctcctaggcctccaggcctgtgataggaggtgctgctgcaaaggtctctgacatgccctggggacattttccccattgtcttagtgtttaacattcagctccgtgttacttacgcaaatttctgcagctggcttgaattttgttccagaaaatgggtttttcttttctatcacatcatcaggctacaaatgttccaaacttttatgctatgcctcctattgaatgctttgccacttagaaatttcttccaccaaataccctaaatcatttctctctagttcaaagttccacagatatctaaggcaggggcaaaatgccaccagtctctttgcatagcaagagtgacctttactcaagttcccaagttcctcatcaacatctaatatcacatcagcctggacttcatcatccatatcactagcagcattttggtcaaagccattcaacaatctctaggaagttccaaactttcccacatcttcctgtcttctgagcctccatgtctctgggacattccaagtattcccacattttcctatcttcttctgagccctccaaactgtttcaacctctgcctgtcatccagttccaaagttacttctacattttggggtatcttcagagcagcaccccactacccagcaccgatgtactgtatttgtccattcttacactgctaataaagacatacctgagactgggtgactaataaaggaaaggggtttaattaatgcaaagttccgcataactggggaggcctcaggaaacttacaataatggtggaaggggaagtaaacatgtccttcttcacatggtggcagcaaggagaagtgccaagcaaagggggaaagactccttataaaatcatcaaatctcatgagaaacgactcactatcacaggaatatcatgagggtcaccacccacatgattaaattacctcccgctgggtctctcctgcggcaggccatgtctcactattgcaggcctccataacaactgtttcagtagtgactgagtggttaagttaaatattaaaagcccgtgcccttatacaaaggctaggatgtaacaaaagcccatcaagagttttgcctaggactttcctgggccttaaagcatgacaaaataatgaaagaattcttaacagggcccatttaagattaaacaagttttattttgggtctgaagagactccccaggcttccacaaacaagtttattgagggtctgaaggaactcctgaaacctctgtgatttatcaggagacaagataagggtaatcaccccagcacgtggacccatttagattaagtaaatttcctcgggctccagaggaaggtcttcaggaatcagaccttagttatagattaaaggaagttaatcacttacgtctttagatgaatgtacacttaatgcatagacatatagattagaaggtttataagctctggaaaacttcgtaattttgacttggtctggcattaattttcaggccttctccctgtaactggttacagaaaataaaaactcttttcctccctagttcatctgaatcttgttattagactgtgagaaatagcagcccagccctcagtttggtctgggaatacttccacaatacttggggattacaggaactacaattcaaaatgagatttgggtgaggacacagctaaaccatatcatccaggtaagtattcttatttaatatctgtaatattaataaagaaggtatatatatctgagataagtgtttaatatactgagattaaatatcttttgttgttattataatcgggactccaacatcatatttcagtgcgaataggtaatctctagagttgtgatagaattagtgataatatattattctcatgattaaagtagctttgtcaactatgagataatagttgaaacattttcaaataaatctacttaacattccaaatttcattttaaaaccagaattaatataattaagctttaaattaaaggaggtaatcaggttgtacaattcaaataattatttgaattaaaaaaggtagtcttcaaaattttagaaaaatctttcataaatcaatatgtgaaaaattttagaatattgaaaaggtattcacattaatattaaatgtacaatctctgagtatataatgacaaaacattttgacaaaaagacaatgtgttttctaaaatactataaaatcagccacactaatttgcatagacttaaaaaaaagtatgttcttgtgtttttttaatagatagagtatttatgtactttctgtgactagcttgctaggaaaatttaagtccaggacaagttttataacgactatgaacttactgacccgaatatgtgacataatggtcagatctaaatttcaatgtaatgcttcataatgttaaatatattatgtttttaaaataatgtttaaactaataattaatagccactaattattaataaaaaggaacctgaataaatatacatttgcacttttgcaaataatctgatttattaaatattttaaactcattatggagttggtcactgaagactccttggcttcatttatttctagtatcatactcctcagcctgccagaatgaaccacacactttgaccatctcagtgaagaaattgaagaagtacaaacaaagaaaggaagatactgcaagaatgattctaaatagttttcatccccgtaacattttcacaattgtcaaattaatccatgaatgcatacacacatacacaagcacaattttgtaagctggttctttaagaataaataagtcaattagataaaacattgttaacctaatcaagaaaaatagagaaagtctaagaaggaaattattatagaaacagaagatatttgtaaaatatttaagaaaccaatttaacaagtctatagaaataaatttgaaaacctagataaatggataattttccagaaaagaaagaattaattcatcaaaactgtgtcctggagatgatataattctcaacaaaccattaagtagagtaagcagaaaaatttgggaggggaggaatctatcatcaaaaaaatatataacagtggattcagaagaaattactatccaatacagaagtctctacatttgaatctttataaaggcaccacaaatcaaaattgtatttaaaaataaccagacttatgcgaaaagtaggttagaggatatttggcggcagtgggagaggctggcttggctaaggtaaggcagggccttcatggcgaagcctgtgcctcctgccacagaactagaacctgccactgacctttgcagctactctgatcctgagagtaagagccaagcctagagtgttcacttttctctacattctcactatcgctagatatttttcatctttttgacaatagactgtctaagaggtgtgaggtaacatatcattgtagttttaatttgtattttaattaaataattttaatttaataattttaatttgatgattaataatgtctcatgatcattttatcaaatacctgttggtcatctggttgtcttcctttgagaaatgtctattcaagttatttgcccatattattattgaactatttgttcaattgctattgaattgaattccttatatattttcaatactagcctcttatcacatctttggtttgcaaatattttatccaaatttgtaggtagactactcactctgtttcttctttcctttgctgtgcaaaaacatttagtttgatgcaatcccctttatgtatttttgtatttgttgcctgtgttttggcataatttccaaaaagtaattgcccagatcaatgttgcggaggctttcctctaagttttcttctagtagttttaaaatttcaattgttatgtacaagtttttaatccattttgagttgattcccatagatggtgtgataaaaggttctaattttattctgctgcatgtggatatctagttttaccaatatcattagtgaagacactgtcctttccccattatatgttcttggcacctttgtgaaaaatcaattgactgtatatttgtaggtttctttctggattttcattgcctttccattggccactgcttctgtttttatgccattatcatgatgctttgattactatagctttgcagtatattttgaagtcaggtagtgtgacggctacaggggtattctttttgctcaatagttttgactagtgtcttttatggttccatattaattttaggattaagtttttctagtcccttgagaaatgttctaagaattttgataaggattgcattgaatctataaatcatgttgagtagtatggatattgttaaatttaacgatatcaattattttaatccaggggcatctggcatagggggcacagctcctgaagacattcagagagtctccgacccctatcacatctccaccttggaatatgaggtctgtacaaccagtactattaccccatgtccgacattcacggtgacataagcttcaggggcttcctcataacctcatcaatgttaaaatggcacaggatgaaaacttagctgcttgaaaaatagctactggtttttcacagtgaatacgagcattttagagtagtctttagcttcagaaaccacttctccagggcacagtgggaagaggtgaaagactgcaggcctgacaggctaagagaggacacaacagtaatccagacctcacagacattaagaattcattgaacctgcaaggctggaagggacctcagacgtccttcattctgttgccttgcattctgcctgcattgcctctgcaacctgttgaaccaagctcaaagcgagtgaccatttccatgggtggatacctcactgatacagatgctccactaacacagatatttcactgtatcctgcaatgaaccatcctgtcagaaagtccttctttgcttactgagggtgtttactgactgctgagatagtacacatcagctgggtgattatagacagaaacagcagctttgtgatgctcaggttacaaccccatatagttccagaaaggttctgactgtcacaagatcaagacatgcataagctggaaataaataagaaagtgcctctgtaacaagaggtgactgcaggtctgtgttaatgtactttcccttcagcaattgttatttagtggcttataccctaggtgtgcagaaaagattgtgcctgaaccatgtgactaccatattaccttgtcataattcccctctcttctaatcgtttctaaggcaatttcagttcagttcaggaattacactaaaacagacagttgtaaagaacagataatagtaaaacaatttgagagtatatattttcatctaaattcttttttatcacacaagtttaaataaatggacaaaagtaacaaatgttaaacaaatagttcacagacaaagctctgtagtaatatcaacaaaaaatctaaataaaatattagagaataaattccaggacctcatttaaagaatattgactaacaggggtatattctaagatagcagaatgtttgtaaacattacatatctaagacattaaatatccccaagacattaaatagctgagaagaaaattagaatgatatcctccctggccactgaatataatatgttaaaattcaacaataattattggtctaaaaaacactgaataaaattaaaatagatatttgggaggccatggtgggttgatcgcctgaggtcaggagttccagatcagcctggctaacatggcgaaaccccgtttctactaaaaatacaaaaattagccaggcgtggtggtgcatgcctgtaatcccagctactcgggaggcttaggcaggagaatctcttgaacccaggaggcgaaggttgcagtgagccgagatagcgccatttcactccagcctgggcaacagagtgatactttgtctaaaaaaaataaaataaagtagataattccttaattatatatatatatgtgtgtgtgtgtgtgtgtgtgtgtgtacatatatatgtatatatgtgtgtgtatatgtgtatatatatacacacacacatatttataccaatgatcttcattatttgcaaattctacatttgtgattttgcttgctggatagaatggatagaatatatttctaactccaaaactaataatggcagccttttgtcagtcattcaaagaacatccacagcagagcaaaaacactttgagtttttgatgtcaacattcccagttgaggcctaacaaggcatttctctgtctttttgcttcagctcttatacagggggtgagacaggtggaggagcagtagtattagtttgctgcagaagtaattgtggttcgtgcaaaagtaaaacaattaaaagtaatggcaaaaactgtgattacttttgcaccaacctaacagcctcttggactatgctacactgcctcctactgtctatatttgtatgagcagagacagtaggaggcagtgtagtgtagcgtagcccaagaagctattactgctctggagccaattgcacagggtttgaatcctaaagtgggtacacttaggggcatggtcttaagcaagtcacttaacacttctgaacctcattttctcttttaaaaaataaagcaaatataatttacctggaagaattgttttagggttcaagattataatctatgtgagatgtgtatgtacacatacatatgcacaaattatactaggaacaatggttcagtatttgctaaatctctatttgtgaagtttataggacataacataataagaatcaattgtacataacacacacacattttgtgaaaagaaatctatctgtctgtctgtctctctgactatctgtctatctatctatgtttcaacccaaaaatcatatagatgacatgggctaatactggaagctttattgctaagtcaagaacatggaagtattataatcaccattattatccaacacagtactagatgtttttaccaatttaattcgtcaaaagagaaattagaagtgtaaacactaaaaaggaggcatcaaaaatatcaatatttgtgaataatatgatttaaacttggcaatttcactagagtaaactgaaaaacttatacaaacaatcaaagaattcagtaaggtagtggggtgtgaaattaaaacacagaaatcaataaccttcatgtatagacacaaagacccatagaagacataatgtgagagacaacttatttataatataaataacaataataagaacaaaaagcatgaaaataatgaaaaatgaaaaacattcatttgaggaaaaatttaaaacatttttaacaatcacaaaagcagaatgagacaaatgaaaataatagaaaaagttagaaacagcctcttaaagctgtcatgaacaggatatatggaaaaatacacaggtatgaatatccaggaaaattttggaaacaaggtcaacaagggacattaagtccattagaacaaacaataatttaagtactcaataatttaaaaaatgggttaatagcatctggataaacagacaaatagagtaaactaatttttcagaaatagacccaaatatgtagagaaatttgctatatcataaaggtagcatttcaaataaatcaggtataatggaattttaaataaaaggtattttttgtagtaatttgggaaaatacaacaaggtagtaatttaggaaataaaggagttgggtcaataactcatctcacactaagaaacgcaaatggtttaacatatatatacacacacatacaaatcatacatgtttgtatatatttgtatatgtaaatgtgtatatgtatacatataaatatatgtgtgtatgtgtgtatattcaataatagtgtaaaagacaaggccatgtcacttatgaccatgtactggaaaagagcactctaactatgcttcaaaatgtaaaaatcataaaagaaaatattgatttttactttatagaaataaaaatatatgtttatccccaattaatgtattcaaaagcaaaaggcataacaaactgaataaaagcagttcgtactacagataaaaagcctagcatatctaatttataaaaatctctatattttaataggaaagagaccaacccaacagaaaataggcaacacatatgaacaggcagttatataaattgagtcacaagttcatcacctcatataactggattctgaagaaacaatcttggctgctaacctaattacagttgttcatacacatgtatggaaattcaattttaaaatactttcatcttttattctcgtaataatgacagaataatttcaaaaaggccctctgatatatttgacatctggaaacattactggttttcactattttgaggacataaaaataaatatgttagtgattttgtttttccattttctataaggataattttaattccctttcaggacatttttagatttaaatgaaaatgtaatctccatcataataaaaattaaaaaatcatcaggcatatatattataggcttttctgacagcaaaagtatatttaaaatttaaccaaacagaatccttctaatgactgtggacatctttaaattttaaggcactcacagttgccaagaccacagaacagtgtaactacagaactaattctgcctcttcagggtttagtaggcataatttatgaacatagcttttttttttaatatagtagcagctgtctgagaaacaagacctaaacaggttaaatagctgattacctttgggtgttctgaggctgtttcagtcattcactgttttgactaaatgctttctagaaattgcatcatatctagaacgttcaatgcagtcaaaggaatgcacatttaaaaaattcaatattaaagctgtaaacttaactcagattttgatgcaggcataaataaatcagtgctgttaaatgaaatcaggctatcatctgtctgcctacttatttataactggttttaacagatatctgtttgtgttgtgacttagtatgcattttaaatgtggaagacgctgctgtaagctttgttttattctcataaaaatccaggcaggtactcaaaattaccatatccccattgtatttatgaagaaacagagaattacaagtaattgttaatttgttttgaactagaaaacaaatacaaagtttgatatcatattataatttcttaaacatcaaacattactttcttccaaaaaatactgttatgaatattaattgatagtgaatctatttcgttgaacctttgacataatcaaatccttctaagttctgccgatgttaattgatatatgtgtgttgctacattagtaaaataatttatctttttaaaggttaatgtttgtgtttgtttttaaactcattttctatttttagccatgaagataaagaaaggcagagacaaatatccacgcatggtctagagcagtgctatccagtaaatttttttgcaattatgaaattgttttatatctctatcctccaatttgatggtcattaaccatatgttggtactgaatgcatgaaaagtgactagaacaaataagaaaattttaattaagttctaaatttttaatataattttattttgattatttttaattttcaatatccacctatagctaatggttgctatattataaagtgcacctctaaagcacatgcctaaccacccctgtacatgctagaaatactgtcatcctacatccacatatatctctaatctgtctgcttattttttccatttctcaaaccactgagcaacaaacactgtaagtgttttctaactggaacacctgcttttaatccctttagaccgttttccagacggcaataaaactaacctttaaaaatcaaatcaacaaacacaatacttaatggtgaatgactgaaagccttctccctcatatcagaaataagacaaggatgtctgcattcaccacttctatccaccataatattggaagttctagccagaccacttaggtttaaaaaagaaattacatccaaactgaaaagaagaagtgaaactatctctacttgcagaggaaataatatatatatatatatatgtaatctgttgctatttatatatatacatatataatatatataaaacctgaaagaacacacacacacacaagtacacacatacacacacacaaagtgttagagctaataaattcaaccaagtgaaggactcaaaatcaaccctcacaacaattgtgtctttatacagtagcaatgaaaaatctgaaaatgaaattaagaaaactattctacctacaacagcatcagaaataaattacttagaaataaatttagccaaggaagctacactgaaaagtacaaaatattgccgaaagaaattaaattttttaaatttctaaataattgaaaagacattccatattcattgattggaagatgtagtcttgttaagataacactactactctaaacaatatattgattcaatatatccatatcaaatacccacagcatttttgcaaacatatgaaaactcatcctaaaattaatatggaatctcaggggacggaatactgaagcaatcttaaaagaaggaaacaaagttggtggtctcacacttcttgacctcaaaacctacttcaaagttaaaccaaacatggaaattacctccttctagacagtatttgacagtattgtttgtctagacgtaaacatgtgatccaattctggccagagtctcaacagaaagtctcctggcacctctctgaaagacttccatcactaacagaaaaaaaacaaaaatgctgtaggaaaaaatgtttcttttacattgctctgttctttttgtctgaacagagttgtgtgaagacttcattttggagctacagtagcccctttgcaacatcagaccattgtaggcaattctccatggggttatctattcctcctataaagacttttgccctgggttgtcttttgaaggatgcttgcatggcaaatagtcttgaaacctagaaatagtgtattcctttgggatgagagcagattcgttttcagaccagaataacatatgtgtgttgctacattagtaaaataatttatctttttaaaggttaatgtttgtgtttgtttttgcttttaaaatcattttctctttttagacatgaagataaagaaaggcagagacaaatatccaggcatgctctagagcagttctatccagtaaatttttttgcaaattaagtggtctggctagaaccagaataatggtcccctccaatgcaacagtgagtcaagtttgctagcagtcccattataagatctggtatttcctggcttggggttcctcagttgtgacactaattgagtgtgtgcggcatctatctgagctgttcacatgaccccagtaggacttgcttggcaaggggaaccaatgcaaacatgaagttcatgctgcctgctatgccatgaatcacaaagtattttatacctgacccagaaatctcacgtcttccttcagcatttatgaacctgtgacaggttaattacttaaattacaaacagagcaaaatctcaaacctttcacagttctcgataaaaataactttaagtacaaaagctgacctgctgaaaacaatatacaaaagatggaaatgtacagagccactgtaccaaaattggattatctaccaccagatttttattacatgatttaaaaaacaaaacaaaaaaactacatttttattcagacatttatgaattaaatatgtgtttattgaggaagtaccagtattcttggcaactgtaatgaatattgctgtataaaaggcacattgagatattcccctggcaggatttacattctactgaggaagaaaaggtacaaacaataaccaatgaaaatatatgatcacaaagtaattacagcttgagattattgctatggaggaagaaaaaaaataacttaaaaagtaggagattctattttggatacaacagtcaagaaatgctgacatttgagggctgacctaaaaggtgggaatgagactatcatgagaaaagccaggaaaacatattctggattaaataaacaaatgaaaaagcctgggaacagggcctgaagatcaaggtagctaggggatagcaggggagagaagaatggtgtaagcaaaatttgcagagatggaaagagacaattaataaagaaatctgtaggttaataagagatttagggctgggcgcggtggttcatgcctgtaatcccagcactttgggagaccgaggcaggcggatcatgaggtcaggagtccgagaccagcctggccaacatggtgaaaccccatctctactaaagatacaaaaaattacctgggtgtggtggtgtgcacctgtaattccagctactcaggaggctgaggcaggagaattgcttgaacccagtggcggaggttgcagtgagctgagatcgtgccattgcactcccgcctgggcaacagggagagactccacctcaaaaaaaaaaaaaaagaaaaaagaaaaaagaaaaaaaaaaagaatatttttatttaagatacagatgtgatctaacttacattcctaagaaatcacctttgctgctctgagttgaatttactcagccttgttggatgcctgtaacaatagtccaggtcaaatatgatgatatcttaaactaagtttgggatatgaggacggagcaaaatgtatggactggagacttaaaagggttttttaatggattcaatgtggttaatgagggaaagtggggataccaggaatgatctgcaggctttaaaagtgcggaagtcactgagtcatggtgagggaatagagaaagtggtagaatttttggaagaatgtcaaaagctccattttcaatgtattaattttaaggtagtcatttaatatctaaaggaagatgtcaacaaagtagatggatattggaatggacgtctgaagggagatctgtataggagaaacaaattttctacatctacctcagaaaatagttgcatttaacactatgggactcaatgagattctggagatagacatttaggtttcagaaaagacatcctaggactgagatttaaggcaaggaaacattgaaatgaaggacattagatccattatgatcagtaaaagtatcccaaagtcaaactgaattaagaaaaattgtattaatatatgagtaaatctacaggcagagtatacttcagggtttttagattcaccatatcaataataatgacaacacttaatattaggtgttattatttcttcattttacagatagcagaacttctaaaaaaaaacacaatttgttcgagcttacaaaattagcaaataaattagtggggattaatgcctaggctcatttctatcacaccactcatctttcataaataacacattttatccctcctcattatgatatttacaaatctctaaaactaggaagtccagttatgcatattttttaccattgagaaatatgagcctcaaaaatactagatgacttcttcaaggttacactgataagtgatagattaagggctagagctgaagtgctgaagtctaaactcctgcaggagcctcatctctccctataccccatgatatcatgttgcctgactattcatgcacccattataaaagcagctttatattcttgtctgttttcttaaattgttttttaaaatttacgtgtgttgtcctagtttctcactatgtcaatattttgcttccttgacctttccctccaccaaaacaaaacaaaacaaaacgaaacaaaacaaaaaaacaccgacgatctgtgcaaaattcttagcatttgtggcagcacagactttcagtgagcacaaattatttggcctcactaacaattatgtaccaagccagccctgagcttcaggagtagtattcatatttttataatgaggtataattctcattcactattgtaaagggacataaaatgaagaaaatgtatgcatgtatttgtgtcttgtttccattttcagaaattaatatgtctaactttactatagctttaatattttaattggtcatctcaatgaccttaagttttccccttagccattttttctttttagcccaaatcataaaaatattcataaacttctgccaaagattcattaaatatcaaataataataatgtaaatgaatggcagtgattagcacatttttcattaaatccatcagctaattctcattcatgttataggccaatttcatttaacacacacggatgacttgtaggtcctaggcatatggatcagtacttatttccaagactattttaatattcttttctttttcatacagattacttgtggaaattaacttcttcatattttatatggtaatgtatttgtcagaattaagcctaaatcctctggataaagcttaagacacataaaattatagctacaaaggcacaaataatcagtggccaaaaacaatatgtgcatgtacgaaacagatacacatattgcatacgaccatttattccttggagcaaacgtgtggctatactattagtaacacttttgctttaaaatatatttttctacttctggaagtctgaaaatttgtatcacagtgaaacttccatttctatttgtgctcttccatgacatgaaatacaaaatcagaaaaaaaaaatctagatgcatgtatctacttccaaagagacttaagatttttgttttttaattctctcaacttttcctaattacttcacacttagaaatcctgtcacatccttctttgtcacacaactgggatttacattcctctcctaatacaccatcacaaatgaaaacactgtttctggttccaactgcatattcaatagctgctaagaaaattagaaatgtggactcatttaatgagtcttagcaaattcatacttcaacttagtagtgcaagaagtttaaaaaaaatccgaagtataaatttttgcaaaagatcacaatgagcaaagatttgatttatttaaaggtgaggaaaacggacactcattccttaatcttcccgaggaaaagacaatctaccttgggcaaatgccgaggcaaggtacatatttattaaatgttttctccttccagaatatgccattcaaagctgtcctttatctgacaattcaaatgcccttctaatgaacttcaactgctttcaaatatttaaaaaaattatcattgtatactttctttcacaaaattagcagccactgaatttgccaaagcccagttccagtaggtctttgcagtttataagatccaagtgaatgtgcctagttacgagcctagaagttcaagccctgtaaatgaaccacaccaaaccaatccgggaagagcaaatgccacagttccttcaattcactgtgaccatgtagatccagccccattcaaaatttcctcaagtgctttcaccactttggtttggcaaattgacagctcagaatagatacagtattgatttgtgtcttcacagtggtgcaggtggaactggtatatgaaaggaggcccttgaaattagtatattggcactcttccattcctgatatattttttttcctccctattcaactcattttgatcaggaaagtatctaactgggtgctttgtatgagatcgttaacaaagtaatgcctcttgtttttaaattttttattgagccattagattcagaagaacttaattttcttgttacagtattaagatagcaataaagcctgatttattattcatggaagtcattatttgccacctttaggttgcaatattatggcatttggtaattatgagcacatacagaagtgagaactcatcacaatgacattgtaacaatacatttccctcgtaagagaatgcaatcagtgtagctatttcctacctagcaagaactactatctaaattctggatattttacccttgttccctaaaaatttccagaacatataaactataagttactcatatgagattcatttctgttagtgtatgtatgccatagtgttagagagtatatcattttgtgctaatatgcgaaatgaaacatgagtagtgaaataaatttcaaataagaaaccctagaaaggagtcctatttgccactttgcaatccattttacctggtaaagttactcagtatttcccagctctatttttcttagcatagatagtcagaataacactaatttcagaggattatatgatgtaataatgtttgtgaaaaaacacttctgaatttataaacattatacagatattaaatatcattgataatcacaaggaagtgttttcacagacaggcttataaaataataaatgttattgattattaagtgcttattaagtgttgcttcttattctaagcactttacatgaattaacccattcaaacactacaataacctcatgaagtagttattatagttatcccagttttacagatgaaaacattgagacacagagaagttaagtaacatcataaaacacacattaataatgtggccaagattccaatctaaggaatcttctcttttgtcatatggtttcatatatatcatataatttaacattattttaataatgagataatattggccacaaatgttttttttttcattgccttatcattgccttcctttttcttcaggttttatttttgagaattttgttagtatagtgtcatgaatatgtagtcatcaaaagtggatctaaagaaaatctattattttatgttttatacaaaatagggtgaagataatttcattttcacagaaagaaatctaagacatacattttgcttctaggaaaatcaaactgtaattaattcattattttaagtaatgaaaactgatctatatcaatggatttaggtatgttttgcttttgcagagttttaatagaatctgtaaaatattgctggagataaatatcacatatatatcaaaatgtagaaaactataaatattaataaattcccaaaattttacgttcaggagcttagtctatagaaatattgagataatttataaaaataaaaataatagttcttactgttgccaagcactactccaagtctttttctgatacagtcttactttatttgtacctcaactctgtgaagctaatactgttatcacatcctttataagtaagcaatctgaaatttagagaatcaaattaattcactcaaaattatatcactgcttcatgaagcaccctgaacaaaatttaaacaaggcaattccaaaccactatattataattactattatattgtaatagattattttctcagatttatcatataagaaacaaaattagatgatagaatattgataaaaataatgaacagagccctcagaaataatgccacatatctacaactatctgatctttgacaaacctgacaaaaacaaggaatggggaaaggattccctatttaataaatggtgctgggaaaactggctagccatatgtagaaagctgaaactggatcccttccttacaccttatacaaaaatcaattcaagatggattgattttttaggtctaacttaaacgttagacctaaaaccataaaaaccctagaagaaaacctaggcattaccattcagaacataggcatgggcaaggacttcatgtctaaaacaccaaaagcaatggcaacaaaagacaaaattgacaaataggatctaattaaactaaagagcttctgcacagcaaaagaaactaccatcagagtgaacagacagcctacaaaatgggagaaaattttcgcaacctactcatctgacaaagggctaatatccagaatctacaatgaactcaaacaaatttacaagaaataaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtgaagaaataggaatacttttacactgttggtgggactgtaaactagttcaaccattgtggaagtcagtgtggcgattcctcagggatctagaactagaaataccatttgacccagccatcccattactaggtatatacccaaagaactataaatcatgctggtataaagacacatgcacacatatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagatcacatggacacaggaaggggaacatcacactctggggactgttgtggggtgggggaggggggagggatagcattgggagatatacataatgctagatgacgagttagtggttgcagcgcaccagcatggcacatgtatacatatgtaactaacctgcacaatgtgcacatgtaccctaaaacttaaagtataataataaaagaaaaaaaaacttaaaaaaaaaataataaaaataaactacaaaaaaaaataatgactcatcctttaagtcaaagatatggggcaactaaaatcaatgctgcaggtctgtacttgtgacatgggactgtttttcatctgtttttaagtataagggaataaaggaaataaataccagattttaaaaaaatgtatatattaataattaagttttattattttaaatgtctaaacaaataagtatatttaaaatgttaaatatatcattgaaaatatttatagtaattctctttaaatctctgttagtgagattacttatagatttaactttgcactgaattccatagacaaactaattttgtaaggaatcaatattgcctactgaataagtacaccagctctggagtcagatgcctgaggtgatccatcaacttcatcttttgagcttggatgggtaattggagtctcttcactaacttccctaagcttgcacttactcttctgtaaaataaaaatgtgaataatatatagttcatggaattacattaagaattaaatgactatacaaataaagggcttacaactcatattgctagctatttcttagctatgccatagggtaaaaatttgtttattatattttcttttgttctctaattttactatcataaacattattttaaagtgagaaaaaatcaggacttatctttttgatttttaaaattatttgccaacgtttgcaccaccacaccaccaaaaaatgtcacctcttagtgttaatcagtgttattctgggtagaggtttctaatcttcatctcttctgatcattgttattgatgaattggaaagggcaattaatgcatgcttttctggtttgcatttggcagacatctagtcagaaccatcactattatatcttattgctgaatcaaaattcacaataaattttaaaggctaaatcagctgaagccaaattatgacatttaataaggataaatgaaaatttttggatataattgctagaaattaataacaaaagttagaggatggaggaaacttggcttgaaaacagttcatgtgcaaaagatctcaagaatttcagttaaccaaagaaactaatatgacaagctagcagaagctaatttaatcctaggcagcattaatagagttatagtgtgtttatcatgggaactgatagccgcattgtactctgctctgtcaaaatgaatttgggtcactgtttaattttgcatactaaaatttcaggaaggcaatgaaaactagagaccattatgagaaggtgaaaggtgaggacaggtctgtagttggagctgtatgagaaatcttgaaggtagtatggatgttcaggtgagcatgggttccaggacaacatgttgtcctgattattctatttttccggttgcttttcctatgtctcatttgtttgcttgctcatttgttttctaagctttgaagtgtagcaatgctcagtcttaacctctctttttactttgataacactaactttcttgatgacctcctccagcttcgtggctttaaatgtcatctttatgattatgactcacaaatttatatcttcactctagatttcttcactgaattttattcttgaatatctaaccaatttctgggtatttctcctttgaattctaataaattttaaaattaataaatccaaaattaaactattgtggtcagagcaatattttataaaaagccttcttctacatttatgtattcttcttctacatgtatatgtacattaattaataattataatattaagagcaacaaataaatataagccattccccaggtaaattctccttcatcatatatgtgcgagtagaggctgagtaaacataacttagcataaatgatgaaggaattccttctctgagtgagttacccttaaaactgaatggaaattatgttccatttatgaaattataatatttcaggcaaagtgaaaagttactctatgcctgcagcatctgtagagaaaaagcaatcagtcaatctgttaatcaataatatttttgagctcctactgtgttccagacactacaaggtactgggttgaattctgtcaagcccagtacctatgactgtgacctaatatgaaaatagagtatttagaacaaaggtcacactgaattagtgtgggcagtaatccaataacaagtataattataaaaataggaaaatttggacacagagacacagagagtgaatgccatgttatgacagaggaaaagattggagtaatagatccataagccagggaatttgacaaagatttttggcaaccttctaaagctgtgaagaggtagagaagtatcctcctccatgtccttcagagagaatgtggccccacagactacttgattttggacttccagactccagaaacatgagacaataaatttatgttgttttatgccacccagtttgtgataatttattacaacatctctaagaaattaatataaccaggtattcatgactgagtggttaattgtcagaatggctatctttagagtctagtgggaaaattcatcaaagatgtgattataaataagtgaataatcaaaatcatgcaacacttatgaagatgtaaatacagaatgcttgatattatatccaagtagataggaaagatgtccctgaaatgaggcactagtcaggttctcacttatttactgagcttaatagagtactaggcacaagagtagatatttagcaattacttgaattaatgctgaataaaggtaaagtatgaagtacctataaggtaactaagattagaggaacattctagacagagaaaagcattatttaccaggacaaattttatttagcaaaaaataaagaaaaaatattaaacacatataataaaaatgttagtactagaataaatattgcattatattgtttaccagttataaaatttataagtcaccaaaatttgatgtttgtacatgatctaacatcctgtgatctctttccctaccatccaatctattccctccattcccccatttcttcctcttagtagaatcctaatttggatcaaatatccaattatataccatgtggcatgtgaatctcaagaaaaaatgaagaaaaatgtaataaaacaaaagaatactttcctacttccaataatagattgtgataaaacaaaatcattgtattcccttacaaataattggtttaggaactaaaatttagtctcattaacttgtggtaaataatatgtccaaagaaccactataaagggaaacacattggacctaatttggcccgtaacattgaagtgagtagctatatttcatgcactgggaaagatattttctgtctgctgggtgatattggaaaatcaaatgataagcttaaggcacatcatttggcacatttaataatttattttactttgaaacattaataagtcctcaataaatgcaaatggatattactattggaacggaaacaaaccaactgaccatgggttttagcaacatgaaaattcttgctaatccttgtaagaacaggataaatggtttgggtaggttgagccgaaattctgattagggtagacacaagagaaaagtggaagaagtgaaataaaatggacaaaaatggattttgataaggtttactgtccaaaagtccagagaaattggcagtaatggctcaaaagaatcttctcttgttacagtggttaatttatgggaacaataaacacatttttgtaaactgatgagacttttcctgtaaagatggaaaaacaaacctctttgatagagacagaggacaactactagagcagtaactctcagaaggtgagagggggtgagaaccagtgaacaattacagcaggtaaatcttgggggaaatatcttgtaattgcttcatttcctactctaaaataatgctacattcatcatataaaaaaggaaagagggtgggatgggaggcatcagaggttggaggaaagagagggtgctagattctcgaatctggaaagattaaatttccagattaaaggtgggatggctgaaattaaaaattatgaagcaattatagatattggtaatgacaatgtctaagacatgaccatggtgtgaatgcttagatagaaaagagggcaaccttcccctctgggttattggagaagtcaacacaatgagaggtcggggtattagaagaatcttccctatgaatacataaatgtccaaggattatgacagaaacaaaacgttgcagaaattggcagtgaagggcagctaaaaccctcaaggaacaggtgggatgcatggtagagggtgtgaactctaataataatgatatttaaatctgagggagtttcacacaggaggaagagaaaaagggctcaccttctggccctgttgtattagtattaagttttggaaagagaaaacaatcacaatggtgaaggccacaggagacgcagtgtcatggaagcagagcatatttcagtgcaagaagctaaatgcaatacatagataaaagaatgagtatagagaaattatgctaagtgacctggagtcctacagtctcagtgcaaaaagacttggcagttagggtcagactgggagattaatgtttagcatatgagtgacttgggagtccccggctttttgtattagttaatatgataataagagaaaataaatgtaatcctttagagtaattctgaagttctcaaagagtatggctgtggcaaatctataattgctgagcaggaggcatgagatttgcaggattcagggaccccctccttcatgccagttatggggagaattggtctgatttggagcagaaggagtttcctgatccctccttattcctggtaatggatctgtgggatctgggggagattattttatctggagcatggacactttggggctcccttgttaccctcttggtcatcaggaactctatgacctccctctgcttatttcctacttctgaatgtgtggaaatcagacaagggacagtattatggagaataagcttttagaatgaagagaatatgggttactcatttataaaacattacagtgcctcatagtcagtaactgataaaatatatgttgaattccatttgctgttatataattgctagtctatacttagtatcattagcattttaattggaaagatcatttatgtcgacagtactatcaatagcaacttgtcatcatgatagatgtccagtcttaaattaactattataaaacaaacaaaaattatatttcctatagaacaagattttacaatagctctttttaaagagatactcgtaaaaatcaaactgacatttaaaaaatttgtataggttccttagggagtgttagatatagacatgttcttttcagtcactttttctccaggaacaagggcttcctgtggtgatctaaatgtaggaaatgtatgagtgatgcctacactgtaaattatactgaatcgaccgatgttacaaaacgaggcttaccagattattagtgtcagtgctagagaccaaaacatgcctgtcttcctcaattcttccagcattaaagataggtaactttatcactgtgcattcaatacccgaagggagacagatactactaattagtttgcaaaagccatcatttttggttccacgatattttactgagaatgttaatgtgtgcataaccctaatttttgatgctttaccatcatcataccctggttagtacagcagacagtatgatgttaaaaacggaacaagggtttagcttggccaaaaaaaaaaaatgatttaattgaaagactcttctggagaatagcttcaaaaaatatctgtgtgtctgatgattaatactccctttaaaaataggctttaaaattatgttgtgatctcaatgctccatatcataatataaacattcaactaaagtaataaaataccttataaataatgtcaaactggacggttgttgccttaataatgtcaataatatagataatatcatctaaaatttttagttctcttatacagactgggaattgagttgtatattacgagcttctttcatttaattctcataacatttctgtgatgtagataatattactacttctactttactgatgaaagaaaaaaccctgagagtaagaaaagtgaggtaacttgacttggttactcagctcagacatagtgcaactggaaatctcaaacagtctgcatctcttatatgatacattgtactgcagtttcgatagggtggaacatgtttaaagggattttctaaaaaggtcacttttgatcctttccaatataaaagttattttttaaaaaagaaagatactcccaacttgtaatagttcacatttctttttcactttcacattttttatattttgtcagtaaaggtaaggatgaaaaatttaaaacctccatgtacagtagggcccttgtagttccactggcattctataaacacctgagtacactgtaaggggaaaaaaatctttattctcaattcaattaataaataatttgaggcttaaaacagtaattagcattctcttttttacatagtcttttaaaatgctattagtaaaatgaaatacttgtttaaatcttaatttaagttgcttgatatgttcacagttactatactttgtagttatggccagacttgaatcaaattattggggataaaacatgtctgaataaaaagctgtgaagagtattttgccaaggaccaaaatatacccatgaatatctagaaccattatatattataatattaagggcatgtatctagtacattatttcaattttgttgtatttctaatatttgcttgaatgataactgaaggactctggcaaacattacatatgcataacatatattaagcacacatttacatgtatgcatatgcatgcatgtatttaaatacatattcatgtacatagtgtcagacaagggatcaataagtggagctgggatgatttaaaaattttcttaagatcgtgagaggaatcgggtattactatgctaacccaacttattgattgattgataatggccttctgccttcggtgcaattctaaaagagatgctaacgtgggaccaggtctaaaggggaaaagagaactccatggggaaggagaaacataaatcaataagcttttcatcatacacatgaacagaacctgtaatataaagtatattcagaatctatttctgtgatacatataacaacggtgaatggaaatcagcagattttttatatgcatttatttttaatgaactgataaacattagaaaactttagacataaaatttcaacattccatactcatttttaattggctagtaaaatcatgtatttaaaaagagaaactcaaaatatatttttgatttattttcttacatatagctctcatctcagactactaaatctaatagcatgctgaaaaacctggagtgcatgtattactctcaaaatggttgctaaaatttgcatttgattatgctaaaatggatgttatggctagttttgtgcactcaccgcagaatttcagttttaaaaagtgttttaatgtatccacatgcctgccctaaagctaagccaagaaagtaagaaatatatagaggaaacatggtttaagtattttattttaaaatttccctttgcctgaaaactatttaacttgagaaattacaaacttccaagtatttcattattttatactcaactttaatccatagaaaatatataatgtcaactatattgaatttttaatttcttatcagttaggtatgggaagtattgtaggtaaattgttcatcttaattagtatggagcttgattcaaagtccaagttaaaccaggaaagctttacattatttttaaaagtgtcaagctgttcactactgtaacaatttataatactttaaaatacttctctctcttttcacttatgattatttagtctcccttactatggagtatttaatgagtccttagaacaaaatataattcccttttttaataaaaatggaattattaaagatagcacaattaaaatgtcattatttccagtaattctgatttcagcttgtaatgggtttcttgcactgtttttcaaattactaattatctgttctttagagaatatgaatgcacatatgccaaaaaaggaaaacctctaaatttgtattatttcaaactatgactatgctgtttcttcagtcaacctacttcaaatagtagtttcatggatcctaatcttctctcagataagacccttaaaatatcacatatctattactagaaagagagatattaaaattaaagcatagcaaaaaagataaagatacaaaatttaaaggtaaacacaaactgcattctgctatctatacgttttttctaaatatactgtgttcactgttaatgcttaccatttctatataaattataattattgaaatatttattttatacaaaaattcatattcttacaaaatatactctatggatataacctgaattttagaattaactctggggagtacacagtgcctaccggaaaaaaagaccatttgccctctggaaagggaaagactgttgaatgcatgtggaattgcaccatttcggaggtatttttatagtgtgaagagaatgtcatttttcaagtaaagatttagtaaatccactaaggaagtcttgtacattgcacttttaatacacaaaagtttataaaattaaagtagattgtgatatttgtggtaagaatatatcttgtgtatcaatggcttacattcaggcagctatttatttctcatatcatttttgcctgtggttattgtttactcaggctgccacaagtaaaacttaatcagaagcatattttgaattgctcttcttaatacattattttactaggtaataacaaggaagagaggaagagaagatctgactttatgcatagttttgtctaaattcaattgcttaatgtaatgaaaaacatgtattttcatgcattatgtgttgaaaatagcaaaacctccataagtacagctaaaagaagaaaaatctagaattttaacaggaaaaaactttctatttaactgcactttgtatgcaattcaattatttattaaaattgttaaatgacttctccagattttctaatgtatttcaatgaaacaaaccattgcttcatcttcagtggtctttgaacccagtaaataacaaatatctgtcaaattaacacaagaaatattgagaagtatatgattttataatatatgattgggttatatatatgactaaattaagaaacataaatcttttaatttaattatctctctagagctattgataactgtgtatttgattacaaaaaacctaccttcattcaacttcagtctttgcctctaaagaaagatgcttcctgcactctccaaataattttgttatcaacgattcttaactaagttttattcagttgtaggaacttcctctcttgaacccttgaagagtccatcgatgctctttaagtttttggtaataaagaaaggaacaccatttgttttccttcttagtacttttcaaagccacagtatgtcccttctaacaccttcacagattctctttcattacaatataagaaaaataatgaaagaaaagagcagaaggaaagaaggaaggaaggaaggaagcaaggaaggaaggaaggagggaaaaggaaaggatttttgttgtgctgataatgcaccaggtgtgacacagggttctgaatattaattatgtcatcctcctaacaaaatttgaaggcagagaatattattgccattgtgtagatgggaaacccaggagataataaagttaaataagttatttaatgtcacacggctagtaaatgagtaatgctggaattgaaatccacaggcaacttcacttctaaaggaagttatgtcttccaccaagtaagaattaccagcttttagttccgtttaaattaaactctaatgttgtaataagaaagttatacagtttacagtacatatgtatacaaagaaagcaaaacactatcatcctcagtaactgtagccaggggtgtagatcttggctcaattcctcatcttttcattaaatcttgaccagccagagtaggtttgaatatttccttctttgtaagtcttcaaaaactaggaatctattgattacattaaaacgaccaacttaccagccatcaactacagaaacccatccaaccagttctaaagtggccatcaattattttctaaacaagtggcattctcttttgcattctgctttcaagtatattggaaaataaattttgaaaacataaaacagagcatcaaacagagatgcatatgtatacacaaacaaacgcactatgcattcctaatttaatgatatatatatatatatatatatatatgtaactaacagatttctatattattactaactgatcatgtcttcttaaatcttcccatctgctaagctggatatggggagagggtgcaaatggggaagaaaaggacaaccaaattgatgtacagtcaggtaaacatagtccttttcagtacctaaaacatttccctttacatacatctcccaactcagtatgcataaagcttcacatttctccatttttaaaatgtctcttcaagacaaaggggatgtatgacttccataaccactaggaggtggaagttaggtgatgagtcaaaatgcaatggatgttgtgtttgccactgtggactaagaattaattggtcctgtgactacctctggactcaaaatttagatagattttggtttcttcatttgattctgaacttctgccagtcaccttcttacccctttgcagcctctcttacctacttagcaagtggggacttctggccttttgcataccatttgcaagccatgaagaatcaagaaaaataccagtttcatgttctactatcaccaagcctccatgtcacatcggaattgttcatagatgaatattctttgacaggcttgcaggctccctaagtaaccagtgaagtgtgtcgctatggctcctgttctgcatttcccatacctgtctctgcatttctagctctctttctcccagacctccctatatatttggactcaggcacttgacttattttatctacccacccttaattatcctttactccttggtctgaaaacaatcagttgtgtaccttagatttctttcatattatgttctaattctctctacactgagaatgccttgaaactccttaatataattatattctaaattttgcattccctgaatcagaaagtttaaaatgtgaaatttagatatcacctgtcttgttgaccaagaaacacaactgaatatccttttggagtttgaatacaggaggtgaattaagggcatatttgattatgcatgtgaataattaaattaaataattttaattattaaaaatctccttacaatttattaagaaaattatctcatcaaaaatcataaagaattttaatgtttgaataataataaaaaatagttgacatttttctgagtaattattttactctgtgaaaaaattccctaatctttttcccagaaaatatatatgtgaaactgtcaaattttgttaaaatgataccatagaattaatatcgtgttcagtgaagactttatttttggaccatatatgtacctggagcatatgttaaaggaagtatgtgttcttttaagccacaagctgcagctttaaaaataacatataaaagcacacaaccacaacccaaaagtgatttaattttactttgtgattcattatatgattttagagggtagctaaatgatcctatcattaatgctccacttaacatgaacattagttcatgtttcttgagtaaaaaggagttgtacaatttgctttggggatgaagagtgtgaaagatcataagtatatttaaaaggggataaactctaagttttaaaaccttctctgataatccatatctgattaacaggaagccgactatatatctaaatatagcttacactgaatatttgaattcataggagggatgatgtaaaattctgaataacaaaaaaggtaacctaattttataggggatttacttcttacagatgaatttgtgtctcatgtactaagtataacgctgaacaaatgagtatacgcattctataggtctgtatcaagtgaatctagatagtataatttctatcatattatccttatgattgctagcaaataggctaaataagcaaaatagttttattttaaagaaaattttctctaaaaatctcctgaaacatagtataaaactataacatagctcaaatttactgggcatctatgatatgctaagcatagtgttttatgtttacattttattttaattttgtaattcctaagaggtaggtattattaatattgtaatagcaagtgaggaaattgggataatcaaataaatggaatgttgttccctcttccttgatgtgcctctgctgccaaatcttccaccctttttacttagttaaaaattttcttcacctttaaaacaattttaagaagcttttttgatccatctcttcccagtacctcccctgagatacccgtcttccattatgactttattaaagagtggtcatatgtccatcattggtcaggtttcatggctaatatctatttttatgtgtttgctccagagattatgattactttgtgcgcagaaattactattaatttacctcattgatgtatttttgtgcttaacagacagaacacttcataaatgaacataaaacaatataaactaaattctataacactcttaatacatgctaggtataggtgaatagaaatgtcacttaatgtttttaattaaaaacacaccctcaaatgaaaaacaaatatccacctcccccaaacaaataataaacaaaacaacagtagtatactttgaaaagaaataaaacgttttcaaaaacttctaataggtttccttagttactaaagtagctgactaaaaatagaaaatctacccaggggagctaatttgtgatcctttgtgccctttcatcaaattacaatggcttcaaactaaaaatgaaagtgacacttcgcgagcatgaaactgaagtatatttttataatgtacataaatagctctcatttagaatttctcaggggtttttaatagctaaaaagttaaaatgtgtatgtagtactctcctgttcatagccagtctcttggtaaatgcagatacaagtgaagctgcaagagaaatatattacataatgtttccttgtgtcgaccaccatgtactgaaactagcatacagactatcttttacctaaatataagattttaaaagtctctcttactgtaaatggcctccttgttatggtctgtttacctaatctgaaatttagtctattacaatttctgagataagacacataagccataattaggatcattcacttttagaactgtaaagcatgtctagggcatctaaatttagctactcctggtcttagagatgaatatactgaagctccaatctatttaagtggagatcttaaatttatataactaagaatagtagtttgatcactttcaacccattgctccttaaaccatcacactctctattttcatactttttcaaaaagtcattatttaagtcaattagcatttgttgaccacccatcacactgacattctacataagaaaggttgatatggaagatacaactaaatgaagatatctcaaaaccatgtgaagatgtgactgaaaacacctgatatgacatagaaatgaaagctgaaatgaacgttttgcgtatctgaatttataacaaacctcaaactggaggtctgtcatacattggatattcccataatttgggatcaggaagggattaagattaacagacagaattgtaagctataacttatgagttgaattcggaataaataagtcacaaaacaatattgaaatagtataagacaatgtcaaagtattttaggttttcaaaaattgtcgagttaggcaaaatcaactctactgattaatgtagtaaagaaaaaaagttactgggtgatgtgtattacacaaaatagttatgatacaaagagaaagtttaattctaggaaaattccggttgtttcaaaaaactatccaatgcttttagtcagcgtgaggtttcagcgtgaggttttaatcacttacatgtgattggttacatctgttttcttccatgattttatagattagtttgtatgcaatctcatccaatatttgaaagtggatttgtcacctataagcaccattcttctcatatctccataacaaaacactaattttgttcatttgtctactctatccagggaaccctaaaacatttagaaaatgctgatcttaccagtttcataagtaaatactgactagtataaaccagtgaaggtaatcttaattcccttgtggtgacattgattcagaaacactggttttagataaacatatagtgcaattccctaacaactattatttgttgagatttaagtgtaatacctattttggtctaatcagacctaagaaaacacctcatatgtcagctataggaagaggatttttctctcttttgctgaatataaacaaccaaactttttgcctgcttgcaggcatattgtggccttgaagaaagcctagctgaggacaaataccatatatgcctggtgtagcacagagaagtggctcacccctgtaatcccagcactttgtgggtgccgaggcaggcaaatcacttgaggtcagtagttcgagaccaggctggccaacattgtgaaaccccgtatttaccaaaaacatgaaaattagctgggcatcgtgttgggcgcctgtaatcccagctacttgggaggatgaggcaggagaatcacttgaacccaggaggtggaggttgcagtgagccaagatgaagccactgctctccagcctgggcaacagaaccaggcaccaggcaccagtccccatctcaaaacaaaaaaaaaaaaaaaaaaaaaggaaaagaaaagcaaacaatcaaaaagctagggtttcattgtgttttgaagcatgcccaaacttcagactgtttaatatgtttttttgtttaagccagagcttctaaagtgtgatacatgagctagtaaggagagcatcaccaggagcttaataaaaatgcaaattcttgccacattgcagacctatggaatcggaaatctgagtaatgcctgtgacacatgtgggatgaacaagatctccaggactttctcaagtccatcaaagtgtgagaagcattgatgtgagcctatttaagtgaagatttctgttaattactgtaaatgaacccaaattaataaaagaaaacaattatttttatcaaaccaagtgaaccagttatacatacacatgtagttgtccaataatgttatttttaaataaatttttactcacttatattaattataatgtactttttgaaatcagaatttgaagttacattacccaaccatgccttccattcaaaaacatttcctattcttcaattagcaactatatatatatatatttgatatgaacaactatatatatacttgatacttgatatgaacaactatatatatatttcattacactaggaaaatttgtttattagtgtaatatgcataatctaaaccagacagttaacagtaaaaatacataatcatacttatcactagaagaataatcttttactcttgaaaataaatccacagaaaacattgataaaagatcactgatgtcgtagatgtaggcgtgtataacaataaagtttaatttgcctgctattttttcctcaaaatggaatttacagaaattgaagtaatatatttttatatttaaaacattacacagttgattctagttttctctgtgaaagtataggacatcttcaaaattatagaaatatatgcaattaatatattcatatatgaacattaaaatattaatggtgtgtaataactccttattgtaaattaaaattagttacatcatctttatacttaatagtaactatcggttttagaaatccaatttacttacagaaatcattctatcaggctgtctgttaaaatctcttacaaggtatcttcaatgtagtctgctttgccattaaaaccaccgtgtcgattcacagaacagatgaaaaagtcctaggttcatacactggtgctgaacttagggaatgaatattaagctttatattcaataaaaaatatatagagttcaatgttttagtttgaacattccataaaactggccaaaataaaaattttgacacatgtactttatttatttgttcttcatttatttattcatttatctatttatttgagacaggtctcattctgtcccccaggctggagtgccatggtgccatcatggctccctgcagcctcaacctcccaggctcaagcaattctcccacttcagcctcctgaggagctaggaggcacaagccagcatgcccaggtaatttttgaatttttggtagacacggtgttttgctatgttgcccaggctggtctccaactgctgagttcaagctacctgcccacctcggcctcccaacgtgctgggattacaggaatgagctacctatcttgtccggcaaaacttctggtttaaaaaaggcactacattcacaaagttctccaaaagtgtgcttatatttaattgtcttaaatgattggatacttttctctattatcaaaacattcttttgtcctgaaaacataatcttctgaaccaacgaatacaccaaaaagaaaatggaaacttatttaatattgtatttgcctagagacatataagcataaagaaatgaagtgaacaacctataatataacttgatatgtgtcaaattaagaaattctggcttaaatagaaaacatttattaaatttgcattacattaacccattccattctactgggtgaatcacttgaattctcatgtccacactgaagcagtttgcatagcctcagatttagttcccattttctaacagggtgaatacaaaatgaatgcatcaaaatgcctggcaacattatgtattgaaaaagaggtgccaaaatagcattatcttagataaaataaagatatggaagccaaatggttttattctatcttcactacgtagcacagaacagggaatgtagagcttgtccctgagtagatgaatggtttaatgatcgcatgaggaatgagtcaacacatcagtgtattagaatgtgaataggaaataaactttctagagaaaactgagaaaatgaaagagcgactttgtagataaattgtaaagtattgaatattttgagcttcttctagtttcagagttctcttcaaattctctggatatttgactataattccctttaacccttctcatcactacacacacactgatttcgaataacttttcattccttcaaacaattggacaaatgttttcaagtcaaagtgaaaattatggaaataaatccttggctcagatagcaatgtgtattttaaggagagtttcttaagagactgtatgaactgtatgtgaatttatttggaatttacaatatgccagataatgtacccaccttatctcattcaatcttcagaaaaagttctaagagagctcaggtaatgttacagatgaccaaacctgagcaggaggaaagttataaatactatttgaaccctaaattatgtgaaaatcatgctctttaagtcaaatcactggttattttgcatcctctatagttttgttatttacaaatagtaattctaatgaaaacatttcagtatgtagcaaataataactcatactatcagtacaccttagcaaaatctgacatatttgaatagtttatattgaaggaagaaaaatgaattcattaaagaaattctgggatgcagggctgatatgcaataaaaatatatactttatataataattttgtattgatggacaaaaagaacctggccaaaattatgtaattattgtttcttaataaagttacatatgctcacgacttgatgttatgctcacgacgtgttatttattgtttactttgcttaaagatgaactcctaaaagtgttttaatattttcacagcaacgaagacagaataacattaaccaatgtaagaaaacatgatcttaagtaaaagcagttgatatcattaccttacatttgcaaagcactttaaagttttctaggctctttcatacgcattatgtcatttggcccttcaaaaccctgtgagtttgccagagaatataaattattaacaaatttcacaggtgatcaagttaaggctcagaaagattaagtatcttgccgaataatacacatagttttatagtgtcatttatgtattattaaagtcaactttctttctggattttctgctttctctctctgaacagcagtgattttactctatgagattgagttttattaactgttcccagtttgtcaactggctttaatttcaaaatcaaaagtgaacggttatcataatataattctctgtaaaggctgttaaaagtccttcacataaaatagtatatttctaatacatagaaccaaatatattaaaaaatgaaccaaaaagaaagcgactgttctttaatttatggaagtggttagaaagtacatccatgtccttcatccacattttctgaatcttaggattaattattccacattttcttattttgtagtaataaaaaatatttttaaagaatcagaaacgtggccgggcacagtggctcacgcctgtaatcccagcactttgggaggccgaggcgggcggatcacgaggtcagcagatcgagaccatcctggctaagacggtgaaaccctgtctctactaaaaatgcaaaaaattagccaggcgtggtggcgggcgcctgtagtcccagctactcgggaggctgaggcaggagaatggcgtgaacccgggaggcggagcttgcggtgagctgagataatgccactgcactccagcctgggcgacagagcgagactccgtctcaaaaaaaaaaaaaaaaaaaaaaaaaaaaaaaaaaaaaaaaaaccagaatcagaagcgtgacatatcattttgtagcatgaataatgatgagtagttttgagctctgttgatgctgcaagatcacagagaatggagcttggaggcttaccatataaattagtgcagtatcacattaggacgcaagacacaggcagagaaacgaattcaaactaaaggaaagcaattgctagatacactattctgaaataaagcaaaaacacacaataatattgttctattatccaatgtaatctttcgggattctggatgtggatttagggatttcattagcaatcaccctttaccacgccagacatgctacagcaactgtgtaagaacagacaagtaacaaaattaatccaaatatattcaggtaataagactgaagattagtcagccacatcaatgtgttattttcatcatgttaactgagcagaatggtacagaatgcttagtaatattcaacaaattcctggtgatttatgatgttgaagcagcctgactttgccatttcttcatttgtatacttaaaatatgacttccaaattattatctgcattagaaagagtcatgcatttcttcagtctagccagattagattggagccggtttggtaaagtatgatccattaagtacagtaaaattgctcatgttacattatgtacagttacagcagtgtaaatgtagtgattgttacaggataatggatatacaggctatctcagctctaccactgattctttgtgctactaattcttagacacaatactccactggctactttcagtcatctcactgagaaatcagcaaagaataatttaagaagcttcacaataatcatttatctaccatcatattttaatattctatggaccatatttcataagcttaacacaaatcacattatactactatttctagagcctatattttcgtactgctgcaagtgtcagaactatctagatgaatctcctgacagatcagatttcaatctcaagtgatataaaatagagtacattttagtttgacttttcatctacttatttcttaagaacttgatacagcttttagatgaactgagatacattctgtcctgctgtgacatataccagttaatttaaaataggcaagcatttgtatgctgagaacgcagttttatcattgtggacaaggagtttcttccaaaacagctaaagatgctcttgtctaatttctgttaagcaggaaaaaataagtgttacatgtaaactctaataaagcccaaataattgacctaacagatgttttctgaatttcaaataaataattataagattatttaataatgaatttagttaccttttataactaattcacttcatttaaaagattaaaagtaaagtgagatcagtataaaatgtaaagtttcacttgaatataattgaagctcttttttggtcaagctagatgccatattacaactgatcttacgatatttctgtgtaacatattaagtggatgtatgtcacagcaggacagaatgtatgccagttcatctaaaagtgtattaagttattgaaaaataagtaagggaaaaaccaaactaaaaagcactcaattttatagcagttgaaattgaaatctggtctatcaggagactcttacagatctgactcttgacatggtatgaaaacacaggcttagtagaaatagtagtataatgtgatttgtgtcatatattagccagattccttgatcagaatctctttgatcattatagaataaatttcatagaatcagcaaagcaatttattgatgaaaaatatgcatcctggattatttctgccatataagtctggggggagcagggtacacctacaggagatgagtgtcctcccaattggacatgaatgccattccagtttaccaccttacataatagatcatcaactccacctcagtatacatggcatcaaaaacactaaatccttatacagtcagtcaatgatactgacactccaacctctctccagagagtatacgctttaaggcactgttgttatccttttatttagtaaattatgaaagaaagaatcaacattcaagaaaaaacaatgtaccattaaatttatttattcaaacatgtaaaccctaatttatataacatttaacatcaggaaaagaaatatattaacattaacttaacctcttaataatgtatgtaatgttttaaattttatgcctttggttttcatttaaagcaaatattgtacctaataacttaaaataaaagttgaaacctgtaacaaatttatcttggaatatatccataataaacaaaaagtcaatatcacatgaacacctaaagccctgtattatatacaaatttattacgttggctgagaagaatttccaaactaatttgaaaggtggatcacacaattattttaccccttgacataccatatcctcctcattggaatgtcttttatattccatgacgatgtactttcttttctacatttgatgtactttcttttctacatttgtcttttttttttttttttttttgagatggagtctcgctctgttgcccaggctggagtgcagtggcacgatctcggctcactgcaagctccgcctcccgggttcacgccattctcctgcctcaacctccggagtagctgggactacaggcgcccgccaccacgcctggctaattatttatttatttattttttttttttttgtatttttagtagagacggggtttcaccgtgttagccaggatggtctcgatctcctgaccttgagatccgcccacctcggcctctcaaagtgctgggattacaggcgtgagccaccgcatccggcctacatttgtcattttataaataaaatggtcttgtttcaatcacattggatttaaattattttttttcaaaacgattttccatgtaattatgaataatatacaaaacattttattgttgttgttttcaattcttggcctataaaataggagaattgaactatactctttgtaaggtccctttcagctctaaaaagctccttttgaagatcttaacatagtaaacattagaataaggacaattcagctgattaatttaaaacacatgggtcagtgaggatggtttgtatacttttttacttttctatatttttaaatgtattaaactcttttttctatcacatacattatacaattagttttcaactgagaacaattttgccttccagagaataagtggtgtttatggagaattttgtttgtcacatgggcattgaataggctatcaaccaccaagtattaagctgtcaacctccagatgttaaccatcttagttggaatggtacaatatcaatactgggggaggcctgaagaaatcactcacactaaatcagtggtaaaggatgttatgaggatctcatctccaagggacatttggccttgtctaaagaaattttttgttgtaacaacctggaagtggggggagttgttgctagtagcatctggcaggtagagaccagcaatgcatgtgataatgcataggacagccatccacactgaagaattatctggcccatattatcaatgttgtagtgctgaggtttaaaaaccttctatccagccaggtgtggtggctctcgcctgtaatcccagcactttgggaggccaacactggagtattgcttgagtcctggagttcgagactatcctgggcaacacagtaagaccctgtctctaaaaataataatagtaaataaataaataatcaaaaaactatctaatagaaggaaacagcattattttatttagtatactgcctttaaagataaatataaatgcctgtaggttaaaaaatattactatggacacagcatagtttagaaaaacacacaaaaaaagaatctcattgtctttgaatttctagaactggatctccttcaaaatcacagtctaatattttcccttcttttttctggaccttgtaaaggttattttacacatctaacaaatttaaaaaacagagtacactcttttaaaagtgatactggcattctgttttacaagctgatcattcttgatggaggaggtttcaagcaatttccctttaagcattttctttttaaaaaatgatgtgaatatctcactttgggagaatagaaactgaggattacaaagaatgtcatttgtgcaatacatatttattgggcacctgttgctttccagaatgatgggaaggagcagaccataagaagaactgaagaaataaagagggaaatgcttctataaagcataaggaagaataattgggccatatcctgataaaaatatttgactctttatgggtaaagagtaatgaatgagagaggcagagaaaaataagacaaaggaggcagagagaggacaaaatcacctaaggcatgatgagcaaggtaagggaaaccattagactgttttaagcaagaaaatggcaagaattggtttctctctctttttttatttctttttcctctttctccttccctcttcttttatttcccttccttctttcctattttacttctttctttatttatcctttgctctttaatagtttccttcagatttctgtagctgttcagagagaacagattaaagatgtaagaaatgatattgaccaggactaggttactagtgggggaaatggagggaaaaagaagttaaaccatgcgtgtagtacaaatattaagcccatactcctttgctagtcaattagatgtgagagttatgggagggtatgcctctgatatttttggcctgatcaactagatgaatattattgcctgtcattaagatatggagactggggggaaaggtgtttttgttttttattttttctttggtagaggaaattaagtgttatactgtaaatatataaaataaaggtttcattacaaatgtaaagaaagagataaaaaatatttggatattagaagacagtctgaggtcaggttataaatttggatgtcatcagtgtatagacacaacgaggtaatattaaaattatagaaacagaaaggtagtatttaaacctatagagaatataggaatgtaaaaaaatagaacatctaaaggcttaaagatcaggaacaacacatagaataagaaaagaagactaaatcgttttagaagaaaaactaataaaatatgttgttttaaaaaacaagtgaagcaatgtttccagaaagggtatttattaacaaagtgcaatgcagctaaaggtaaagtagggagaggacattgaatacagtaagagaaaatatgctgatgactctaacaagagttatttcagtaaagtaattgaggcaaaagtccaactaaaatacttagactgaaaaactcaatatcgcaaagatgtcagtttatggatttaatgcaattccaattaaaatcccaacagttttttaaaagaaacttgaaagctcattttaatatttcctagaaaggcaaagggtcaaaaaaaaccaagacgactcctgataaagaagcaaggtaggaagatattccttaccacatacccagactccttttagtaattaagtaggcattttattggtttaaggatagatacacaaatcagaaacacaggaaatagagtccagaaacataccatacattaatgaaccctttctatatgacagaggtggtacccggaagcaacaggaaaaggatggtcttatcaattgatagaggacaacgggatatttattaggaagaaaaaagaaggaaactgaatacctacctcaccccatagaaatcaggtatacttaatacttgaatgtgaaaataaaagtaaagcttttagaagataatagggcagaatatatttataaccttaggatcatgaaacatttcttaaacaagacaaggaaaaagcaatacactagagtctacaagggaaaagaaagaaaataataggccacaatgcaaacagtgattctcctaattgtcttactctgtaaactttgtgtgaacagtaggcaacacttagaaatgtttgtaacagtttgtgtaattttatatctagtaaattgaatttttttaaatttgaaataataaaagactaattgaaatgataactaaagatgaaggctttgaggaaatatggtctatataactaaggtctatttttctccctcctaacatttcactaaaatgactgtaagaattttaaaaagttatgtgttttacaaggtggaataaaaaaggtagagtgaaataacaggatacctgataaatataaaaacacattttgaaatctggaatgcagatatattgaaaaccagtttagagaagtgaaagaaagctaaatcctaagagcttgaaaagatggatgtaggaacagcaagtcaatttgttcacagaaggaacagatatgaggagtggagctaggaaaaaaatcgacgactgaaattctgttaatagagctgtcagaccccagcatcctcctttcctaccacacagcctcaggccactacttactgtaacctatgtttgacatgcttctcccatagcctacttaagccatgaaatctgggattgaatattggaagaaatagcactgacaagcttcctaactttgcaatacctaaaatagcagaactcaataaaaaaaaaagtacctaacagaaaaagagtaataggaaaggttaataagtattggggaagggctgtgggactggatgaagttaatggtattacttggtaataaaacatctaaatatgtgagattttaattgtcatgtaaaatatagattattatttctacaatcttgtgatgaaggaaatttaaaaatcatatactgtaaataatagcatggataaaaatgtcaaacaacaaagaaaagatatatatatattatatatatatatatatatacacttttttttactatgtagtactttttttgttttgttttgtttttttttgttttttttttttttgagacggagtctcgctctgtcgcccaggctggagtgcagtggtgggatctcggctcactgcaagctccgcctcccgggttcacgccattctcctgcctcagcctcccaagtagctgggactacaggtgcccgccactacgcccggctaattttttgtatttttagtagagacggggtttcaccgttttagccgggatggtctcgatctcctgacctcgtgatccgcccgcctcggcctcccaaagtgctgggattacaggcgtgagtatgtagtactttaattactactagtatgcattttttaaaccacactatacatttttggtaaaaatgttaaaaaaattttggtaaaaaatgcataatgtgggttaaaagtgcatggtagtagtaatttaaaaaataaaagtaatttacaaaaagaaagaagaaagggagagagagaaagaaaataggaaggaaggcaggcaagcatattcaattttactgataaaaattaaatgaaatattttgcttcatcacattaataaaatttttaaaaatctctttatgtcagcacaccgctgaatgtgcagtaataactttttaaaagaacttttggacactgtgttttggcattgtaaatattcaaatccttttataaaccaaatctatttctgggaacttaacagaaaggaaggtgtgcatgtgtgtgtctgtgtgtgcacgtgcatgtgcgtgtgtgtgtgtatgtgcacctgtgcgtgtgttttgtgtatattaactaaaaattaaaagtttcttaaagaactatcctaggggactgatataattaggcattctatatgcatgtgcaaaatatcatacaactacttaaaatgatgatgtcacctataaaggctgctcaatgatatcaggccctaatccttttaacttgtaaatatttctttaaaaggaaaaagtgtctttgcagatataattaagtaaaatatctttaaatgaagatattattctgaattatcaaggtgggctataaatcaaatcaccatatacttagacagccagacagaagagaaggcaatgttatcaaggagacagagattggagggatgtggccaccatccatgtaatgctagcagccaccagtaactggactaagcaaggaatggattgtctcctagagtcttcacagggagcacagttctgtcaacccttgatttcaatctagtgtaacagactttagacatgtggccttcggtactgtgacagaatatatttctattattttaagccaccaagattttcgtactatgttacagcagctgagagaaactaacataccatctatattcattgacaaagaaaaatgcctatgttatattgttaattttaaaagtcaatttataaataatttatgttcaaaaatacttataaaaccactgaaaaaaaatgttaacaggaattacacataaatattaagattatggataatttaaatttaaaaaatattttattttatttttagagaccaggtgttgctttgctgcccaggctggagtgcagtggtgtgatcataggttacagcagtcttgaagtcctgggctcaggcatgagccaccctacctggcctgatttattttaatctttacgatgaccatgttttatttttctggtaaaaatcatgctattttcattttaaacaaaaaataatattttttactatagacagcaaaatattcctatgtctaatcatctagactaaagtggcatagtcagagttttctgagggtattgagcccagtgaagtgccatgtgtactctggtgcagttttttttaaattttcataattaataatatttgaggttgaataaatcactgtgttttttttttgttgtttatcagttagaaattacatttgcctgctaatgtaagagatccaagcttagtgacttccatatgttataggtttatttttgtgtaaaattaatttgaaaacaggacataaagggctggtatagccactctagaggtcaccaaggaaacaactgttttctgtctttgtattctgccattcttgtttcatggtttcactaacaagggcattagattagcataaggtatctgttgggccaatattctaggaaaatagaaagaggcaaatgggaatatactcccagttgagtctttgctcttttaaagagttgcatccaccaatatccatttacatctcactgggcaacccaatctgcagcaaggcaacaaatacagtcttacgagtgacagcaatgttactaaggcagagggagattaatactggtttgaaaaatgacagtctctcccatactcatggaactaacaactaaagatagctctgagaagcattcaaatcaagatagaagaggagctgctgtcatgacatttgttgccaatcttatacctctagtaatcataaatatttggtaagatttctctgtcttgagactaaagacagactcggtctgtttctattctttacccactatagactataaatagattaattaactattttaagtgcttagttaaaaatgtattcaatttgatttatatacataaattgcagagaattggacctacatgtaaaacttttaatcaaaattcatgttgaatttgtgataaagagaaccctgcctcccaacatctatataggacacagcatctttcttttgcatcaactggctgagcagttctcctctaacatagcatctgcaagtttgttaagtaaataaagtttgttaagtaaatcttggtgaagcacacgcctacctgaattactaccaatcaggatatgaattcataacatgatctctacataagtgactatatgttgaagaagcatgataaaacaaggataaatattgtgtaactgaattccactaatttgcaagccttcaacatataaattatatggattaatgataaatatttaatggcttcaattctaattaagcatgaatagcaaaataaaaccaaaaaagcccaaataaatattaaacaaacacatcagggaacaacttttatctaaatataattgttactttttaaaggattactaaacatatgtatatgagcactgtataaatgaaaatctagatataatataattcagattttaaaaaatcttcagctgggcacagtggctcctgtctgtaaactcaaatagggatgctgaggtgggaggattatgtgaggccaggagtttgagaccagactgagcaatatagcaagaccccttatagaaaaacattttttaataatcagccaggtatggtggcatgcacttgcaataccagctactcaggaggctgaggtgggaggatcacttgagctaaagagtttgagaatgcagtgagtgaactataacaccaccactgtccgccaagctgggtgacagagtaagaactcgtttcttaaattaatatacatacatatatttgcatatatatttttaacaatgttccatgatatacacattgtctatgtttattttacaggttttcttctactgtgtctcagccacattcaatatgttcctaagttaaaatacattttggtcccccttgaatgccttttaagttgacatatggcacaccacatgaaatcttaattaagtgatgattaccttaatacacaaatccattaggttgtctcaataactataaacaccttcaaaggttcatgtcattaaattatttttgcttatttctcctccacacccatattaggtaaatattaatcattatataagacagaattcttagctctgcttggattatgcacaaattgctttttctatatttttaagttgccaagttttcaatctgttgactgactaataaacatccactagatggtaatagtgcttatatgacccccttgccaccacttgcccaagagccccatgagagaaaaaatgtgatttacactaggcataactgctgcccctagaggagttgctagcacattgtgtgtgctcaagaaataaccatgaacttcagcggttaaactacacttcaaaaacagaaatagaacatagactcattagcatagcatgaaaggcttttatagtgtagtaggtgtccacagactttcataacaacctatacttctaagaatttatgtctctaacataaatgagataagtaataatgatgtaagcatttattcagcataaatataccctagtcaccgtgaagtgccttacacatattatcccatattatctaaataatactatcataatctactacttgcaaataagtaaacaaaggcttagagaccataaattattttaatcccaggttttgcagctattgacagtattactccagaaccggagtctttagctgcagtgataacctgtgcctgttaacaggaaatacctcagtaagtagagacaccggaagttttcctccagatccaagcaatttgggattatctgtttctctggattcatcactgtacctaaaccagaggagttatatgtaaaggattaaatacatggtttatttgatatgcttacttcagaaactaaaattagttttaagatgctccccatgtttcctgttgctaaggaacttacacctcagaattgtgtagaatgccctagattcaaatggagaacaaaaacaattttctgaaatacagtaaaaatctactaaaatgaaatcacaaactaaggtaaataaaactcgtttaagaggtgatttttgagaaaaaaaatataaaacctatctggctcttaacaaaaaaaaaatcattttgccataaaagaaggcagagaaataaaattatatcattggacttcattctccttgaagaaagatcaaatacagaaatacatattttgtgcatttgtattgctctaattttacagtaaatatttggcagaattcttcttgtatcgatcaatacaatatacctattatctattaatatttattgtacagcctttattcaataacatatatttacatatttaagctatgcattactgatacaatatttttgctgttgttttaatacttcccaggaagttatttgtcaaaaaattaaatatgtctttgttattttgatatttgataccaacatacttgatacaaacatacttggcacttactgtagcatatgtttttaatgctaaataattggcccatctctaaagttaaaatagatgggcttgaatagcaaacaatataaaaatatagacttttaaaaaacttgttataaatgcaaagactattttaatatgatataaggtactttcttctcctaaactaaaacaaattatatatttgctgatatgaagatgatgagagggaagaaagaaatattggaagctgtgtgccatttttaataacttacaaaaatagttgtttccttttggaaagcaagatgattgatagctattattcaactcgattctgatcaatttaaaggcagccagataacacatgatataaagacagaagtttcctctatgaatttagataattagttattaagtgcagatttggaataaaacagatttacaatcaatccctctgctgggcatctagttctgaggttaagtatacctaattcctgagagatttcagcacagtgacttgcctgattagtcttgacctaccaatgcctttaacatcctagctaaaagtctcagggctgtagtttctccctcttttctcactagaatatttagccccccaccatgcctggctaattttcgtattttttgtagagacagggtttcatcacttgcccaggctggtctcggactcctgagctcaagcattttgtccgcctcagcctcccaaactgctgggactacaggtatgagccactgcccagccttcttattctttttatgaattaaaatgttagtcaatgtcacattacgtttgtgaccccgtattccaaatattttctattctattgtttaaaactctcctttccatatcttacaattttgcaatttgctcttcattcttggtaaatgtttaaattttccttctcattacacgtatctgaacacatcgtagatattctactctgatcatgataaaaaccacccaaaataaataaaactggccaattttaaaatgtgaaataaatccttttaggtataatttgtcctgaaattagatatatattttttatgtgaaaatctgcaaaacagaaaaacaacatagcaaaaaactgagcttgagttttggttacagaatcctgtgtatattattgtctggaatcagtgtatgaggagttacgtaaggtatgaagggaatattgtgatcctcctcatactctggcttcataacccagctataatttaaaaaagaaaaagcacctcggcacactcattgtattgttttcaagcccaaactaatgtacgatggatttttattaaaaatattcctctgagcttttatatttactaagaatactaaattatatgatttttactatccatatcatgcttcctaaagtatttgtgtttctgatactaaatgattttcatacaaaatctgaattattctatattttctatgtaagataccatttataagctggaggtcatttaacttgtctaacaaagcaagcaaatcttaaaattaatattctctctttagttaaacttccaatattagaaaattctgattgcatgcattcttttcatatcaaaaggggaaataaaaaatgaatgtttcaaaagcattacatttagaaaaattaatctaaaaactgaagctaattttcaaaaaaatttctgtcattgcaagacaccaatttatgattgaattaagagttaagaaatcagtaaatacagcatgtctctttttattattttggttctatggctataaaacataaaatgtatatgaattttaagtttaaattattggtcacatttatcaaataaaaatcattttagtaatttataattgagtttgaagctgagtaataagcacctaatatacctaaacttggttctaaaaatatcgtatttttattgtatattgtataatgaatagatatttgaaataaaactaaactgaggaagtagcttataccaacttgtgatagctgacaccaagtgaacaaagacagaaaaccttacctccttcatccagtttctcatacattttctctgttcagttcctagttttaaaacgttatattcacatatacatttatacacacacacacacacacacacacacacgttagctttctaagaaacacacaacacacattaactttctaagaaactagtaatgaaacaatagtcacaaatacacagaatgttaaagcaaaatactggtgtatcaaaccatgttaactagaagaaaaaaagaatccctgattagaaaaaaaaaatactcccaggtcaatatgacaatgaaaccaaagactggtttcaaatggggttggcatttgtttttcttgagaggttatacaaatatcagctgtgttggtataatatgtttgcaagcaagccaaatttggggaccaaagtagattcatatttataacaaatctatatatgaaacttaaataagattaaataagcaaacagatggttttgcaggtggtcatgtcttaaaaactaaagctattcaagaaggagcgtgtattagtgtcttgaagcaaggatggacacaaacagctgctctaagaattttctattccactgagttgatatattctgtcaatctttggccacaattaagttttcaattgtcccaatatatcacactcactaaacagtctgtgttaccatccctgaatgtacacctttaacaagaatatatagcatgtgtgcaaaaagttgtagattgtcagagcttggaagaatgcaataactgattattcacaggggagaagaaaagatttggttcaggaagtaaatgcagtttgatagactttccaccatcatcagagtaggccaaaatcaaatgtcaaacaatcactttgtaaccctaagttaaccaaagtgatccattcattaccctctaaaagaagatttcacatttcacaaaaaatgtccactatttcaggactacatcatttctaattaatgtctgaattgtccatataactttagtaaagtgttaagttttgaaaactttccgtttggagaaatggcaactttcatgctccaattgtagaaaattgtagtcttcaaactatcatgtagtcttcaaactatcatcctcagcaaaatcttatacttgaaaattgaagcatcacaaattctgtcacttatccaggtatcatcagctatctcatttaagggaatgacaaaaacagcttaaattttatagactgccatgcataaaggagaatgttagaaaaagacaatgtttccagggagatttcggctcttccataatctaaaggtttctatttcagttaccagaaagaggtcagaacaagcttgttgggtgaaaactcttgagtccagaggtatcagtttcttgaccctatgactttagcaaatataagaattgcatgattctcacttagtatgaaaagaatgacacatatatcaccttggtactaactattctactcacaacggcacaaatatttaacccaatactaattgtaactagaaaaaaaatgattcctgttataatccaataaattgctaatcactaaattctccatatgtattcacaacaattgtccaatttcttaagacaaatgttttgtgtactagctgccattgaaatgttacaataacaagtagcctattcacagataatagtgaaggacatttgaacaagattctcattattattattattattattattattattattattgccagttgaggtagcataaagggcaactaggatttttgggtaactctgggttttggcagactacttaggccactgataaactgttgaagatgcaatgttttaaaagtcatactaaaaatggatctacatgttattttatttaatctctatagaaatttataactatatataactatgaccataataaaacaaggtaatgagatgttttatgaaagtaattgattccctatgttatgaatatcggcatcatttcttggaatgagtcattaatgtgaccatataataaatatcacatgtcacttatgtgaccatataataaatatagacatgtagttgctatgtgatagatagatttgaatccaggcaccaccactcactagttctgtgccattagacaaatcaaattttttaacttcacgagttcatttcttcatctgaaaaagtttactagctatagtttttgagaaaatcaaagtggtcatgattatgaaatgtttaacataatgttaaatcatcagacttccagttactacttttattacttatttatatttattttgtggacattccttgcattcttttcttcttctttgctattttagagaccactttactccttatctttttgctggctacttaataagtctccatctagcacccatttctaagaagtatagctttcctgtccaagtttcccagagtgacactggtatttcatcagatgactgaatttatgtgccagttctgcctcttaataattgacctgaggataattctttaacattttttttacatctcagccttctaatctatatagtgcaaatcatagtggtacttaactcgtggttaattcaaggtataataagacaatgcatgacacgaagcatttaaaagtgtgcctgcgtccattaaatgtgaccaatgatattaatgaatacatactcttgcttgccttagaatgtggtcgattagtcattttcagcatagagatggttgacatattttgaatatattaacaaatctagaactgagaagatcatattgctcagattctctatgaacctcagaaaagacatcagaaaattcaatcctgtattattggattatttaaactttcagaaaccatcaaagcaactcttgatgaaaactgacacctgctctagggaagtcaacatgaaagatgacacatttaggacatatgctgaaaattcatcagaaatgttccctgatgtgctaggtaactagaaacataccaatcaccagagtagctgcaggatttctagaatttataagggatgatttttcatctgtaagtagcacatactggtttatcacaaaaggccactttccagaaaaagagagctgaagttcgctttttgaagcgtgagactagggcaagaagggaatttaaagtctaaacctcattcgaaaactagagtatttgaatatttttagatttaagcatttgttttatgtttgtaatttatggctgaattaaaatagtttttccatattacaatcttcttttgacatatatgacttacaaagctggtaacttctacagaagttaaaatgctagatattattactatatttcaaattatcattgtgtatatttttaagaatccttgaaaaactagtttttctcatctgatttttgaagtaacagatgtccacttgcagcctaggcaggcagtaagcttccattgatccttctcagtagaaaataagggagggatttttgctagaccccagacccttcatgctactttctaagatgagcaatactttatgtttacgtgtattccagttatttgtggggaggcattcgagacatgtattctgctccccaggaaggcattaaagcaccaaatagtcattaagggccctatgactcctatgactcctacattcttctatggggttttacctcttactttatgacagctgaaaatttctttttcactgttatagagttcaatttatttaaaaaaatcaccacacattttagtatttaggaatggaacagagtctaaggcagcccccagtccacaattttgacttgagttttctgtttatttacataacataaagtcagtgagaaagtattaaataaacattataaatatttaaatatgttcacaggatagcgtagaattttccttccataatactatggcactggcagcatacaatgccaaacattattttacctttacttatttggcaatttgacaagaaaaatgttgcgaattactttaatttttgacttatactttatacattcaatatagcataatcaagacattataaagaataaagtgttatgaaagaatgaactatttattcaaatttttctattcacaagtgaatttctcaaactgttgactttacgtatttctcccaactcctccaccccctaccctaaactatcatacatatacacacaactcctggcactggtgctagatgtaaggattttatttttatcattatgacagtttttgttttacattacattatttttctcttatagggattttataattttgtatcactgtaatccaattttaagcaatgcgaagcaagtttatgttaacctagtttcagacttgctcataacctgttcttttattgacttcacattcttaaatattacattacatttcacttcctagttgatgggagttccacacatgggactttttttgttggtatatatgtattttatttttaaatatagtccaaaatatatatagtcaaaaatatatatagtcaaaaatatctatatttttgaatatagattaagaacttaattctcctgcctctttctacaaaagaaaacttcctatgttgtgagttctaaccttcattctaattctactgtggatattacttcagtattttctggaatgtgttgttatatagtcaaattattgagggcggcataaaatatacaaatggttacagctttccaatcattcataatcataagtattgcccctttgttgcccctctaggcccattaagagatgtcaagtctcagaaaacaacctgatgttgacagaggagcattttaaaattggaggtagagtctttgtacaaagggaaatacagtgaggaaaagtggagaacgaacattgttagtaagatactgtcatagggactttaaaggtttatacattcctttaattcagattgtcaagcagctggtagtggcttagtataacatcccaactttgccccagtaagaaatgtcttatagaaatttgttctagaaactctaactggtagactaccttcctgctgtacatataagaaagaaacagtgaacagtaagagtagtagaaatatatttttgtaataactgagaattttagcgtttaaagattagatcatataaaaacaattatagagaagctctaaaaaataccacagatcatggcaaactaaatctagaagtctctgaaatattacctttagaaagtcaactttagaaagcattttcctttctaacagaaggaaatgcctatattgtatcaatagtatgcaaagaagtaagtatgatgacatggcctgtttgaaacagcacaccctgggaggtgaggagagtcagagaaagaaaacaggatccaattaaagggaagatgaataagaggaaaaatttaaaggaaaccagaactgcagcaataaaataaaaatcagattgaatgcaaacacaaagagaactgacacttcaaatagcaagagataaaggaaaatattgaaaatctcagaatgcaaaagaaaataacaaagtttaaaataatgacagacaatataggtgatagtttgaaggtgatattttggagaacagaagaaggatatgaaacctatgaactaaaagtgttatataacagtttacatagatataaaataattgataaagttagatttaaaagacatatgagttgaaaagagatctatacttgtacattgaaatgatttaacaatttcaaagcaataccaattacttaaaaactcagtagactgatgctggcaagcacatagattttgtctcaacataagcatagcatacctcctaataaatgaacagcgttttcatattctcaatcaatctctagtggccaatttatttcaacaatggagaaagctcacagtatgctagaactaagaaagtgccaattcacttgtttcaaagaagtgtgaatttttaacttggaaagaatggcaattccttctactatgggtctgtatcaacatatttaacaaggaaatattgcatattatggaaaagacttccagttcaccccttttactagaaacatgatctgtaagccaaattaaagtaaaatgaaaagaggcttagccacgtacaatgttgcacaacagctaagttggcaaaacctttgtttgaccttaaataagtatacttgttagaattatttccaaatcaataaccattagacccaaacaatgttgatttgtgcctttctgaaaggtaaatggcttaaacaaaatcattgcaataaaatcttcctctctaacggtattcctttcaacaggaagccaataaatctgactctcatgaaaagccaataactaacaaaaagcccagcattttatttttaatcagcaaaaatttaaatgcattggcatatacaatgtcagtattgcaaaaaaagttctgcaattatattttgatatgaataacatgctgcttgaaaaatgaaacattcatatcttcaatattataataaaatctgaggattgtaaaagttcatatatatcctttattttggaaacgtgtaatgaaaaaatatatatccaaaggcagagtataatttcgaggattgtttctaagtgaagaagtaaaattttcccagtctcacctttatgtagactacatgcaaatactatgccattttatatgagacttgagcatctctggatcttggtatttgtggagtcctgaaacaaatacccacagataacaagagacaactgtaatctacactgcatgtactacgcccagaagataataagacaggttgagggtttcttacccaaaatgcctgggaccagagatatttcagatattggtgttttttggctttaggaatgtttgcattatgctaattgagcgtccctaatccaaaaattccaaatccaaaatgctccaatgagcatttcttttgattggcatgttggcactcaaacaaacatttttagattgtagagcatttgggatttcagatttttcaattaggatgctcagtctgtagaaggaaatacaacaaaacaaatttggttgtctctggtggtagggttatcaaattattacaatttaaatatttatacaaagccatgttccaaataattttgtttcctcatagttttcattagtttacaattatgcctatgaataccaattatttaattaattaattaaaaattagacagttgtgttatgagtattataattttgaattctggattaacggaacattattttgtaagcaagttacttaactttcttttatatctcttggggagtccaaatgatagttatttcagagattagtatgagaattaaaagatacaatgaatataaaatagccagttctgcctgtaacatcagagtaatctccacagatgttgaaattttttaaggttaactctcttatctttacacttcaggtatgtatttgtatactattctttctagtgttaaagtgttatacctttgacatcaaagactttgtgtattacatagaataaaattctcagatgagatttgaaaacacttatatttatctaatttctatgggtatgaaaaactagacatatttataaatagcgtatgtaaaattgtgttctctactatttggccagggtgcttgtgtcttttgattgtaaatagaataaagaacatgactctaacatcttatttaaataaattcttgtgaattttaaactcttttaaaatactctgtgtgcactcacttagtattaaagtgagtactaaatataggccttattaaagaactacatgtaaaaataaagaaataagtcatacaggtaaaatcaattttgtacaccctttcaacaataaccactctgtgtgatacttataaaatagttgaatgtaaatcacatttctgaaacaagtttttatttgaaatgcacagggaaatctcctttttaaatgattcacttgtgactcactgttaaaggtaataattgtttattaattaatgagtatgtaaaatatttgctaacaacatttttaaaaatgagggtttgggtagcaaagaaaaatcccttagagcctcaagaaggagtgcagccttctgacctatttagatgcctggtcttcaaaacagtaaaataataaattgcagatttttattttaacttttattttaagttcagaggtacaggtgccagtttcttacacaggtaaacttgtgtcatggggatttgttgtaccaattattttatcagccaggtattaagcctagtatgcattaggttttttttttttttcattttctccttcctcccatcccccatgccccaaaagaccacagtgtgtgctcttcctctctatgtgtccatgtgttcttgtcatttagctcccagttataagtgagaatatgtgatatttggttttctgttcctatgtgactttgccaaggataatggcctccagatcctttcagacaatctctgcagtgccaagaagcaaagagattaagacaaggcaaatatttttttttcctcagtaggaaaaaacataagaatagttttttggttatgagatattggcaataaagaggaagagattgaactagaaggtatgcttttcctgaataaaaaaacaaaaaacaaaaacaagaattttcattaacacaatctctaaattgcgttgttttaagccattaagtttgtagtaatttgttaacagcaacaatagaaaactaatttgtctattgatactaaaatatactatgaataaaaattattttagtttttattcaggaaaaggatgccttctagttctatctctttttctttattatcaatacctcataatccccccccaaaaaaactcgtatttttttctaatgaaaaaaagtatttaccttgtcttattctctacctgttgacactacagaggtcgtctgaaatttctatcttgtttgtgttcatttaaaacattgtgcaatcaagattctatctttaacacccaccaaaaattattctttcaattacttccatcagctatttcccagttattcattctttaatttaataaaatgcatattattttgaatgtttccaacacaaagcaatcataaacatttgagatgatacatatcctacttaccttgatttgatctttatacattgtatatatgtattaaaatatcacatggtattccataaatatgtacaatgattatgggtcaactaaaataatactaataaaacaaatgcatattaaacttattgcaataatattttccaagtaaattttttgaaatacaatttaaagcatttaattggattctcaatacatgtttgttaaaatcaaagcttaaaggccttaggtttaagatcacaaaaatatgttcaaaataacctttttaaactattgctgaaaataatggaggaaaatgttgaatacttgctataaatcagatgctgctttagctactttacatttactcattcagtcaacatatatgaagaaaatataagatttgtgaactcagctcacaataaagatacacaaatttaaagaagctgtcactttataaagccattggaagcaatattaaaattgagaatgcatataattttttgtctttataaacacttgttctacagatatgtcagtgcctgtggacaaaggcatatgtgcaaagatactcatttcagcatagactggaaagaatttaaatgtatagcactagaaaaatgtttttaataaattgtggtttttacataatttggaaactatgcaaccactacaaaaaatatggtagacttttgtataatgaagtcatggtttcccctaataaagaactgagaaccagtgagttgagttccaaaatgagatgaaaacttacttttcagcaaatataattttgcactgtttgtttgtagtagacatattcattacttactgtaaatattattctaattgtatcaagttatctaaagatttttaaattttaattacatctttctttcttcctttttttttttttttgtgaaggagtcttgctctgtcacccagactggagtgcaatgaggagatctcagctcactgcaacctccatctcctgggttcaaacgattctcctgcctcagactcccaagtagctgggattacaggaagctgccaccatgcttggctgatttttgtatttttagtcgagacagtttcaccatcttggccagactggtctcgaactcccgacatcaagtcatctgccctgcccgccttggcctcccaaagtgctgggattacaaatgtgagtcaacgcccagccaaaattttaattacatctacctggtttttaaagggttatgttactagtatatatttttacagtctcaaacatatacttaaggaacataacaaaacataatcttgttacatgagattctagaaatattttatatctatagatactttcttgacatttgaaggttaggacacgtctaagaaaaacttgttcactttaacctactctcatctgtttttccccatgaagacgtcagcattaatcacaaaatatagatgtttacttcaaatttgacttttaccagaggttaggtgaatcagagaaaaaacattttcaaacatctcaagtcagtcagttttgctcttcattaggcactttgccagcagtcaaatttgagagggagagggagataaagtgcacaatgtgattaaaagagaaaaccatgacatagagctaattgctaatactgcttacagtttattacttattcttagaaattagatagaacacaggtcaccagaaatgaaggattagtcaaggtgaattagaaaaatataggagggaaagattcaatcctacaatgtggggcaattttatctacatttctttgcactgaggtaagatttatacaaggggctcagtgtgcctaagccagatggtaaagttcagagtcccaattttgggtagagaaataatgtaggaagagggaagaagtcaaagcctcatagctaaattgtataattaaaatatattttggtattacacgtgagtttctcttacttaagctgtgcaacttcaactattataagggataatttccaattctcaaagacattcaaagatcatcagattcaaaagcagtgatggcatactacattttcttctcagtgtgaaatgttgaaagtattgacaaaaaccataatttagctttatgaagcaaggaatccagttgctgtgtttctcactgttggagtcaacctataaattgaaacagttcaatcccaatgtataatttataagaaatcaaattaatggtgctgtaaactacttaaatctgtttatcctgttcaaatgataattgtataaagtgttttttttttactcatcaagcttattgttgagtaatataatgtctcatagaaatataggataatgtggtaattactggaaggtctcaggaaataggtaatttatgacatactacgtattagctctctagaaagaatgttagcttgaggaccatgaccaaaagcatagtgcatttctgaattctcataacattatttttaataaaaataattccagaaatgtaatgaaaatttgactaatacatttagtatggctattgcttaattaattgattgtaaatgcatttgattttctctatgtgtaggtcaccctcaaatatttgtatgcaaggttaaaagaaaatatccagaaattttattttgtaagtgttcttgtttattttaattgttttttaaatttatttttatttacttatatttttagacggcgactctctctgctgcccaggccggagtgcagtggcacaatctcagctcactgcaaacttcatccctgggtgaagctgttctcctgcctcatcctccctagtagctgggattacaggtgtgcacttccatgcccagataatttttgtatttttagtagagatggggttttactatgatggccaggctggtgtcaaactcctgacctcaagtgatctgccagcctcggcctctcaaagtgctgggattacaggtgtgagcctggccttctttattttaaaataatcatattaataaattattaaactgaaaaatgtgaagatttcacttcaaatgaaaaaaatccctggggaaaatgaacacacacatgctcagaaaccgtagaagtaaaccacagtttttttaaagagaattttctgctgtgtcactgtatttgtttttctgccagataatgcaaatgatatcaatattagtctgcaatatgatgcattttatttgaaaatgttattcaaaagcttatctctaatgctgaaataattcataagaaaaaattgtttctaaacttacgacctctaatgtacatttatttcactccaaaataagaaccaaataatgctattaaaaggactatactaaaggtactaggagaacaccgttaacaaacatgttcatatatatacacaaataggaaaaatggtgcattagaaataaacaaaactgcaaaaaacaaatatgtaaatccctgataatttttataaaacataatctttctatccatactttactactgccttcattcacatgagtcaaattatggcccagtaaatatagctttcttacctaaaaaacagaaattgcatcttcaacacaacagtgcagtcatgaaattctactccaattgaaaacaatgcaatttctggttgccatttagaggtatatttcttctatttctaaaataagttagtttaagggccataacatgcagctggcaacttatttgttcaaaattttccactcacccttgagccattaaagaatggtgatattcagaggccatatcacacaatacaaaagtgaaatccatgattttaaattattaagctttaaccatctatccatctgaaatttccatcctctaaggcaccatgtgtgttttagtgtctataatttcagcataaaagaacatggcatttcggggctgatactttttgaacaagataagaactctctgcttttgcctatcgttctactgccacgttaagaggtgggactgaattaaagcttctgagtctacaggactaaatagaggcatgatcctgttttcatgtttctcagctgaatactaatttaatccatctgtggaaatttgtgcatttgccattagaacaaacaaaataatggatctggtacagtttaggattaaccatccagaagctgaaatttacctaaaattcacacttaatggtcatatatgttatttgggactgtagcaaaagattagttgtctgtatccatcaattataaacatagtctatgtttgcttttaatttttatgaaaaatacatagtttataagatgtttcataaacatatatcaattatagtgttaaatttattgaaaagaaatagagaccaaaaaaatctattttagaatacattgtttcattaacctagttatcattaacgaactgagtagttcggaatattgttccaaattagaattaaagaaggtggaagtttttagttttgttttatggacccctgtccacatcttcacctacttttcatagaccactgcaaatattgcaactgctctcttctttctgctattatttgctctgtaatccattctcttcagactgtcaaggaaccttttaagaagtatacagatcaatcaattatactctgattataaactttcaatgatctcccactgcatttggaataatacctgaacttaactgtggcattgaaagcctctacgatctactttctgggttcttattaacctcatctaagattaacaccctctaacatcatgttacttgtcttccaagtcctttttctgatgagtgattctgctattttctttgcctggaatgtgttttcttccctttcagcatttatatggcccaacctcatattccaggcctcagttcagtatcaccttttcagagataccatctcttactataaccctttttagacccatttctattcctattacttcccttctgttttcccctttcagttctccttattcccctagcagcaatggtcacaatctgaaattattatgctatctacctatctacctcgttccattgtcttctgacctgcaattttctgaaaagtagaaatcaatcttgtaattgctccttcatatactttttaatttttgtttacaatataaaggctataagttttggtcatgctaattaacatgttaaatttttgccacttataaaggtgagaaaaagatgtgtgtgctgtaaaaagttgaattatatgtgttcttgagcatttctagtctgctaaaatatgagctacagaaagttctctattatccccaccccggttttctgcgaaattagttactttggttaaaaattataactaatatgagtagtaaagaccacactaggagtaatattgacagagtaaaataaccatgtctttttgttttaccagcaaacattagtttcacctaaagaaatggttatttatttatttatttttatttatttatttattttgagatgaagtcttgttccctcacccaggctgaagtgcagtggccagatctcgactcactgcagcctccgcctcctggattctgcctcaccagcctccggaacagctgggattacagatgcccaccaccacgcctggctaatttttgtatttttaataggcacaaggtttcaccatcttggccaggctggtctcgaattcctgacctcgggtgatctgcccaccttggcttcccaaggtgctaagattacaggcatgacccaccgttcccagcccaaaataatggttctttaggtttctttgttgttctttttcaagtttttttgttgatcttttttaccataagactcttttactttctcaggacttattgaggatcccaaagagcttctgtctatttaggttataatgataggcattacactatagacattaaagctgagaaatttaaatatatatatatttattgtttctcttaaacatacaaagaggaatgcatttcatattaatataaataacatcttactattattataaaattagttttgacctttcagaagccccaagatttgtcctacagtaaagtgtcagttcctggaatatgaacaagcaccatgaaggtaaaaacttggaaaattaattttatttgccttgatttataatacccaagcctgaaaaactatgaacgtgttaaatatttgcaaagtttgttcaatttgatgggcttccttccatgctatactaactaatgcctttgcccctaatgtaaaaattctaaatcttctgtttaatctgcctagatagcagagatttggtgacttaacagtatagttttctgtgctctatgaagacttcatgctgcttcatgatgtccttgattattttagatggagaaaatagaaaaaaagtatagtttgtttaacttctttttggaatggttttattatttgcatgcaacaaaaacaaatttcctgatcaatgaaattgttcctactatgaaactgcatcagtcctctcacatttgaaagttatcaataatgcattaacacagccattttaaatctctatcctctacaaatattgttttattctgatgcttgcctgaaaaaggtatatagactaccagccagaatgtgtggaataagattgagctagatacttcaaacttttgacactttaaaaaatagacatttggctaagaagtttgtgaatagacatcacttagacaactttcagattacattactgaactgtgtcaggatttccagaactcatttttttttttgaggcagagagagcttcttgagattgataacgtgagatcgagcagaccaaaaaataattatataggaataagtgaacaaattaggaaaatattattatggttagttggttagaattattgtttattttatattaatgtttaatcttctagataaactaactcacaacaatgtcatgatgtatgtttttgtaaactaaaatgtaacatttttaaatgacatctaattcttactggcaccccaggattcaaaatctgttactgtctctacttttcacagcaagaaacttatttgtatgggtaaataaaaatttgtcttccttcttaccaggatttagttcaaaatcaattgtacaaccaaaaccttacctccagtaccatacttgtagcatgacaagtttattgttagagaaacgagaaacatggcataatctaagcacatctaccctggttatattattttatggaggctgcacttcccatagcctttgagcttttcacaaccctgtgaattttagataactgataaaatgcaaatgattttgtccatagacaaaatagattttgtaaggtagggagagaatcattttttccccatgatggagtaaattagttacccatctgtttgtgaattcacttcagtattcctgattgaattatccttcgatccagttataatactggttccacatcaatgagttaaataaaatttttgccctgcttatttcatgtttctaggaaagtcataattatatcctatttttaaaattatattttaacatatgcttaaatatgaggacatcatttggcctagttagatatagacaaatgggaattaaaggacgattgaatcagaagcatattttttgttgttgttctgttctgattttatgtagattaaccaaaggtcaaagagggagcaattagtgtaatgaaccaaaccataggtggacaacgccagagccaaggatcttaaaatatatgtggtcaacaatcttagaaaaggacaatcatcccatgaccttcttagataaaaatcacccatacctatgggacaaacttattcaagctaaattataagatccaaaaaaagagtgaaaggagatccaaatttgcatctcttataatttttgaattataaatagcaaatatgtgggtcatataacggtgcattatgatcatttttttaaaatgatcttaaataaaatgtctattcttaaataaaattatctgaataattcatctcatacaatttaacaaataattaaatgtaggaaatatgcctggttgaaaatcatatcaagcaaatagaatcatgagactcaattgactcaattgaccatagctgaaaataagcagataagttaatctgaactacagacactgggtgccatctggtggaagctcttattgtgtcattattgtatttattgagcatatgttatgcacatgtctttgtgctacatcctgaaactataataataaacaagatactatatttactctcaacaaacatatagccttgggtaatactatcagatacataagcgattacaatataagttacagaagttttacaatatctgcccattttatgaaggcaaatattcacctgagtattgctcaaagcaatctgtataatcaatattgtttaaactggctacttctttaaatggtggtttttatattaccatgttttcattaaaaagtaaatgacttcaatggattttttcagcaaaaaatcaaaatatgaaatattttgaaattttacttgtgaaaatacccggtttctagttctcttatccaacagatacaagaccttggacaatttatttaactttttgggcttttctccatttccaacaaaaccacagagttgtgagacacaaacagcctccatgcaaacaacctactgtctacattaacatcttaaacgacataactttatcattccaggaaattcttgcctaggaaggtaagtttcaaataacttcacttaatccttcttttgctctgtccagtaatcctaaactatcatatccagggtccttatctaatcctaatgaagtcttacattgcccacattaataaatccacttaaaaaacataaaacttcaattaatgtttcaattttcccttctcctctctgccctactattaaagtctctgttatggtaatacactcacgtgcagtggtaagaataaaatcagctttgtcttatcaacagattgtcttgatgtgatttggaaaagtaaatattcaacaatttcattatttgtttaagtaatttttatgcttacctttgaaaatgtttaatgacttcttggtatatattttaactgttaaatactgttaaaaaaactgttaaataaaaatacatggaaatgcaattaatccatttacttttatgttaagagacttgtaaaatataacatatattgtagaggagttaaggagttaatatttcaaaagataacgttctacgggattttgttacaaatttttccttataatttatatagtataattacaaaagtaattctaaaacaaatatcagtgggttatatttatgtataggtaatttgaaaaattataacttcactcctcaagatttcacaataaaatcaaaactgtaaaatgaaaagattccaagttaataatctctaaaatatcttcccatatagggaataatgaataaagaggaaatgaagagtacttcaactgaaattggataaaatattttcccatcccaaaagttactatagaatcattctttaatcattgtacaatattaaatgtaacctttagctgctttgacaataattataaaaatacctaaaatatttctataattaaaaactataaaaataactaaaatattatacaagataatctcaaatattatttttaggtttatatttatttagatataaaataacactatcaacagtttttctctctatctctcatcacttctctcgatatatgtaaaacaggatgatataatggtcacacaattaacaaaattttcaaaattgcattttcaaaaaaattaacttcctgactctgactttggggaaacttatactgtagctataaaaagccatcatgaagcttgacttgtagcttatgctgactttgaggatgttttatatgaaatacataagcaccttaatattaaagccactggataattttcacaaaggttccccctttagaaaattttgatatacactaaatttaattccatggtgattagtgaatggcatgttagtttgagatatgtgctgtgtcaagcaaaaatgcaaaggtgaacagagagttacccttgacaataaggagaaaggcactaaccaaggaagagtaaatgttccctctcaagatgccataatagtgacacactaccagttatcaatgtagattgtgacaggaagagtaaaggataggttaatatcacctctattgtggaagttacttgttctctttcacaggattcaatctcagaccccagaaagatattccactagtattttcaggcctctctgttttcatttttgtccccagttgcctatgacagagtagaaattaaagagctcttttctgatttaagtttattctttctatctattgtgtctaatgatgtcattttcagagttgtgtgtctatgtgggagatgacccaaaaggcgagaggcgtaggtgagtacgtttcttcccttttgactctgatacaatgcaggtcaacagacataaaaataaatgtaacttaccctgcactcttatcttccactcttcctaggagagaaaaaagtgttgctcataagtaggcataatgttcatatgaatagtagaataaagggaaaatgaagagtatttcaactgaaactgggtatattaattaattaatataatgtttttttatataacctcagtaccttactttggtttgaatctccagttttaattttgaagtgttaaataacaaaagcgtggcataagactattttatatttaaccaaataagtcatgtctttaaaaaccagatcaaaattttactccaaggcagaagaaatagcatctaattccaaatttttgtaagaaggtctgtaagagtacgtgtgtgtgtgtatgtgtatgggtgtttgaatgaattaatggtagaaagatgttgagctgtgtggtgatctaattaaggggcatgactggggccagaagtagaagacagataacctaaagcctaaacagtaaagctgaaaccgtgaacagtgccaaggaagagaatgcaatgtgagcctaattcttaacagatgccagaaatagaagtagaaaatttgagtttttaagtaatattatattaacctcttataatgtcaataataaattttatttcctataataaagcattcatatacaatggcaaaaacaggactcaagctataagttcacatgtcgtgggcaagtttttttaattctcattttgattcttttgatttgactgaaagggaagaactagtcatagtgcattagttttcacagaacaatactttgaataaccactttaatataagatatgctaacataacagactgtatttcttccagtagttatcaaaaatcagatttttagaaaggtacaatgtagtataaaatgtattcattgattgtataaagttcgattataggaaacagctatttgtaatttttgtaaaataaaagaaaatccattcatatgatttgctaaaaatataatctaaggaaatccaacaatggaaatttctttaccatctgatatgttttattcatgtctcttgcattatttaaatcgtttctctttttacaagcaaataggacttatcttgaaaaaaattacacacgaattttagaaattagaaaaatttgatatctttatgttaagccacagtgttcattcaatataattatgtaaatcaccaaactatactcaaaacaatttaagtattgaccttaaagaaataaaacctgcagtccgttctacggcatatttagaaacttttaatttctatatacagtgatgttatcctacatatcaacattatcaaatagattatgtcagaaaggtgaccagtaaaacttaattataatggaatgtcatagtgagaaataaacttagagaattccctgtcatcttcatttactagatgaggactcaaagacagaaggctgataaaattttatacatttgtacaaagagtaaatggtcgataaaagcatgaaacctcagttctataacgtcaacttatcactctatccaactatgtgttgtcttcgcctctccagtccaaatgagctggattaaactgacataatacaaaaataaatgatttaacttaaaagtcaattggaaaataaaagattgaaaaacttatcaatgaagtatgaggacaacaaagtcacaacctaagtaaacatttgcaaagtactgatgagaaaacaattctaataaaaaactgaaatcttttagaatacaattctaatatacaaaaaagaaaaggagggtcctagattgtatttttataggctttaaaagttagattaaaagaaaaaacaaatagtgaaattcacttattttctccttagatgggactgctaaactaatagagcaacaagatcagtcagtattctgtaaaatacttgaatgttatggcaacatttgacttggtcaaatataatctcctaatagagaagctagaaaaaaaaaacctagaaattaatacagatccacagtgctgtatctgaagcccctgaagtcaaatgtgcttcagagttcagttttccatattttagagggaaatgaggaacacacagtgtatgttatgtaatattttcaatggaatgtaaggcagtaacatataatcaagtacatcagcatccttgcaataaaacgtgaatatctgcattcaacacaaaaataaaaactatatctcacatctgtccaagtcaggacaggtttcaaagcaaaatgtgctaaaagaaaatggttcagtttcaaagctttggaatttagcaatttccataaagggctttgaacctgtacaaaaagttgaaatttgtctaattattggaggtttctcattatttaattgaggatatattttttattattattctgctaagatatttgtcagtgatgcaaatgaatacataggagctattcctttaaaatgtgcatatttggaataaaccagtatgtttgagtataattttcaagaaaagaaaattattgacagatttctcaaataggtcaaatatgtttttattattatttttaatgagatatggacacatgcaatgctctcaagagtaggagaatctagttctccctaatagtacttcaataaaagagaatagtaatgtgaagtctgagtgttatcattggattaaacattgaagagatagaattgggataggattagaaggtacaccctggaatgtggtttgctcccagtaatttgaaacatttaaagaatggttagatgatcacttgacagttatgctataaatgggaattagaaagcatgagttaaagatcattactttgagtagatacattttaatgtcattttcaatctttagaatcttttgttttatttgggaaaaaaaacaaaaccctaaatcctgaaacgatcactgcaaaaaaggattatagtctgttactttttaaattgataaacatggagatgtattccaatgagtgttaaacttactgttgtattttaaaaatttgctttcatataatggttaagttttgaaagattacatttcgtgagaaaatactttatgaattttaatgaggtatgtttatttaaatctaattttctattctgttttgggaaatagttgtgtgtgtctttaagataagaccgtcagcaaataaggccacagcaaaacagagattttgctaattttttaagcctttgttaatttctggctgacaagagaggtagtttaattagttagctactaatatctgtttaaatgagcagccagggaactgtccatcacaataaggatatgcaaagcccaggccattctctttgactcttttcaactatttcaaaagagaaaagaataggtagattccacctatgtgtaaatgaagggagaatactcaaaaagtaatcacacacacgtaaatacgtaacatactttcgagacaaattaagaaaattggatttaaataaaacaagtaaggtacttacgtgtgtgtgtgtgattacgtgtgtgtgtgtattttcttcaaatgtgtgtggttactttgtgtgtattttcttcatgcctgtgcgtgtgtgtgtgtattttcttcaaatgtgtgtggttactttgtgtgtattttcttcatgcctgtgcgtgtgtgtgtgtgtgtgtgtgtgtgtgtaattttgggtttgaggtataggtgccttaacaataaaatagtgaaatactttcaaatattgtggaagtctctgtatctttttttttttttttttttttggcgacggagtttcgcttttgttgcccaaggctggagtgcaatggcacaatctcggctcgctgcaaactctgcctcccgggttcaagtgattctcctgcctcggcctcccaagtagctgggactatgggcgtgcgccactgcacccgtctacattttgtatttttagtagagatggggtttcactatataggccagaatgatatcaaactcctgacctcactcggcctcccaaagtgctgggattatgggcgtgagccactgcgcctgtccagccttctgtatcttgactaaaagaaaatattcagtctctactaaaaatataaaaaattagccgggcattgtggcgggcgcctgtaatcccagttactcgggaggctgaggcaggagaatggcgtgaaccagggaggcggagcttgcagtgagccgagatcgtgcctgggcactctagcctgggcgacagagcaagactccgtctcaaaaaaaaaaaaaagaaaagaaaagaaaagaaaatattcaaagaactctgagaatctttaaaaggaactgaagagtataaaacattctctttccctagtttaaagtatctctgctactggcaaacaaaatggacactctggcaaactggggtattcaaagttgaaacagaaccaggcagccatacctgcatgagggagcagtgggtcacagactctgcattcccagaaagatgttgtaaaagtatcacaggacctccctttccgcatttggcttgccaaaccaatgtctgttatccttgccaagataaactgagaggtttatcccccaccaccagcagttggaaacatctgacagcgacttctagtttggggcttggaaaccaaccaatcagaacttacctaccctggccaatcaaggcccaacttgtatcaaacaatcagaactcagctgcaatgactaatctgaattaagcaagcttcattctttctataaacagacctgattgggaacgtggacaggaactttgctataaaacatgaacagtcagccaggcaaggtggctcccgtctataatcccagcactttggtaggctgagggtggcagattacctaaggttgggagttcgagaccagcctgaccaaaattgagaaaacctgtctctactaaaagtacaaaattagctggggggtggtggcccatgcctgtaatcccaggtactcgggaggctgaggcaggagaatagtttgaacccaggaggtggaggaggttgcagtgaccggacgacattgtgccattgcactcctgccggggcaacaagagcaaaactccgtctcaaaaaaaaaaaaaaaaaaaaaaaaaaaaaaaatccctttgttctctggaatgaattttaatggggtgtgttttatttaaatccaattttcttcttttgtgtacaaaggctgtttcccaagtttacaaaccattcactggtataaagtctctttcctcaaatttcagagaacttttcttcataccaataatcagttattagcttttacatttaaaataaaatggcttactaatatatttcctaggtttgtttatataaaaatagtatgctttttatttatttatttttatttatttttttatttatttattttttgagacagagtcttgctctgtcgccagcctggagttcagtggctcgaactcagctcgctgaaacctctgtctcccaggttcaagcgattctcccgcctcagcctcctgagtacctgggatttacaggcgcgcaccagtatgctcagctgatttatctatttgtagcagagacggggtttcaccatatttgccagactggtctcgaattcctgacctggtgatctgtctgccttggcccccccaaggtgctgggattacaggcgtgagccaccgcgcctggccaaaaatagtaggctttttatattgcctttgtttactgggaaatttggagaaataaatgaatggaatatttaataagatacgtacgtcctttgtgtaatttttttcaaccaacatgttttaacatctttatattatcacatatcacgtcagtaagagaagcaagttcatgaacaaatattaccaattaattggtgtaagactcttttagaggctgaattttattggaaaattattatatcctaaggcagattatggaattataattcctattgaaaattatggggaagttaaaaaatttactttggggaaattaaaaaaataggcagcataatttcaaaaaaccaaaaaacttgctacttctataaagattggtctaattatggatattggataaattaaaatctattataaaccataaatagtacacatttcagctttaactttaaaatacaatttgaaaatgagggtctaatcttttactttcattcacaagtgcttattaaaatgaaagagataatattataacttaatattaggactaatttatttaaactcgattaaaaaatattgtcagcattgctattttatttttatataaaagcagaaaggacataatgaatgtaattttagaatcttttgtaacttagtgagaaacatcataatgcaaatcacttttttctcattaaatttgatttaagtatacacacgcatacacacacgcacgtgcataacacatactcacacacacacacacacacacaccctcaagaaaaatgtcagggaacccttcaaagtgctaaaacccagtttttttcctctaattttcaatttcacatttttgggatggtgcccattaaaaaaatacatattagcaattcaaaagctccagcagagtgaaaacaaaagagaacaagcctgataattctggcaatttcacttggaagaagaccgcagagataatgaaaatgaagaattagagtgcttggcaaaatgggattagatagagaaaaataatcaaataaagtatttgtttaaatgccaaaacatcataattgttgtttactattctgtaaataattgtgttaactagcaatcttgtttattttgtcattataatagtaacaaacatgaatacactattaaactaaaaattattacttataaattgttttaattattacaaaagccatatttttaatttatagtaacgattatacacaattctcattaagaactggctcttctgacagtggattatagtttctaaactatttatatttctatattatttctggctgaaattttcccaatggcaactgtatatttcatttgtgaattataattaaataacaaaaattaaaacgtattatatggtttaatctcaaaattagagatatagcaatattgttgttgaacacatatattcaaattattttggttattaatgtgttttgatgattatttaaaatcactacctagaatactcctcttaatttatcattgcaccaagtgtgttaacagttagtgtagtgatttatagtaaaccaaccaactagggtaaaaagcttccttcttactatagcttcttcaatataacatacaagaaataggaaaaaattagattggtgggggaaagataagtaattacacaatttatgttccaatatacacaaataaaagtataagcgattcttagatattatttatgaagaagtaattgtaagtgatttttgcagataaatgccgatataagaattaaccacagtacatttttgttttaatgcttttaacctatttgttctgatgtttccattttgcttttgatatccaaaaaattgaactttatagctcaaaggatctacagacatctagttcagccttaattttacaaatgaggagactgaggtctgagaaattaagttacaaaactgagtgaatacagttggtttttgtcaaagacagaaaagaatacatgcctccttgcttatagtcaagaggaaatattttaattgggatgcacttgatctttaaatccagcatatccaaatgcaaagccagtgcctttgatgggtgaacaactggcttgctctaggaaattaaagacagatagaaagatagaaataaaaagaaaaagtgtataaaattaaataaaacagaaagatgaaaaagttctgtcttccatgtattcataatttaagttagaaggtgattttagtgcaatatacatgaaagagaaattcagggacatgaggggcaaacaaaagttcagcatgttcttgtttttatttgtgaatatgtaaaatggaaattattacagctgtttataggagtaagtaagataacatgaaagcactaattacataatgaaaatataatatttaatttcaatctcttttccttttctagtatggattgatagatagatatagaccagactattaccctatatatatagtgtaaaatagtatatatatatatatagtataatttttttaaccaacatttttgaacatcttatatatatatatatatttgtgaatagcttattatacactagaaataagatgtattaatttctttttaatttcttaaataagaaataattccaatctctttcccttttctagtgtggaaaagggaaagagattgaagttaaatattgtttgatatatatgtacaaacaccacttttgcactatatatatataaaatatatatatataaatgtacgtacacacacacgttttgcagtctctctttctccctatagctctctctctctctctctctatatatatatactacatatagatttgattccaaaacacttctgacgtatgttatagtctgtctttcacatacgaagatgtttaattataattattttaaaaattagtgttaaggctcaaaggagaaagtatgtttcattattttaactctatttttaacttttgcttaaataaccctggtatatcataatttaagtgacttttcaaataaattatagctcatcctaatgtttttaataacagctaatattttgcctgatcataaaatttacacatactcatcacaaaaaagtgagagggaaaacctataaacctttacacaagagatacctcaaacgtttaggtggaatacttgtaggctttttagtatacatttgtatatattaaaaaagtaagaccatcctaaaataattagagcactattttatgtttttaaatttttatgtgttttgttttacttaaatttgaaggaatatgaaagaatttcctattgtattgaatatccttagaaaataaaacaatatgtagtactattaaaactgaattctcagttttctgagcaaacagtttaattgatttctttaaatttgtattcttaatatctagttttaaatttgcattcttaagatttttgagaatttttaaaataaggatatatttaatttattatgttaaaatttttctttgtgggttagaataaagtcaaattgagtatacattgcatgaccgtatttaagatgtatgttacatatttagtgcacaaaattccatatatcagtacaattgcactaaattctatatttaaataatcttttttcttaacacccctacacttggggtttgtgtgtgtgtgtgtgtgtgtgtgtgtgtgatctatttcatccataaaaatcaaaatagcagattaaagtttcttgtgacagttatgtttttttaatttctcctggaagatctatgtataatttactattcattgtatagtgatatatggcattaaagaaaatcgattatctttttactttttatgttgggtctaattttgtcttagttaactttgctaaaagtagcacattcaaagaaatttttaagtctgattatgataattatttttagagctggaaatatttacacttattacatttgctatatttttgttttttctggtcaccttgtttcaagtttgataattctatcattttcatttatttttaaactttttatatgtttgtctttatatgtagcaggaaattttcaaaatacacatgaagctttttacattcacaagttgttaaggttggcaataatattttaaacttaatttttctggttgaaaatggaaatattaataaatttgaatttccactctctgcttaatttttctaaggttttactcaaattcagatctctaagtatttatttatatcatcggagtttataaacctgggtcacttaaacttaatagttctctttattgttaaatactgtctcttccaagaattatattttaacatttccttgaaattttaaaacaatatttactatttttcactaaactctgtgtgataatttttagtgtgaatgacatttgtgtggctacattttattttatttgcactattatcacaccctccaaactcctttttattttcaccctatttttttcttgccgtatggtcttctgtttctagagataccacaatttcctacaatctattgaagagaccaggcattcatgtgtgcttgtttgtgtatgtgtatatcagggaaagggatcatgaagaggtaatctctcctactgaatctttaagatatttatttctttcgtttagctattttgaaaaatgtgttaccttctcccttcagtaaaagcatggtctccctactattaacctcatactgtcatgtaatgcaagtccaaagctactgttgtattatagcatgtatatatatatatgtacataatatgtataatatattactgtattattttatttgttatgtggaatagagagggctctatcaatatgtagattttgctgaaacaggatgtgttgatcagtgcctccaaatccttctttggtttgcaggagactgcactgatatgtagtggtttgggcttaattatcagtgtatagctgaggcggaatttactctgacattcatttctctgacaatctgaacaagaaagtccaggggaaacaacattaattacactaaagtctattcctctccctgttggtaatttaattctgaaagtccttgttccttgtcatagatatgtaatcattaatattagtactcgtatattcccttccagagttgccaaatgtagcaaataaaaatacatggcaaacaaataaattaaaatttaaatagagaaaaatattttctgcttctttattttttggtttaattgtgtctcaaatattacatggggcatccttatttgatatcttcctaccacatcattcttgccatgtgccaattccaaacatggtgagagagagagatcatttttctgtggctacatctcaaggtaggatcctgtcgtagagagggagctgcgaagttgctattaggatccaactctgggcttctgagtagttagctgatggtaatgacacagctcccttctgtatttagggtaagtgccacctttgttgaggcatttgggcttgctcatctgaagtattaaaatatgttttgctagtcttataacttttaagaagcttataactacttcaatgcctctcatattctggcagaaggttacatattaaccataattttctgtgttgttatgagttttcattttccctcctgataatttatacagtattttaataggaagtttgaagtgatttctatctggattgctactttaaagacattttaaaccagaatcctcatagtttttattatagaaaattgtacattcttaaaaacaactctttatcagtaaatacttgtccaattcttattcctgatgaaaaatacttgtattttaattcttaataacttgtacttaaatggattcttatgtatcccaatattatgaagtttttttcctctgttttcttctagaaatttagtatttttgcctttcctattgagatcattattccatataaaataggcttatatatatgttatgaagaaaggattaaatttctgcttttctcatatggatacccatataaagaaacacttattcaaaagttcactctttcccacacatgatttcattataatcctgtcacatatgaagtgaccatatagtggtttaactctttttagaccatcttgtctttccttagtcattttttaaatataattttttttcaaggaacatgactgaaaagaccagtaagtcataacattcacctcaattgtctcctattctcaaattggagcattatttgagtgctctgaagaagcacatcaagttgtgataatatgacatgtctgtataatattttgaaaaattataagaaaatcaacatcattttcccaataattcacttacacatgtggttaaccaaagaatggtagaagttagggaaagaaaaaaaaaatttttgttttgagtcatcatatctgaagatttacctatgtgaaatgtttattttatgataatgaaagttgccagcctctgaccttagaactcatatcagtagttcaagataactgcatctaagtttgagccactaaaaatgagtcccttgtctagagatcctctaatgtattaaaagaataaagatttccacagcctagagaagattatacatatcctgacaggcttacagcctgaggatagtgtttctagaatacaactgcaaacacaaggctccagcttactaaggcgccaagtgtccccctgttctatgcggcagagtagacaaaatttctccaggaatagctcactttctgaaactaaaaacacttttagaaatgcctttttttttttaaatgaggcaacaaatcttccaactcagtgatcaatccacaaattaataatcttttaagtcttaatgtagtttcaaatacaaattctgtaaataactttaaatatacacaagtttaaaaacataaatgtaagttctattagttgacaaaaacacactttttcaaacatgatgacaattttaaaaaatcttagccctagctatgattttagcaatttttgattgttgtgtccttgccgttctatatttggagtgaaaataaaaatatgttgctggagaagaggatgaaatgaagaaagacaagtgaaaatagatttgacctaattatattaacaggtttgatatgttttacatttctaactaatgcctttcagaaacaatgtcaatgcaatattcccctagaatgtgttgatgatagtaataataagcactagtagaactgggctgatcactttaggaaattacaatctttaaaatgacaaatcaaatatttaaatatggaaaacattaattttccatctatgtgttttaagtactcacaaattctatatttttatggcaaacattaatgaaaagtgaactttctaaaatatttttgaagacaaatattaaagacaaaacttgctttactaaaactaaaggtaccctaatgaataaattatactgttcattttatagcaactatcaataaccgtggcatcatttgcaatgtttaaatggttttataagaagttgtaacctagctccattgtttataaatggatttaatatctttacatgtttattcaagccacaaaggtaaagacatagtaaggataagtagcacagggctaatgaaggtcttcaggaagtgagttgcataaaaaccaaacagaatatatgcgccttgcaaacaaacctcagagcacttttgttcattacctttaacatctgtgatccaaataatgcctctttcattcaacccagcacctctaaaaacatgtcaagctggccgcgcacggtggctcacgcctgtaatcccagcactttaggaggccacggcaggcggatcacttgaagtcagaagttcaaaaccagcctcaccaacatgaaatcccgtctctaccaacaatacaaaaattagctgggcgcggtggcgggcgcctattaatctaagctacttgggagcctgaggcaggagaatcgcttaaacccaggaggcggaggttgcagtgtgtcaagaccgtgccactgcactccagccttggtggcagaacgagactccgtcccaaaaaaacataaacaaaaacatgtcaagccatgtttgctactcacagctgattgactgataagctaaaccacaacaatcacacataagacagcaccttagacctccagatagagatgccgataaatcacggagacatgctctggcatcagtttgtgtgatagagtgttaaaaatcctcttgcagagtgctaaaatctaacacattcttagaatcctaaaatcaggtagcttcactcaatctgtgaggaaaaactggctaaatcaataaacacacataaaaataaatgaacccagaatcataaaatgttgacaatttctgctacttttcagaaagaaaaactttagtatttttttttttttttttttttttttttttttttttgagacggaggctcgctctgtcgcccaggctggagtgtagtggcgcgatctcggctcactgcaagctccacctcccgagttcaagcctttctcctgcctcagcctccccagtagctgggactacaggcgctagccaccacgcccggctaatttttgtatttttagtagagacggggtttcaccatgttggaagatggtctgcatctcttgacctcgtgatccgcccgtctctgcctcccaaagtgctaggattacaggcatgagccaccacgcccagcctcgtcatttcatttatttaaaaaatagagtaaatcttttcattaggcttatgacagtgttatgactgcatggaataagggatttcttatttttgagaaggcaaagcaataattgtgtggtgcttcatggaacttgctcaggacattcagtgtcttctgtaaatatacattgctgataggatttataaatttctcataatgctgtataaatgactacagacaaacatgaagcacagtgccctctggtgcacataaaacataaaataaaatatttatataggagtatctacatagatacagccacacaaaaatacacaacaaatgtgcttctttataaatgttaaaccattaactaggaattgtaaaagtctatcaccaataaacaaattgaagtgatagcttcacataaaatgttcttcatggcatagatcaatataatctaatccatcaggcaaccacttgtacactcttctacttaatgtattcacgggacatcaggtgaacaggcaacctttgttgaatttaatatattactctttttgtgtaacttatttagattttaaacatagaacattgatagatgttaaagatcatatatctttatcccatccatttctttgatctttgctatcatgtcctatttatctgctacttgtttttattccattgctgtttcctttagcttctgaacgtacaattacctttcaggtaaaaaaggatgaggtgactcaacttctcagtgactagtagaagataccatttccatttaggctgaaaaaggtaacatagcattgtataaggtagaaaggaaaagcaattttttaaatttcactttaaaattttggctatttaaaataagaaactcggcttccaaatacattgccatttactttaaggcagtgtagcatgcttaaatttgggagtgatagacaagtggtcaccattatctgtttttatcataatatattacatctataagaaatactttgaatagcaagaaaacattactatggtgcatggtaaataacaacccttctgataatacctttttcccgtctgaaactttcccttagagaaacttatgtatacacaaccttcaaggatgatatttctgtaattgctttccctttgcttcatacctgtatatcttgtatcttgtgctaaatccctgccggcttctgtccacaaaatctgtgtattcctgtgagcgatggaagggtcccttatcagagaggagccagtcgaaggggcttgtggcatgctgatccgaaacagcagcaaccgctaaaacccagcaatgaagactcagtgctatccactcccatagagccatcagagagaacaattcagcaccagctctgcttcgccatatcatgcttccactggggatttagagccttcattctctcagctttccctcaacacctagacaaaatacacaggcaattagttaactcctagaagattcctttctctcagttaaggtgttgaggtggctaattttaaattttaatctaatatcattgttttaaattagtattatcagcagataataaaatacaaaccaaaattatttttttagagctgtatatcttttatactttgttccttttttatattaatggaaaataagacattgagtcataacagactttgtcataacaattttattcagtggatcattaaagcctattgagcaaaaatcagaagttgaatgttttataaagttggactgatgcaaataaataattaataagttcaagtatttcatatatttcataaattgtgttacaaattttaatactagatttaattttattgtatatttatcttaaataaatgctttaaatgaagcaaagatattcatgtagttatttccataatctacataaacacggagtaaaactgtggatttaagaatacataaatatatgtatgtatatgtgtgtatatgtgtgtatacctattatagatatatatagatatagagacagacacagagtgagacagagagatgatagaaagacagactgatacatgaacagatgtgtgtgtgtgagagtggatgtgaggagtaatgtcttttcccagattttttttcattattctgttaggaaaaaactgcatatctgattatttaaacaaaatcataattacattatttctagggtctttaaagatttaaatgtgcatctgtcttattcataagaaagtcatacctccaaaattatatgcacataaattaagctaatgcagactattcatagactttgaaactgcatacattgtagtataatcattcaaaaaaaagtaataagacgtataatcccagtatggtacagtgtaagacactttatgcaaagctgctgatgcaatgtctatatgctacaccagaaaattctaaaaatatttgaattcaatttttctttctatcctcatcagcttttcaaactgtattattcatagcacatagcactacagagtgcaaagattctgactaatgagaaaggtttacttgcatgagttcttactcagcaaaacatctttagaaaaaaagattaagatttacagtattaagatatatcagtaatagtagctaccatatttctctggtatttgaataagaacactggtggttttaatgtactttcctagctataaccccattatttgtatttaatcctaaactatttctatctgagagatatagagaaataattttggggctctgaagtagctcaaagcagtgatacaatgagtgaactcttaatatcacgatatccataaaaggacattcctcacatactgtatgagttgcctcaatcatatgagttgctcactgaggggattaaagcgtaccgtcttttgtaaacaacatgggaagccttacaagtgaagacattttaaaaatgattttctataagaaggaatattataatagaagaattttggaataggagcttggagattctaggcttttttctattatctatataaatgtaccattgtcaaatgattcaactcctaactttcaaatttgctgaaaaaatattttatatattttttcttatgagaactatacaatttattttaaaatatagcttactttcatttataaacacaattattcttatgtgtagtggtatagtataataatcctgtgactaaaaaatattactcgtctttgttaaacacactatttttattttgcttatcatatacatttaaacgggcaaaatttaatcattatttttagaatatataatttcttaatttaaatgagtaatttttcatttcataaagacagaataaattattcaaaccactactcaagtccatattacatatatcatctgaaaggatgtgtttcttaattgaataaaacttcagtcacaccatctaaatgaagttctcttattaacaaatgtagatgtgaacaagaatattattgaaaaaattcaaacagtacttatttcatcctaataaataacttggaaaacagttctttgaaaatgaaatcagattttctccaaacccaacaaccaatatagcaaattaggatatataacgtcaagagacaatattcatagtggttaaaaaaatggactctagagccaaaccgctgatgttaaaattctagccctggccaggcacggtagctcacgcctataatcccagcactttgggaggccgaggagggcggatcacctgaggttgggagttcaagaccagcctggacaacatggtgaaaccctttctctactaaaaatatacaaaaattagccaggcagggtggcacacatctgtaatcctggctattctagatgctgaagcacgagaatttctcgaacctgggagacaggggttgcggtgagcttagatgactccactgcactccagcctgggtaacagagggaggctctgtctcaaaaaaacacaaaaacaaaaacaaaacaaaaacacccagcccttctactaacgctatagatgtttgactttaggcaagttacttaacttcttttgtgcgtcagattcctaaactattatagaggtcacctcatcagtctattataaaaatagagtgagttaatatttgtaaaatccctagaatagtgcctaccatatggtaaggacatgtggtaaagttttaagttatattttatactggtatgaagccatgccattatacaccttaaaattaaacaaatgttttgtactcacacatgtgatttttgtaatacacaaagtgttttaaaagtaggatacagttgacctagatggcatttgaggtcctgttctacaattctgtaatttttcaataggtgaattacccagaaccactttcttatcactttctttatcaaatgtgttgagcttgtttcatagtcttcatatcccctcattaaaaaaaaaaaaaactatattgtgtatatttaaggcgtatagcatgatgtaatatggttacagtagtggaacaatttaacatatccatcatttcacattgttatgcattttaacatatgggaagatagaaaggttttctttaattttgtgcagagaactacctaacaatattaccaggtaattatgaggtaattatcacataattcgggggtttaattatttctgttttttctacttctgactttgggaacatgttccccacttctgtacagaaataatttttttctgaaagtttgttaacacataggaatgtcaatcttaccccaaattaagttaattttggtgatatcctaaaatcattgtatttgtaagaactttataaagatattttgtaatgaacaaattgagatatcccaataaagttatactgaaatagtgtttaagaacttttttcacaagttacatgacagggagaaaagtcataatagaatgcctaaggcaagcatgtaagcttctagccatctttaggacaagtggtaattaaactcaatattcaccatcagaagagcttcattacctggtttgtcacaaaagtagatcattgtacatttaattcatattttcatgagtactaatttataaattattactgaattaccttaattggttgctttatttggtttgggttataaccatattaatccatgtgtcagagatggtttagtaaatagagtttgtttgttacgatgtagtgttaggatattttgaggtgacaagtgaggtgaacagctaaacttagatatactgccaagaaagagaaatcacaagttccaatgaaagaggatagaaattattaaactaataatgaatttatcactttttctatagtgtggggaaatgcaaaatagtccagaatttaatattcataaccaagaggctaactggccaactaaagagatgagaacatcaatgcaccatattttctggaccatgggagagtgattttatataaaagagagaaataaaagagaatgaagaacacaaaaaaacaaaacattaaaaacaatacaaaattaaaaacatgactttatgtttaaaacatggtgtttaattaagtatttatggtttttttcataaaaaataagtcataaatattgaaatatctatttgaaaagcagatatttagtataggtcctactcttaaattctttctcacaaaaaaaaaaaaaaataactgtgaagaccacatcatgatacaagtttatttgcaaatcctcaatggccttgacaatctgtgcagaaataaaatacatcaaaaatatgttacatatatactaatgtatactaatgcatataatacataataaatgcataaataatatgtgtataatatatagtctaaatatgattattctttcttactagctgtcagtagtcttattccaaggtggtggtaccttacttttatctaaaatactgatatatcatatatatttgaaattcataaatattgaaatttatgaaagaaatatttactataacagtaaaagtgaatttccagtagaactgaaactacaaagatataaacaaaatattcggaatcactgaattaaacttaatatcctttaaagtggtgggtcatgtcatagtggtgcatcttttaaacctcagtatcttattatccacaactgaattagatgtccagtgataattattactatttgttaaacaattaacattgcaaactgtatcatttctttttttgtatttgcatttggactgatttttgctgcttacatatccaaaatattctctcaggaactaaaacctgctgaagaacttgaatatgcaaagtcatttcagaaaaccattgtatcaaacatatttactttcattttgaataatgtagaacccatggaaaactgaaagactgatacggtaaactcttacatatctgtcagttagagtcaccagttttgttttcttttttttctaccatattatcactctctgtctctttttctctttccctgtctctctccctctcataaatttttaagtattggacaaaggtataaagaaaattggctgatttgcccaatgtctgcaaccattctctaaatttcttctcttgagcaaatactactttgctctataaaatagtttcttaacattaatgcttactaatactgaagcttataaatgtaaaactatgaatcttcaaaataaaatatccaatattcaaaataactatttaaaaagtcacattctttcaaataatacgatacatattattctattaaatctattaaattataaatgttagaattatttattataaaataaaatatttatatgtagtaccccagaatctgtttaaaatctacagcattattatataatcatatataactataataattattttttgattattcatttaaataaatactagctatgaaataaatgaatactaaatacataattgtgtaagtaaataaatggtagatgaggtaaaaatattttaacataaattttcaatactttttccactatagtttattaattgtttcaattccaatttggtagaagtaataatgtagaaaaccagaataaaaaaataaatcttattgatcaattgcaatgtgcaaaatatcatgataagttttgagacagaggtgggccttaagtcttaataaagatagtgcttctagcctcaggaacttaccggtttaggaaggccatgtggaaggcagggcatactgcctgtggccatttctgttagaacatgatacctctgtcaaggaaaactaaacgttctccaaacttttttctggttttcttatctcactaaatgatacttccatctactcaaatttttaagcctaaacatgactttgacctaccttctcactcacatatacaatctgtcctcaagttctgtacattcttccccctaaatataagatttaccactttttctccacccccattttacttgatcagctcatagtatacgctcaacaataccaactttgcctctaaaatgtattactgcaatagcttcatgactagttttcccactagccatgtggctctatccaatctgttctttttactacagtcagagtgatcttactaaaaagttaaatctgaacatgcaaatcctttacccccaattatgtaatgacttttgtttcaggatatctgatctctttaaaataacttatgaaattatctttccttgcttaactctctatccatatctttcttatgtatatgtgccaggagagttattaaccaaacaccaactttgtttttcagccatgaccatagacctcatcttcaccccattttctctccaagatcttagtttattgcggttcctctgcctgaatgactgtttggactaggatctcttcatctgcctaacattgaccttaaaacctcagactagattatcatttcattcacaaggattttcatgaccctacaaagttggttggtcatttttttatgctcccattactttccctatgatggtacatttacatgatatttgcttgcatgtttgccctatttccctgcacatctcctttccttcaattagattaattttgggagaaaaataattgctcctatcttaatgacaagaaaatagtcaccaaagtttctgaaataaacctgcataaataagtattgttagagtgaatgaataaatgttgatgaaataagtactaaattagggtgcaactgcaactggtggtgtgatatggctggcaagaccatataataaaaagaaaatttattcttcatggaaatagaatctacagagaatctgtatccgaatctgcatctgagctgagtgtcaggatgaaaatagctttggcagttgaagaaagggagcaaattgagttatgaggtaatgatttttaagaccagattgtaaacatatattgacaagctcaaagagtatcaaagcaaaatattctttaattttaattttgattttattttattttgagacggagtttcgccaggctggagcgcagtggctcgatctcagtcgctgcaacctcctcctcccagttcaggcgattctcctgcctcagcctcccaagtaactggaattataggcatgcaccatcattcccagctaattttgtatttttagtagagatgggatttcaccatgttggtcaggctggtctcaaactcctgatttcaggtaatccactcatctcagtctcccaaagtgctgggattacaggcatgagacaccatacctggcccaaagcaagatattcttaatgttaaaaaatgttaaggacaaaaatagaaagtattattattaattattagctttggacataacaataagagattatcatattatgcacaactggaaaactaaggactttttcacttatgttctataattcaatttctaaagacagaaactatatatgaaagtcaaacctagatcctaatcaacaaacagccaaaccaaaatccccctctaattgaggagcacaatgagaatttaaagaataataataaagaaacaggaattgaatagcctgttcctctccatttggaaaatcatatactaggattattttgattgagatctccctgactacctgtgagaaaagtaaagaaaatgatgataaaatgaaatgctatttttattttcttcacaacaaaattaacacctttttaatctttttgatataccaagcatttcacgaaattttcttatttcagttctcagcagcacagtgtagtatatattaagatctcatttgtactcttgaagtcaaactgaatactatagttttcctgttgtactctactgtaacctaaaaataaccaattgcaaattgaaagttatttcttagaatttttgaggtcacctttgcataaaataaaaattcaaatgaaagaatactattatctcaagctattaaaagcaagcaagtgttctgagtaactacatattatgggttttcattgagtgtttgctttgtatagtttaatattttgaattaaagtgatagtttaaatctactaaatgtgatttattttaaaacatgtactgaaaagtcaaaaattagaaaacatttttcatattacatatgatatttattgggttgaaaagtataatcatggctaaactggattaatttacttatctgttcctcagaaaaattgtaagattaatccagtaggctttgattattcaatcttattataaattgctttatagtactactaaaaataagacaattcaacacttacatagttggtgtctaacaatgggagacataataaaatttcagagaaatgagatgacacttaatattttgctaaaatgcaatcatacaattttaattaaaatctgttttttcatgttcccatacaatagataatgacaaggatataaggatatgagggtcatttctaacaagtattattttaagtgataatagcgtgaaaattcagaactacaactaaaaaaaaaggaaaaattataacatcatttgccaagaaatatcctgggtacaaaaaaaaagttttaaagacattgctcttttaggacatcagtcaatactcaggtattatattccatgaacatattcaaacataaataaataaggtaatacattatctttttacatgtgtaaaaacacagattttcatttttggatgttcataaattctatatattctgtagtcagattagtaaaagaatgagagcctcattattcaataatttgtatcattgctttttggtaatgatgtataacttcacactttagtgaaatactgattacaatctataattttagatttcagacaacttcaaattgttctttcttaatctttacattttttatttaaaggtaatgaatttttagatagccagcaaactaaaatttgctactgtattttctaaagatgtcagataattcttcaagatatgaaatcttgttttgcacaatgtaggccattcgtcctataaataggtaggattttgctattctatttctatactccaacaagagtatggataaataattgctttatctttatcttctgttgaaataaacaataatatgtaaaaatgggaataaaataattctgaaatttaaaaagacaaattatcactgaatatttctaggaattataacaaaaattacgtctttcaaaaagtgtttttttttaaaaaaaaaagtaaactaaaagttagtgataatccttaaagaaaaatggtatttaattccaagcatcaaagcaaactgaatttatctaatgaggggctacaaaaatggcagaaatggatgtttatttgaaatagaaatcccttttgaatttcaaagacaaatgtcttggtgtattaataactaccttaaattttttgaacaaagtaggtcataaattattaaagtaagtagagactggatagattttcattcatgaatcttgtaaaattttacaatatgctgttgttattctttttaacacctttgttcatatgaccagattacgagagatttgctggcagttattatgttttcgtaatccctggagcccctactacgtaatgcactgtcttaggcatagtaactttttggaacaggtactgaaatgaactcctgtttattttttaactttataaagaataaatatttttgggctgctttattatatatgcttgcactagcaggagatttccattatattaatgtgctagcaatgcattattattgcacttttttatttttctattcttttttatttctttctcaaaataactgagcttccttgtcttcaatcatattatacaagttaataccgacctcagaaatgcattcttctagtcatataactctgctaaacctgtgttccagaaaattattcttcttgtttattttagctgatcaggcaatatagtgccctgaattacagctttgttttccaacttaatgagggttagtattcctctgagaaatgtgtactgctaaggaaactaatctcctacttcatcctgtcaatacagtcttgtcctaccaacaaagaggaagttaaatgctaatacctaatggtagaactgattagaagaatgaagagaaggtaagttccattccttaagtcggcccagcacataggggaaattattcttaagagccccaaatacaagaatcacctaggttttctgataaatataaaatatcatggtgtttcaacgtagatgatcatataagaaaatatcattgtaagattcagattgtacttcattttaattcataaagaaattgtcaggcactaaagaatgaagtccaaatgaaagatgtttagaaagtatattagattggaaaatctaattttaatataaagtatagggaacgctttgacaaagactcttttctggacctaactctagtcaggctcctgttaactcagttctcagcccctgacttctgagcttctgcatttgtctctatgttgtccaattttagcaagaatcctgctaagtcagttttatttgaatcttcacccttaatatatgatccgcctagatatccgtttgggttcctcattcttcactatcctgaaggtgatatctgaccaccctggcctgtctttagcaagaatcctgttagatcagtttagccagaatcccctcttacccctaatgttttctcttagtaattttccatccactgatccccatcctgctccttggctagaaattctactttttcttgttgagttcagagttgagtgaaacagctgtcttccacttaccaaaccccattaaagtagcccaccttgaataaggtctatcccacaagtctttaacaagtattatgaataatttttttattaacagcttcagaaaatgtatgacaattaatatgttttactaccaaaacagtaaaacagaagacagttttaaaaaaaagattaaaacgatatgtagaaatgaagtagaaatgttaggtgcagatatcaagatttaattgttgctatgactggcaacatgattttgcctttcctggcagaatctaagaatagaaagtgttccacttgcaaggataataaatgctttttgttattaaaagaattttgtcatgtaagtgtcaatttaaagaaaatgtggacaatattgcccctgcacttttggatagtgtgctcaatttcagttttacaaagtttttttttttttctttaacaatgatctcaaataaaaactaaaagtataaaaatggttcagcaaagatattcatactgctctaaataatggcttactaatataatctaagaacaattctcaatactgggacaaagaaatcttggagtttggtaaccaaatggaaatctctcaatctgtaattgctcccaggcttaccctggagttaaccaggcatacaaggtgaaatgagctgtttacttagaagttattttctagagaagcataaataagagcatgtactctgaaatcactgacaaataaatattacatttaaggagctttcaaagatggttcagtaaaactttttactaagataaaaagaggtagtacttatctagtccacaggaagaaactttcagaatttcaaaataataatcttcagtttcttttttaccaatttctaaggaaatgaaaatgtttcaacatttttaaccgaggaatgtgtgttacaaatattattagtaaaccccttaacttgtcttcttactggttacagaagtcattcaattcacatggtaacaattccactgtagtttaggcaacatgaggcagatttgtctctgttttatacactaatatctctgtggcaccaacaagagaacttggcatgtagaaggtcctaaataaatggagtttattaataataaattgaataaaaaataaatttgtaaataaaacactcgtaatgttaatctgatttttcattaattattataatttaaaaaaattattggaaatgtttccattaaaaagaagccaacatattttggagataaaaaaacacaacgaacacaacaacacacaaaatgccactaaatcatcactctgagaattgttatgactattttcagaaatgtcctggtttctccatttctctttaatagttattctttaataccctacatagaaaatgcattattcattgacttttctctataatgaagaattagacaaccctcttctctctaagagagttatatttacagtatcaaaattggacatgtgtgcaaataaaatgagtgaccaagcattaaatttgatttagtagattaattttaaaaagtgtactacaaatagcaaaaaactgtaagcatcttatgagcaatgattacatattttcattgctatattcccagggtttacaccagtgcacataattcatcatacatctaatgtacattttttaaaaaaagggtcaaaaacagaagtgatcgacaacaagcaaacaaaactaacaccaagtacttaaatctttatatgctgttttccaattgcctccttaactgccatctagtaaagcatgtcagaactctgggtgtttctaattaaagaatgcctctttagaaaaccttagcacaacttacccagttgacagagaggcttggatagcccaaattttaacccagaggttagccttataatgtctccaaaagttacatggtgtctaactaagctttctttcttacaataagcatctacttttatcattccccaatatacaattttgagaacacttgacatttccaaggaccacttgtcaatacattaatttaacttctaaaatagcccaaactgtcttcaaactcaaaaggttatgaggtactatttcaaaagaaaagtaaaccatttttaaaatttaaaaacatttttgaaaaacatttttagagatttttgataacagtctttacataaaaaagaatcactcaaattttgaaaagaaagaaaattaaaatgagacattacgatatctgacatagagagactattaaatattagctattcttagcatgtcatgcacaaactaagtggtaatttttaaaatcatcttgtttgaacttgtcaagaattaccttctgaacaataattacagcaatcactgttactggacttatctgagaccaatatttagtaataaatacattttaattaatagttaataattgtctggtttcagatcttgagcaaattgtcttcagctttgactgatgcaaatatatatctaaaatataggaaagcatttcaaaattatatcacttctgtaattaaagaatcatgataataaacttatttaccttactaaagattattaaaaagaaatattttaacagttaatcaaacacttattattggagctgctgattcttacttgaaatcagaattgatttccttaattaacagctatgaatgataggtttaaaaagcctgtcatataatgacaaaagtgatctttcatttttattctggcctatcttacaattgtaatttgttgtttcgtctttcaaattgattgaacaagatatttgttaaaatttcttcatttcatggctggatgaaagatacatacaaaaacctgccagagttcactctaaaaggaaacaagaatcctctgaattattttccctataggtaagttactattcaaacatattagcgttacatttttgaccaaaatataaagatagctacacacttaataagacaataatctgactttgatataaaagttctcaaacaaggaattatggattgcaaaattgtatatcttttggggggtgggagtagaggaggcttatgaatccataaagtgtctccactcaaaagtgagttagttgcataaaacaattaatttaattttaaaaaggtgtaaaaattatttctaaaatatactttgaatgtcctttaaattttttttttcaggagacccttttttcttaggtatgaagtttaagtttcaattcacagagaaagctagattcacttctctagttcacgttaggaaaaataataatgctgtctttgagttactccaaattacctgctgaaactttgaataagtagaaatgagtatcttatacatctgataagcacagatttcttcataattgtttacccataaatttcttttaataaaattaacaagttgtttaaaaaactctctttggagtaaaattgatatttaggaaaaaattacactttctagttgttggtactaatcattgataattcattttcttctaaattactccattttgaaacatatagtcttcttcctcattattgtttggtataatcttgacaatattacttaccacatttataaaatgtactattactgtgtctttatatattagtgaactggtctggatgaataataagaaattctattactgtaaactcaagtatagtcatttaattttaatattttcaataagctagacttgatctatgtattaacatgcttggcgttatatgcaaaaatgttaagaaagcaagcattaattatcttaaaatagtattttgtgcaactttgctgcataatttattcaatttttcataatttttcttctaccaatttagagtgtatttataattatttaagaagtgttcatgtctgaaaaaaacagtatttcttctgtgtatatacatttacagggctgacgtttcaaaccatcagaaatattaccatactaaagtcatgaaaaccactttacttattatctatcccaggaacttcctgattttattaatttttgttctatatttagtttagctataacagaaggggctttggtgagcaacattaaattgaatatttaaaagcagttacaaaaaatttgtcttaaaaatatatgcataaggtattatatagaacccaatcatactcaaccttcatgcagatatgtgctttttaatatgatatttgaataaactcatgctttaatggctaaatttagtttttgatttaatttaatcacattttttagactggcttacatttttgaacagcatctgaaacatttcaaagaaaatatttgttattagtgacagtgagaatttaatgaatctgtaaaataacattgtagttatatactggccactatttgacactgaaaaatctaaaatgcatggttactgaattctggtcttcccaactctagattgttttttaatagtgcaatattttagagatagcttttaaaattaacaaatgcaacagtccagaaaagttaataaaaaaaagcttaatcctgatgagcttggctaatactcacagaaatcaggaaaaataagtctatctataagtattctttcacaataaatctataatggaatataaatgaaacacaccattatgagagaataattcttacatggcagagaactataataaattctaatgtaatgttcatgtatttattaatttaatcaataaatgtgtactttatagatttaatttgctggaactataatatggtagctactttattagctattaaaaggaatttgttttgctttgggtgcttttaaaggcaaccacatctcatctgagttaattagggtttaggcattaaaacaaatacttataaaaaaatagtaaaaataggttgcactgagggtactttttaactctaaacttgaacaataaaacattgacaaattatgaatagtgattattgaaaataacaatgaaatagaagaatgagaatctataagatttctcagtttagtagattgcatgtcatttttcaccatctcaattgatacaatcatggttgaatataaacatttcaaaatttgaacacaaacatgtatttcatgataaaacatcaagtaatccaatcgactcattataaatatttatgctatatctttcaatttttgggaaaagatattgattagtaaatcataattgagttattgcaattattagagcatcaattaattactcttgattagttattttgagtatgaaattgggaaatgctccagaactgtatgaatgaatactttattttaaacattaagtgtagaggagtggattaaaggcttataaagtaagcttataaagtaattatgaagactttgtaattggataggtctgcaggtgagtaattggatacaaatattcttgctagcttatatttatgctttgaaaagataggggcagaaaccttcaaagttctttgtgaggatatttcataaccagtataaaatcgttatggtggctatttgatgctattaaaaaataaaaaattaagaacttggccaggacttccaagtatatcttcagtagaaaggtcattagtgttcattattaaattttatactcagaggctcattttcaaaaaacaggatagaatatttcctaaaatagaataaatattattaaactatcctcctccttttagcaactaagattatccattagcaatcaataatattcacatagattatttgttattttgctttcctttaaaaattatgaattattaacactaaaataataaagttatacagaacacatagtagtgcatgaagaaagtggacagagttatacttcgaagtgtctaaataagtttatccaagtagttgctaaattaaaacaccaaaaatgccggatgtcatcctaattaattctagtaaactttatatgagtttgtaaaaagcattggaaattagaagtttgactgtctaaagtttctccatttttaaatgattacatgaaaatattttaatcttgttcccaattaagagtagagatcatcaggttgacaatataaatctgctaagaaatcagatgtcctttctattaaataacaatgagaaaccaatcaaaagcaactattttgtaaaggtgactgtaccccaaactgaataaaagcaaaggtaaatatactataaataacaactaatatgcctcaggaagtgtattatttcaagctttttaaattacacatattgaaactgttatacttaatcaatatcaaatatttattaaattcatttgacaccataacaccactgaccaagaagatttgatactagcattaaaaaaaagttgagtcaacattgtttattgtgtggagatacaagtttatcaaaaatgtctaattaaaaattcaaacttacatggtatcccttgaaaaatatattttgttttcataacatatttgtccttttaaagcatccatatctcttatgtcattttatgtacaactctctgaggtaggcattgtttcctccatgtgagagatgagaaaaataaatgaagagtggtcaagaaatcttaccaggagtacattaatgccaggtagaactagaactgaaattcaggaaggaagtctacgtgtacaagcactctacttttcccaataaccctttattacgatgtgaaagaaaaaaacattaaaagccttagaagagaacatcactaatcataagcacacaatcataatatccaaaaatctttgggatatttttcaagaaaaaatattttttttctaaaaacaatatgtgtgcaaaacaaagataacacaagttggtgtcatattccaatttgcgtctgaactcttttaatattaatatgcaatttgctaaattacaaaatgtttcagactcttattctagtaaataactgcctcttttaaagataatgtggaaaaactaaaaataaatacaggaaacataagaaactgaatcataggttgataatgaaacataaaagtttggaaatcccaacagttgcattctttgtacttgtggagagaaacccacaaatacactacactgcaaataaatacacttttatttaaagaatcctcaaatctaggagtcaagataatggtagaaattacacacacacacacacacacacacactttgagtcccaatggtttcttcctacttaggttttatttacttaattataatgtacaataactttgcatggagaaaatcaagatgtattgtagtttatgaaaatgtacatttctatgatgatgatgaatttcttaagataagatatcctatgagaggatgaaatcacgtaatattatctgattaaaagaaaatgaaattgatcgttatatggtatcatgtctatttcatttggaaaacattattaaaacaacatagatttaaaataaataccttctcccaccaccaaaaatgtgtgcatgtatacaaatatatatgtatacacacacacaaacatatatacacaatgagcatatctactacaataaaattgctaaggattaaatgcaaaagtattagggaattagaattcattgacaaattactttccctagtggaggaaaaactaccttttgcatccaactaagaaaagcactacaactttgcaattttacaacccaaagttacaattatctttcttatttcttccaggttttatcagtaagccatactagcagaaaaattattgatcagggatctacatcaataaatataagtactaaaactatttccagagataatttaaataatacaatttcttagagaagagaaagtgttattaacaaatagaagagttttatgatggtgttttagtaatttttctcttttttttttttttttgcttcactgtgtggaaagtccaggctccttcaacatgttagcaaaaaataacaaaacaatatcaataataataacaaagcttatttgagtattcagaatgtgtttgtcattttaattgagaaaaatctgatagtggaagaaatctattggctgctcaatctacaaaactgaaaatgtaaaataaatttatttggggaagaaaacccataattttctatttttttttttttttcagttttccaactggttttctaaacccaaagattttcatactggggttgtacgctacactgcccttgggcaagctttcttcttttttccttctattttacaacccaacccacccccacctcatgtattttttcttaaggtggagaaaataatggaaatacctacaaaacagttctctcgagtagtcagaattaatttgatagttcaagaaacccttaatagttcttcacctgtcctttatatattaaggtctgggaccttaagaagaagcaatgtttttaatgcatttctgcaactgccatcttccatgttttattaagattatacatttcttcttctaactctctacccttcccatttcttcctctaaccttggtccagtttctgatttttgtaacatggctacacatttaaataaatgcacactaagcagttaaattaatgcatgttaaacatctaaactgttttaccctgtttcgtgaatgtgaatattaagaagttatgcatcatagcaggaccaactgaaaatgcatatattccattgcttgcaacacagaaaaaacatcacgatagtaaaacacaagttatatgattgtcaagaaaatacattcattccttacctgcttaactgcatgatgacaaacaaatctatgtaacacgcaaaagaaagtccccaaaatctgaatcatctgtcttccaagctgctgtggcagttttatatcctggtgctctcttctttgcttacgtacatttgactagatagaatatttttaagtgatactaaggttaatttgcaaccctagtcaccttttccttctttcaaacagccagtgggcattttacacagctccaaacatgcatcttatcttcggaggtagtgcctacacggcgtttcccagcagaattcctgttacaaggaggttccttctctaaagggctgatcacgttctcgacctggtgcaaagtaaaagcctctccggttcaactcttggggactaggagaacagccatcagagacttaaactctctgtcactgtttggctgtggaaccagcagtaaccagcggccaagaagcaccaccccctctccggtggactctggaagagagcgctcccagtcccagatcttcctacttcccacccccacctccagaaagaggaaaataaaaataaaaggccaactttaaagtgggtataatataagctagacagattccaaaccctcactctttgcttttaacttcaaccttatattccaagctctagcttcaagttgaaatctaactctcttccgctctccccaccgccctccagattcttgggagttggtgaaggaaaggaaggagtgaccgtcagcaataatactttaacacagagcctaagaagtcattcaacagttctaaaccctacttcgcagtcagacaaggacagtgattagggttttataaagcaggcattctgaggaatcgtcgtttactaacgttaaatatagctcattaaaataaataaatattaacgcaaaaaggtactaagagactccagagatcttaagtctattctctcatacagaagaggtttgctcaagtttggcttaggaaggttggaaatggagcattctggaaggatggaaaccccctggcgcaccccactctatggggctgcaaatgcccacaccaagcacacgttcgctgcaggggctgagtgcagagcctgagctagcaggtcagagtaggggacacctttcctacacgcatgggttattcccacatcaacaccaagcctggggccagctggtcaaccaggcaccttgctctcctccgttccctgagctcaggtggcataggcgttgccgtgagctgcggagaaatctccacgcagagtcgcctgttgataaccctccagttaaaacgttcttggcagcgggagcccctcagatgtaaatttccctttcacacgcttgagcttcaggtataatacagcaaaacgcacttacctaaatactgactgtctgttccttactggatctgactgtactgaaagttttttttttctttttcttttttttttcctccctccacccttgcgcaacaacagcagtcctccaaagagaatgtttgaattgaattatatgaagccctcctttcttcaaatgaagtcacggactctgatggcactggcttgtcaggcaggacgaccggactgggaaagagaccaggtagaaactagtgacctagtgacgggtgaggggcgccaagtggtgcggaccacagtctcaacccccgttccctctcggtgggagtcaagggggaaaagcccttgaatcccgagacggggggatggggcgacgctgcagctggagtacttttatgtctgggagctaaaagggcttttgaatttaaaaaaacattgcttgggttgtcgcgtcagccatcaatgacgacaagaatagttatttcccagaaattaaaaaaaaaaaaaaggaaaagaaaagcgtgaacaataggttcttacctccatgtatcccaagaaaaggaaatgttgtagagaccaggaacttgtccttaatttgagggcggggggcggatgttcagagaaaaccctcagtgggtgttaaaaattaccgatacatgcaggtttggcatttaatgaatatcgtgctttcctcattatgtgtcaattgtgaagtaaaagtaaagattaaaatgtttctcaacacaactatacggaagaggaggtgataatcttgtcagttaagtccatagaaatgttcataaaagcaaaaggcactgaccatattaacatgcctattaaacacaagggttgggggcagacaagtatgaagagtgaggcaattaaatttttcatgtaaagtctattcttgaatttcaatttatcagaaccaagataatcaggggtttcttctgattgctcctctctgaaatgagtactctgtgtccaattaactgttcaccagctaattcacaaaatcagaaatgtactgacaaatactatgcctgaattaaaatacaatgcctaaaataacgtgcttatgtgtgatttgaaatattttaagaaaaaaaaatggtgccctcaaaactcacagtcctcttcctaccattcagtggcattttagtgcttaaggtcttgctaaattcataaaaatacactttgcaacaaagtcttccttcagtcatgtaattgcttatcatgaacaaatgctgacctgaacaaccttctgaatatccgactagcgaactttccagaccttgcaattgtcagaaggtctcttttaagctctctcttagataaacctataaaatgtgacatttcaaatggcacaggaatgtgtgccaagaagggttaatgggggtgggggcgattaatgtccgtgtaacccataatataaatgaggacaaatattttaaaaataaagaaggtaaaagatattggggtaatacatgggatattggggtaatacattacatgggttatgtcttagcagtgcagttgccactaacatactaattaataaatatggccatatggatctttcagttctgaaagtaacaaaaatgtgaaaaatgaaatacttcaacaaaacagagcttattaaaaatagcaatagttaagtttctagtaacagataaagagaataacttaccagaggaaatttcaggaagcaagaagactgtgagaaaaatacatccaggattcaaatagatattccatgatcttccaaatcaaggtaaagtagtgagctgcagggtagtaggactttaaaataatcagcagttcctggtggcatgtaaccaagtaaaaaccagttacacagagagccacgaa

SEQ ID NO: 1358 - DNA, 64463 bp, Homo sapiens
ttttctcgagccgcctgtttcgggtgccgccatgttggtgaggagaaatcaccgttacggccactgtccaaatccccgcgtcgctgcacgccgcccgcccgctcccacgccacagccaccggcggcgaatagagactagagcggcagcgccggcagcgcggggccgttgcccagtgtttgcagttagagccccatctctctggcgtggttgttaatagactggaaagtctgtgtctgtgtcgctcactagtaaccgtgagtttttaccacttcgtcacctgtcggcggcggccgggagcaggttcccgcaggcggcgcggggggtcttccccgcgccccgccgccgccggcctcgcagacctgccctccagccccgccccgttcttgaccaaacatgacagactctgaacatgcagggcacgacaggtcgggaacccttcttgtctgtctttctgtcggatgagaggaggggtctggggcggcgggagcgggccggggccgggcgcctcctgcatgacctagacgtctctgtgtggctccgtcagttccatgacgcgcactcttatgtaaactgctggatcgcggccgcgggggaggtcggcccggccgcgcccgcctccccgagccggggtcgctgctcgccagcgccggccccgcccccggccgggcacgtgcgagccccccgccccccgggcgggctccgtgtgcgccgggcggctctcagcgtcccggctcggtgctgaggtcctgcttctgcccgtccaggtgtcggtgctcccggccagataggaccagccaggaattttcaggaatgggtgttttgatatttgactgcttcccgagaaccgagaacacctctaaaaaaataaacatttggttttcagggaagttttaagcagcaccaaaaggccatctgttgtatacagtcttatcccttggaatttgagatggcaagtttcaagtttaatatgttaacacaaaatacttaggctttgcagaaacttagtttagcacagttttaccctaacgtaaaaactccatggattattccggctagcccaattttctagatggtgtgtatcacttgaatattgagattctgattttttattttttgctctgtgccttaagaggcacattcttgtttccattcgagtttggggacatttacaaagtatactgtagcatacttaaattttggttataattcaaattttcattcgtatatatctttaataatgcgaaaggggggctttcattcattaaacttactgaaacaaaatccattgcatctgattcttacttagaatattaatttgaaaatctagaacctcacaattactcctttgtgaatagaagtaagaaaaaatatacgttttactatagactatatacattgctgaagttttatctgtagtaatgtgatcggcttggtaaagcatcctaaacacgttttttaaaacccagaagcaaaaatcacaaacactgctgaaatttgaaatatctaaatacctagcaatcttgagagggataaaaatggtatttcaacaacttcagtattgtaataataaaagtagattcccagagggcacgtcaatcaaagtgtaaaaatttttggaaagtaaaatgcacttttaaaaatgataagcttgcacttggcacatttttaatgatttttttaacgttatcttttgtattaaaaaggaaattcttagaatgggttgactaataccttgctcttgaggtatggacaaaccaatgatggggttttgctaatggagcctaaaatcctttttttttttaatatggaagaatatctgttcccctctcttagtgcacaaagtaacttctatatatggagttatgtattgtacatcatgaaaaaacaatgccatcaaattcaagtatcaaaataattttgctggtaaggaactgtgatgacagaccttttaaagaatttgaaattttaaaatactggtttagaggttagaaaactttaaagaattatttgtaagatatgttaataggttggtagtaggagctaaagattaagattagtctattttatttaaaattcggactaaaagtattttctagtgatttctgaaacaaaaaggttagctccactttaacttagccaattgttaagtggcatcattgtgctgagatgaaggagatggtttttttttttcatgctttttttgtcaacccacatgaaaaacaaaacaactacatcaaaaacaaagtgaactagaagtcaggagaaattctacaagatcagatcaatggttctaaaccttccctggggaactttttttctttaaagtattggcgctatttctgttggtctggacctcagcctgggttttaagagttctaaaagctccccaggaaattctaatatgtgccaaattgagaaccgctatactcgatcagtgtttcccaatgatagttaatcatcagaatcactttggggaataaatttttgttctgcccagagcaactgaatcagaatctctagggtatttttcataggctccctgggaaattcttaagaaatttggggaaaaaatggactaatctgcgggcttccaaaatactgtatctttccatataatagctattttatgctgttataaaagtttctgtgaattaagtggagaaaaatatatgaaacttggtatatggagctaggctttgtctcaaggattttattttatttattttatttttttgagacggagtctcgctctgtcgcccaggctggagtgcagtggcactgtctcagctcactgcaagctccacttcccgccttcacaccattctcctgcctcagcctcctgagtagctgggattacaggcacccgccaccacacctggctaattttttgtatttttagtagagaccacgtttcatcatgttggacaggctggtcttgaactcctgacctcaagtgatccaccagccttggcctcccaaagttttgggattacaggggtgagccactgtgcccagccaaggatattctttttataacattttcaaaaattaaggcatattgtgtatgcaggaaaaaaaatgaagcctatgatttatatttacaattgctttgattttatacaaattaaaatattactgtttatgagaatgagattctaaatgtaaatggaattcacagaatgcataatttttttctcgtttaaagaaatagagtctcgctatatgcctaggctggtcttgaactcctgggctccagccatcctcccatttcagcctcccagagtgttgggattacaggcgtgagccaccacgcctggccttgtacatgttatatagtgaacattttgcacaagattgtttgccaaatgaataatttaaaaaaaatccatttagtgtactttcctttaaatattttcacacctggagttaaaacattgtattttataagatgttattaatataaaaatacttctaattctacttgtggctatgtagaatgtagtagaggacttttgcataagcccagagcctagtttctaaaggtctttagggatttagggaaatcagagggaggtataattctggtctctcgtcgttcagttctttttcattcagttctctcaggcacgactccagccgctcagttttatatttcaactggatgttgacccaattaaaacaattcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaaagataattttttagcatgaaccttttaagagcttgtgagtctcaaagagtctttaactgataggtgatatggataatactcccctttgggaggaggtttataatacataaacaacctccccacccttccctcgcagctttctgtcctgtactacaagaacaacaaaactccaactagtcagaattgcaagtggtttatggccccccatatagattgaaaacttgctaagagactgcactggagaacctgaaaggatgaggatggaaaagatgattatacttttcatttgcaacagggctttcatttgattctcacattaatcccatgtggtagttaattaaggtagcattacaaggttcagtgaattgtctgagatctcataaatacaacctagataagaacccaggtattattattttcagtcttgcaatattattttcctacttgcaatattatcttcactcttcattaagtttgcacagcaaagtaatggaataagttctgggctttaatccttgagtagtttggaattgtaatgtgctacatttgagagagagcccttcattttgaataaaaccttggtactgatcctgatcttctaacttgggttaatgctcttccccttttcattatttttttcatttgtgaaatgaagtagttgcactagatcattttcaattttccttcccacttaaatcaattttaattaaaaaaattgcagatgccttttctcagattagagtacactttttgctccacacaatatctggtttgtaaattagtatgttccgtggagtaaataactttcctgactagccattaacttacttctgattcctgaatccactaatttaactattgttgaaattactaaaggaaatttttctttagcaaatgtaaaacctcgtatcaggtctcaggtttgatgttgtaaagcactctgactctcaggaagactctttttttcccccaacctctcataaacaaatatttcattcattataaaatttcattcattacattttcattcctcagacttaacagtgtttcgtctctgctaagtatagtgttaagcactgacaaaagaactctggacacaacatcatgaacttgctctctgggatcttataatctagttgcagaaacagattggtaaatacatagtatagcacaagtactataatggaggcctgaactgagtgctgtgggggtacacagatgaaggcttctgggagacatcatggcataactagacctggaggatgaataaaactttggccaagtaaatacagagatacacgaaaagcatggataaatggcacaagtaggttcagggatgataaaagtgttagtatgtggagagtgtacaactattttggggaatggggaaacggattaaatttggggccagaccctgaaggatgtggggatcccatcaaagtcttttaagcaggagaatgatcagatgcattttttggtatactacctgggggataggaggaaatggactacagaaggggagatcagtagaaggaagacaagttaggaagcttttcagtcattttcattaaacatgaagcttaatatgtattgttctaggatcaggaatacagcaataaagaaaaaacttggtgtaatgaaacatattttcttgggagagacagaaaataaacatgaaaaacagatgtgttcaatggtgataaagcagaaagggagatggggagtcaagtggatgtggggagggtgtttagggaagcacttatgaaagagtaacatttgagcaaagagccctgatacaagacaacaattcagacccaagacatttgaggaaagagcatccatataaagggagtgggaggtagagaaagcctggaccaggaatgagcctggtatgattgaggaaaacacaagggatttcactcttgagtgacctgggagctaatgggggattaaacagaggagggacaggatcctctatggtatatggtaagtgagtagtatggtaaatgaggtaaatgaatagtaaaaggaactgctgtggtaatttaggtaacagatgatgatggtttaggtgaaaatggttggattgtggatatggtttgattggttttagaaccaataggatttactggtggctggatgtggacaatgagagaatagaatgaaccaaagctattgtaaacgtctagaaatcagatgaggacttgaccaaaggcattggcaatgagaaagtaggcacaattcatgaggtatttcttagcattgatagagttggatataaatatctggaatttttagctgattgaaatgttagttgaaatgaatgataccactcaaggtatgtgtgtcaagaggtatggagaagagcacagaagtttttggaaaccaagggaggagaaaagaagggatagtcacagagcagtaaagaaaaataaaggttaaaaataggtcacaggatgtacattatcctaagttaaaatattttaaggtttgaatgaaagggtgctgcagggtttgcaaactggtgggcttcaggcctaaaatctgcctatactgttgtttttgcctgacagaatatcttaaaatatctgtatttgaaagcatttaaggcttgacttgtgctctacactccacagtcttatcattcatagtttcttggcaaactcaccactcaaggtgtgcctcacttatttaggagatctgcctcactagggtagacattttaggtttatgactcttaagttttcacctggacagattggctaccaaaaagaacctcacaggtgggtgaccttgaattcaccaggtcatgccatcagttcagagcggccggagaactctgttctcttgtgcattgatgcccccggagttgtgaaacacagtggccctgctttagtttttttagatttagaaactgatcagtgtcagagcgatcagacacaggaatgttaattcatgttcaaaaataataaccaggctagcatttgtttagcacttgctatgtgacaggtactgttttaagtgctttacatgaattgtttaatcctcacaacaaccctgggaaataggtcctattattaggcaccctttctacagatgaggaaacagacaacagattggtaagtttcccaagatcacaaagtaagtcagtgggaactcaaagtaacctgactccagagcccactctcttatctaagcatatacattcccatcacaagagaacgccagtttattcaagtaaaataaggactagaaatttacatcaagaaatatattctttcaatgtagaatgctgaatggaaaaccaaatttcaatagttgcctactgaacaagatcatgagataacaacaagggagttgattataaatgactagaagttttaaatggcatcggcgctgataaagtgataatctcagctccatgatatacttgtcaagcagttacttacatcaatctgccttctaggatatcctttctcctggttgatgcttatatgatagtgttttgtacctttcctttttcactgcttccattgctgaccaaactactcacctccatatttctggtagatatattttttctcattgcatgttagtatcttaaatttagtcctatcttttgcttgatcctctgggcttgacttcctaatctatgttctggtttatgttttagtttgacagttgagctttctgaggacattcttattcccagtatctttttttgggtggttgggttctgggaggtggtatttgactgctgctgatgtgtaccaaccaagacagtagtcattaagtgactaacaataatgatttcagcagattattattactcttggcaaaaagcaagctttctctattataaatgattttatatttgttttgtttttctttatttgtaatttgagttctagcttaacattaatacttcagataactgttaatacactttcataaatcatacccacattcttgaatggcaaataaataaataatcaagttccgagtagtttctaaagagagtaaacattaaaagtaaacataaaactacataaaaatcaatcacagtctatttataaagttggtatgaaaacaaagatcctagatttggaacactcatgatactcaatattttacatatatcagagtttgtaatttccataacttcatttggtagttagacatatagacagagaagatattaatatattcattttatagtttaggaaacagacttggaagggcaaataacttgtctaagatgactaagcagctgagtgagaaccacagcctatctgtggcattcagtctcagccatctttcccttgcttcataaggatcgttactctggtatcagttgctggactgggattttgggcatttataaatgtttttattttggatatcactgaatcacagacaatttcatcttagttaaaaattcatctgacgtgacacttgtctaaatcttaaaatattaaattttaatgtataaggatgttaataatctttatattttaagagactatgaagtcaagtctggctaacttagatctggaagtttttagctgtggaaagcaattctattgtgtacaggtttcagcctgtgaagggaattcattgaaaatgcatagagatcagaagaactaacacctttcttgcatggatttttcttgattattggcagttaacaataaaatgttattagatcactggtgcttctgtgtggggttgagttttttatgatatctcctgttagacccataagggaggctgtgagttgttttctacatccttggactatataagatcctcttttaaaattatattttatataagcacatgaaaatggaatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatgtgtgtgtatacaaatatgtatacacatacataatatctggagcaaaaatgattatgttgtacagaacttttggaggttttcctccttataaaattctgaagtggtagagttaacattctgcttttaatttatctccaaaaaaatgtgaagaattcccaaataagattttctcatagaagattcatggattttgagtctgagaaaaaaaaggaagaaaaaaaattcatggtataaaataactaaaaattaaatatagtctttagaaatgattttgtttagtataattaatactggtatgacaactgaatgcaattgaaattatgatataaaatttctattctgctttgtatttttcgttaaagtttttataattgtcatctgaaaaaggatttaatattcttcttaaattcattagctaactctctcaatattattacactattatttgcctatttgaaaattgttactttctttcgtacataaatagcattcataatcattgtgacattttcttcttgcattaatgtacatttatacttcatctaattgagaaaattttaacatacaaagtgacacaaaaagattttcattccaagttttatgtaaaacacctcaaattggaaaatgaatattcagatactgagtaaatttttttttttttttgagatggcatctaactctgtcacccaggctggagtgcagtggtgggatcttggctcactgtaacctctgcctcccgggttcaaattattcccctcccttagcctcctgagtagctgggactacaggcccacaacgccacgcccggctaatttttgtattttttggtagagacggggtttcaccatgttggccaggctggtctccaactcccaacctcaagggatctgctggcctcagtcttccaaagtgctggaattacaggtgtgagccactgcacctaaatgacatacttgaaaaaatattctcgggccgtgtgtggtggctcacgcctgtaatctcagcactgtggaaggttgagggtggatcacctgaggtcaggagttcaagaccagcctggctaacatggtgaaaccccatctctactaaaaatacaaaaattagctgggtgtggtggcatgcgcctgtaatcccagctacttgggaggctgaggcaggagaactgcttgaatccaggaggcggaggctgcagtgagcagagattgccccactgcactccagcctgggcgacagagcgagtctccgtctcaaaaaaaaaaaaattctcactttctgttgttgttgtttgtttaatgattaatagatgatttatttaagcaagaatacatagtcatcattgccagacttaatatgacaggttaaatgttggacccaattttccttcccagataagtttttctttcctatccatgtcagttttaaaaacataataccagaagaagaggggcccaattccacacagagctcccaagagtgagtttttaggagtgggtctgaaattaggaaagacacttgctgatcttgcataggtccagggaatcaaggcaggattttcgatgagccctcggcagttagggtaagcaggtttcagccaggctcttaatggtcaaccacttggcttgcgcccgctgggtttccaaaaatatgtcctgttcggctgggttgagggcatagtggccaggggcgaaggagtatactttgggaacgacatcttggcgacccagcgcataactcacttttttttggaaacaaggttggctctgtcttccagactggagtgcagtggcgcaatctcggcgcactgcaacctccgcctcccgagttcgggcgattgtcctgcctcagcctcccaagtagctgggactatgggcgcacaacaccacgcccagctaaattttgcatttttggtagagacggggttttgccatgttgcccaggctagtcttgagcctcctgggctcaagtgatctgcccgctttggccttccaaagtgctgggctcataggcatgacactgtgcctggacagatttttgttatactgtttagatatgatggtaactgaatgatcatgcaatctctgaccatgtgacattcagggataccaaaaatgacttgagatgggccaagggagaattggagaagcatactttggctgaatacttaggccaaagtataatttggaacatttcttttaaaaaatctactcccctatgccccccacttgcagtaccttacaattacagttaatctagtagcagatactggattgggatattaggtatttacagaccaaatgcccattgggatattactaggtaacaggcagtttcactctggttcattgtagattcatccagtaagcatttctagagaactgctatatgaaaatattgtggaaagtatcaactttttaaacttttgatgtcatggcacctagaagattattttctgatactcatattctaagggaattttgttttctgagatttgtttctgtggaatttctagttccccagtctgcactgaaagcctaaatcaagaggataatttgaaaggtaatgaaagtaaatcaattctagcttagatacccaagagagtaaatgaaatataaaaataataacttttaaaatgtctcaaaaaaaagctatggcaagctaattcagtttgacttattcatgcaatagtctgtctctgcttatgacataaagtataatatattttaggaatagtgtggttttcttcatgatgtcaaacatacaagcttatggatatatttaaaaattcttaattttctagattaatgttcagcactacttccatcttgcattggatgggggcagataattaataattatcagatattttcttatcaaaaacaaatttgttggaaaaaaaattttttttttgagatggagtcttgttctgtcgcccaggctggaggtgcagtggcacgatctcagctcactgcaagctccacctcccgggttcacgctattgtcctgcctcagcctcccacatagctgggactacaggcgcatgccaccacgcccggctaatttttttgtatttttagtagagacagggtttcactgtgttagccaggatgctctagatctcctgacctcgtgatccgcctgccttggcctcccaaagtactgggattacaggcgtgagccaccgcccccggccgttggaaacattttgaaggaactctttgtaaataaaatacatggcatgcctttctgttttactatacagttgctgatttatcctttagttggttactttgaatcatcattaacatctgttgtcaccataatccctgtgatcactagatgtcatactccattttatgttttattgttgccttggggagactttgagagtatgagaggtgttcatgcagactgctgctgagtgttgcatagagatggaataaagtacaaataccttcaggaacagactccaaacttggtctattccagcttcctttcattttttttttttaaacctattccagataatttttcattggtattctctgaaggaaaataagagaaatttcctcttagaatcccttctccttggatttgtaacctttcccagttcatttctgtggaagtacttgtagtccagcatagtaattctattcagatatgtatagttcagttaagtcacgaagggaaaggaagctttcgttgagggctatctactaggtggtacagtgctaggtaattaactttatctcaatccttaaacaactctgcagtggtaagggtgattaattcatcccattttgtagacaaggaaactgaatgttagagggatggcataatttgttcatgttcatataggtagtactttgggaagcagaatttgaacacagatctttctggttctagagctttgtgttcttctaccttgctatgatgttaagtaattagttttaacatgccacttaagtttaaagccttaagtagtccttttaagaaatcttttgttgctggttattctcatttaacactcctattttaatttccaggttcaggtgacctcactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttattaataaaatagttttcattctttgagcgttcctcttctcactgcccacccccccgccaccaccaccctactgactttgatgagctgaactgaaccactcttttttttcttttttttcttttttttttttgagacagaatcccgccctgttgcccaggctggagtgcagtggcacaatatcggctcactgcaacctctacctcccagattcaagcgatttctggctaatttttgtagttttagtagagacggggtttcaccatgttggccaggctggtctcgaactcaagtgatctgcccacctcagcctcccaaagtgctagggttacaggcatgagccacccgtgccaggccctgaacactttttttttctttttctttttttttttttttttgagatggagtctcttgttcttgtcgcccaggctggagtgcagtggcgcgatcttggctcactacaagctccgcctcctggtttcatgccattctcctgcctcagcttcccaagtagctgggattacaggcgcccgcaaccacgcccagctgatttattgtattttttagtagagacggggtttcaccgtgttagccaggctggtctcgatctcctgaccttgtgatccgcctgcctcggcctcccaaagtgctgggattacaggcgtgagccaccgcgccggccctgaaccactcttcatcaacttatctgggaccctgaaatgaaatagggtgacccattttctagctttatatgattttctggcttcatatgatttaaatatttttaccgttttttgtttgttttgttttgttttgtttttgagacagggtctctgtcacccaggctgaaatacaatggcccaatgacagcttactctagcctcgacctcccaggctcaggtgattctaccaccccagcctccagagtggctggagccacagccacgcacctaacacctggttcatttttgtatttttttatagagacggggttttaccgtgttgcccaggctggtctcacactcctgggcttgaccagttcaccctccttggccttccaaagtgctgggattataggcatgaaccaccgtgcccagcttttgaaaaacctgtacaataaaaagtttggactaatgttctttgagcccttaaaaaaatgctattcaattaaaaaaaaaacaaacctatagtgtcttataactccaaatcccatactgtcacccaactggtctgccctggtgaccaccatttcctgacaaacattcaaatcactcctgaggaattgaagaaattcacatttatgacccagtgacactggccttgtctcagttcctatagtgtgtcatactctgttctgcacagaagttttgctcatcctattcctttgtttgcagaggtcccttccccatcccctatctctcaggcagactcctcatctcagtttatttacgacttcctcagggaaagccttccacacttccctgacggatgactttcccctgttgtgtgtgctcatagcaccatttacctacttcgtatacttgtgtggttattttatgtttatttgtgtgattctttgattggtgtctgtgctgtcccaagattaaaaacttcatgagagaagaaaccatgtctttttcttgtttttgtttgccattgtatccccactgagaacatggtgaataaatacgtgttaaatgaatgaatggccttttttttttttttagctggaaggacataaaattcttacatacatatagtttttaagaattatggctgcagatattttggatttcatctctggattaagtcagaatgtcagacaattgtgtacttgcacagtagtactttgttcctttacataattgttttttcttaattgaactttggtagtgtgcccttggctcaaattggcatatgctgtaagcaataaaatgttgcattgattgtatggacactcttgaggacagtgtctgccatatcaagtactatccattatatcaggtaatatcatcaggacccagaggagaaatttctctctgatcttactcccagaaaaaaaagtgtgcttttcttgagcaactggtctgtttttgtctcggaagcactgttgtcttaggcctaacttttgtttcctgaagctcaaagtcagatttgtgactgacatctaaaaattagttaggggtttctggcataccctgtgtaagctaatctcagttttagtttcatcttaatctctagaattttaactgtgattatgtgattatttacatattttatagtttgttcaataaaatactttttttttttggaacagagtctcactctgtcggccaggctggagtgcagtggcacgatctcagttcactgcaatgtctgtctcctgggctcaagcaattctcctgcctcagcctcctgagtagctgggattataggcatgtcccactattcctggccaatttttgtagttttagtagagacggggtttcgccatgttggccaggctggtctcgaactcctgacctcaggtaatccgtccgcctcagcctcccaaagtgctgtgattacaggcatgagccaccgcgccaggcctcaataaaatattttataaatacctttaaggaataatacaaacacaaccagagcttaaataaataaatgtaaatcagtctgcttgctggttaagtaatgagttcagtgtttctctccgcacagaaagtgggagagatagatgaagaagaaaataaagcttattacatgttgggaaggatgctaggcactaagttcctttttttgagacagagtctcattctgtcgcccaggccagactgcagtggctcgatcttagctcactgcaacctccgcctcccaggttcaagagattctcctgcctcacctcccaagtagttgggactacaggcacctgccaccacgcctggctaatttttgtatttttagtagagataggggttcaccatgttgaccaggctggtctcgaactcctgacctgaagcgatctgcctgccttggcctccgaagtgctgcgattacaggcgtgagccactgtgtttggccagttctaggcattaagttctaattggttcatttggggactcgaaattctccattttattttattttattttttctgcttttgtcacaaaagcacagacattgcttaacaaagaggtctgagatgggatatgaatgttaagctcagggacatagggtcaacacttttgagtgcacagactgggaacctggcacagttttaacaatcccctcccctattttcaccatcccttattcctgtagaagtagagcagatgattacgtattcactgctatatggcttattacctttgtaggaattctaactgaagggcttggcatttggcctgactgaatatcagaatccctttatttttcgttccattgcaaaataattttttgtgccatcagtgaaataacagctatgcagtggcatatacagctctggagaccaggcattagaagactgtgagacaagaataactagaacgatgataaggagacactggaagtcactttagattgatgaccaaagatttccttattttgaccaggaggtcagatctcaagggtccttctgagtccacttttgattagccaaattgtcttttctttcagtttgactataggttagtcaaccttccctccacattcatcagggaatgttagcaatatgtcatatttttttcttggtgtaccattaagcaatctaaagctatgctgttacctgtaaccacttggattaattattttagattagttggttatacttctaggttttatggctttatcttttcagtcagcattattaaccaagttttggtagctttttcaagttttgtaacccccatccagggagatcagtgtcctctcagacactcccaggtaagcatgatctcctggaagacgtgagaagtctcttaaatcatctaattattacattggagctatataataactccagtatacctggagttattatgcatatatgcaagttaggttctaatgaggcaaatgtaagtaaatatgttgttgattcaggaggtaaaaattaggagagccatgtgtagttttaagaacaaaagaggaattacttgtaacaaaagtaagtaagaaaggaattctcagttatctcttgggtagagataccttgcatagagttcagcaaaaattccaaaggttgtcataggactatggaggccattaggctaattaaaatttataatattgcccatatatttgtactaagtctcattcctgaaggattttatatttgggttgaggctttgagaaattctaagactggcttgagcagtaaaacaaaccaagtaaaaattgccatggctgtaaatagtcaaaaaggggtaagctaagtttctgcaaactaaacaatttcagagggtgtaagaatgtattggataaaggatgaagataaaaagcactttgaagactattgatactcatcagattttaccactgataatttttcaagaggaactgtttatgaaactgtaaagagaaaatggagatacaaaaagccatccaagatgtaaatgccgaaggccaagttttgagataaacagaaaatcacgaaaactcatgtctggtggatcttccatggccccagtgtgagcagacagtattttccttgaggagaaatactagtttggtgggggtaaggtagggagttagtttaaggattaatcaagagaactatacatgtgctatttaggttgagggaaaagatcagaataggcatgggcaaagcctagactcaaatcaagttatctatcaagcaagctgacatattcagacagtttattaattacttagagaaatgcatgatcagcatagtgtcagctcctcatgtccctcatccgcagggtaacactgaaactaaacgggaccacatgataggtaacatgagtggtgggcactctggctgaggaacagtttccatcctgtagctaagtagttttttagcctacagctacatcctaaggagtgggcaaggtggtgaatctcagacctcatggaaccagggaaggtggatgagaaactgcctcccagcaggctcccacaaaatatggaggttggtaagaaatagccttgtagcagcacctcacaatactgcctatctttccatattctgaaggaacacagagcattctgccaaagcttaggtcagcctatcgttgggcttacgtaagtagcctatgtggaggcatgcgagttttccagggcacgagtacagagcagttatcctaccttatcatctatagtaaggaagaaacgaccgtgtgaattagtacaaaagcatgaaaagaaaaatgttataagtaatcatttcaaacatctaggaaattttgttctgttggtcttaggataagcattctgcttctattaagttgtttgctcctggactgcaaagaaatcctagagattctgacacagtcacttggcacattctgaagattgtctttttttgtggtgatcatattatcccaagaagtttgcattcatgagtaatgtcattgtactatcatctatcaggagtacttgtatagtcttttatagaggcttttgtgtttcttccagaagactcagtttctgatctgtagcttgtaacaggagcctttaggcaagcataaaaaaaaagcagaaactactgtggaggtaagactgaatagttgaggttaatttattttaatagccatcaatatcagagtggaaaaaagtagaatcctctattaaggcatatcagtttgtaaagatttaatgaataattaccttagaataagaacatcatgggtgacgagggtactgaccattttcagagtcttgaatttttataccatagggtattatgattttccccagttgtctcaatctagatacttagatctagagaaaaaatatttttaactattttttaaaataacagctttattgagatacatttcacttttaaagtgtacagatcactggtttttagtatattcagagtagtacagtcattaccactatttaattttagaacattttcaccactccacaaagtaaccctttacccactagcattcactccctatttttccctctaatctacctggcaactcctaatctactttgtatctgtatagatttgcctaagatataaaatcttttaaaattattgtttattaactgaacagttatttaccagtcattggtacaagaacatgaatatgctccttttttaaaaaggacataatcagtctattgtgtttatattaataaaacgtcacatatataattaattgactgaggaacttatctatttgatgtattacattttttaaagtcttgtgtttagtaaacaaaacagctcttatataatagtattaagctagttcaaaatctagagaatgataagaactcttaattatttctattacctcttctaggtatttcccaagatcactaggttagtatctgatacattactaggtgttcaattaagaaagctttattttattttggtgatagagctggaattagaatccagctttcctcccatggagtctccttctctttccattataccacacatgctttccacatgcgtccaaagctgacatttcaaagggtttggaagcagttcatagtgtgaattatttttctctatttcctctttctctcgcattttttgtagccatacaaaaatatacaagtttaaatctgctattatatgaatgctgaaatgataagtaggctaagggaaactaaaaaaaattttaaaagcttgcagtgttttatatctcgtaacaaatataaatgacccacatttcacacttaaataatgtatgtaaagtaggacatgagtttatgggcatttttagcatgtttactttgtttttaaatagctctagttaaaatgctaaatatgaagcagtgatttccagatgtaattttttttatgctttaaggagctcacgttgaaggagaggcgcagtaaaagaaaggataaacacttatagattttttttgtcatttgtgttttaaattttattgtggtataaatgtagatagcaaagtacacaatacttaaatgtataacttgatgggtttttacaaatgtgtataatgtatatatagtaatcacacagattaatatacagaatatttcagtacctcagaagtttccttaatacccctttttttgtcacttgcactcgtgcaagaggtaatcactattctgacttctgttatatattggtttgtctgttttcaaagtgcatatacatgaaatcatacagtactgtcttgtgtctggcttctttcactcctcattatgtctataagattcctctatattgtttttttgtagcagttgttaattttttctttgtagtattctatgatataaataaagcataatttatatatctatttgcctgttgatagagatttgttatttataattttttactattatgactacagctgtcaaaaacattcttatacttgtcttttggtgaatatgtgcactcattttctcggattgtaaggttttgtagtttataaaagttcaaaacattttaattgaaatagccagaatgccaagactgcctcataagcaattttcaagtctaagtgaatattacctctctgattttatagtagaagctggggaaaattccagtgactttacagccactttagggtcgtatcatatgcctcttctatgatgcaagagttatgggtattatacattcagggattcagtaaatagcaaggtgccatgctaggtgctagagatacctctgtaaaagacagtcatacaccctgctttcaccaatgaacaaacaagtcatttgacataatgtacagagtgcaatgataagagaaatgagaactagcagaggagtacttagaatgaagcatctcacctaaatctgggtagtaatgggagacatcttgtaggaaatgacatctaaactgcatccgaaatactgaattggaattagccaggtgaaagaggtgtggtgaggctggtgacatgagctgggcattgagagattttaggcactttttaaggcttgtagacttgagaaattgaaagtagctgggtgagcagagggaaccattgaagattatctttttattatagaacacctcaaaaagaatagaatgaatcctcgtatacacatcccagtttcagcagttaccaactcatggccaatcttattaagaccacgtccactatccgtagtggattattttgaagcagatttgagatatatcatatcatatcattgaagatttatggcaggagagtgacatgatcagttttgtatttaagaaattacacatacctggtaattctaaattacctttaaaatgcccacaccatagtttagttgtttttcatttgctgccatttatacatagacagttacctttctgcatgtactatttgtagtagtttgcactttttcaaactatagtgttttggaagtatgattaaatgttaaaattgttttatgtattcatctttccatgtgtatcggttggtttatttgcattttaaaatactattaatgaatattttggtttctatctataaaatgtcataatcaatataaaagtcagtttgtttctaggattcagcctccataatagcaaagatactagtatttggaaagaaattagatttatagttctactatgaatcttttttacagattcaagttgaggaattgttttgtggcttgagttttgttactatctgtgtatgaaaatttggttttttgtttgtttgtttacttagtgtttgttggtaagaattaatattgactggctgggcacggtggcttgcacctgtaatcccggtattttgggaggccaaggcaggcagatcacttgaggtcaggagtttgagaccagtctggccaacgtggtgaaacccccatctccgtaaaaatacaaaaattagtcggatgtgatggcgtgtgcctgtaatcccagctactcggaggctgaggcacgagaatcgcttgaacctgggaggtggaggttgcagtgagctgagatcgtgccactgcactgcagtctgggtgacagagtgagaccctgtctcaaaaaatatatatatacatatagatagatatattgctttttaaaaaatttatttttttcagattatgaaaaacatttgtattaaatatgaccaacagtactagttttgaataaaatgttttacacagataagtttaaaaaaatagtatgaccccaatccaaaagaaggacggtgacacaaacaggcaaagtatgcaagcaatataacaggcagggaaaattcaacttcactagtcatcaaagaaagtaaaattttagacctattaagctggcaaaaaaaaccaactgaaattccaccaccaacattagtaaagttgtagtaaaactaatctgctgattcactgctaaagatgatctaaattggtgcagcccttgtgcaaagcatcatggcgatacacgtcaaaattcatgagcatggtaatttctgtagaccagaaatctcactcttaagtaagccccatatcaagaataaaattcaaccaaagaattacttcatgcttaaaaatgcttattgccgagttatcggcaagcaatcaaatgcccagctctatgtgaattatttatgatataaaagaacttgatcaaatgaatatacagccatgaaatgtaaaatatttaagtacaaaatacaaattgtcgtatgcacaccaactaaaatttctgaaaatatgtaagcacaggaaagggaacaatacaataaagaaaaaagttatgattcaaatgaagaaatgtttaattatttgatactgatacagtattttttaacttaaaatgagacagatccttatgtgccttttgaggtttccctttaagccacatgcctgtattatctattgaaagaattattttttagaaataaaaataaaaaaagaataatttggccgggtgtggtgggtggctcacacctgtaatcccagcactttgggaggccgaggcaggcagatcacgaggtcaggagattgagaccatcctggctaacacggtgaaaccccgtctctactaaaaatacaaaaaattagccgggcgtggtggcaggcgcctgtagtcccagctacttgggaggctgaggcagtagaatggcgtgaacccgggaggcggagcttgcagtgagccgagatggtgccactgcactccagcctgggcgtcagagtgagactccatctcaaaaaaaaaaaaaaaaatttaagaactgtatgcatagggacaagccataagctgcaccaactggatcctagatcctctttcgccaagggcagcccattcttggttcttagattccttttattttaaaactatagctgtctatgagccactaagttaaaaataccttcctgtaagtcgagtgtttcttagagcattttagtttaattcctttttttgaagaaaatttagtagatggtaactattggagtactttgggatagcactgtatttattcatgcattcattttgtgagaatcagtgattttaatctaagaggtttgcaaacttcggctgctgataatggttcttacattcttaaaggaatgttaaatgaagacgaattcgcaacagaaaccatatatggcctgcaaatgtaaaatatttactatctgggcctttatagaaaaatttttcaagtgcttgtctaaatgaatataacataaatccttggcatatgctttttttcttttgaaaatctttctgtaagatttgttttagaatgatatttgaaaattaaaattttccttctatagagaagatggcgaattagaagatggtgaaatagacgatgcaggatttgaagaaatacaagaaaaagaagcaaaagagaatgaaaagcagaaaagtgagaaagcctacagaaaatcaagaaaaaaacataagaaagagagagagaagaaaaaatccaaaaggagaaaacgtgagaaacataaggttagttagaatctactttttattcttttgataaatgtttatgaaatataaaatactgaaaattagaaagtagaagtcattattttattataaaacatgtggattagatattttcatttatgtgattaaactttctaaacaaagattatatgaattatcttaaagatttaaaaagtaattaagttaaatcttttttttttttgagatagggtctattgtccaggcttgagtgcagtggcacaattttggctcactgcagccttgatctcccaggcttaggtgatcccccactcagcctcctgagtagctggaactacaggtgcacaccaccacacttggctaatgttttatttttagtagagacagggttttgccatgttgcccaggctgggctcaaactgctgggctcaagtgatgtgccaaccgtggcctcccaaattgctaggtttacaggtgtgagccaccacaccgggcttcaagttaaattttaacgcagattgaaataaataatattttaattgatggaagcttgtatacatggatattggaagattaaggaaagagagtttcattctctacagatacagattagcagcattggcattgtccatctatttattattcatttaggtatatgatcgagtgcttactatggaaacctttatgctgtatgctgagggttatagtagtgagtgaaatagttggctcttaaagagtttacattgcaatgggaaagctatgaaaaaaacaacaaggtactggatagagaattatgtggatttggggtagggaagaaggggaacctatgctgactgagaaatcatggacaagttggcagcaatgtaggagcaggttttgaaactccctgaatttcctccattaaaatcacatcaattaggataacacaaccaaaacccattgacaacatctacaaaaaaaggaagaaacaagttatctctaataaacctaaaaagtacaaatgactggagccaaacgatagacagcaacaagagcagtgtaacaacagcatcagtacaaatgaagcagagggaaaataaagggacttccagaaaccaagttgccaacagatattcacctcaaatggtcagtgcccagcacggaaacctcatgggcctgagaacagcaacagaaactgggagggggctgtgctatcaccagttcatgcatgaatgtaaggtgaccacagaaattggatggtgctgaaaagatctggacctgatgaaccccaaatatgaatcaaccaaattcctttttatgacagagtcccacactgaggaggtaactgctggaagtaaagtctacattgagaaacaggcatatagggccaaggaaagaaatagtcagataacaaatgggggaaggaagcagaagaggcatagctcagaaaatagccatatttttgaatacttcatgctaacaacagaagagataaccctagagctatgaagctaggaaagctttattggcccattccatccatttttttcacatgagaagcaagataagactatggtcacattccatagttgttattgtaagataaaagagaataatggagagtaagtcttccagaaaagaaagcatgcccacaaagcatatgaaaaatttaacctaatattttaaaatgacaaaaaattaagaaaacaatataagctatgctcaaacagcatagaataataacaaaacaaaacaaaaccaaaaggaagtacttaataaaattataagcagaagtgaatgaattagaatgaaaaccaatagttttttaaaaaagatcaacaacatatatatcattgaccaaacttatcaataataaaagggaaaagaaaaataaatgtatatatgctgagggtgaaataactatcaaaaaggaaattcaaatcataagaaatttatgtatataattttatgaaaataaatattaaaagcaagatgaaatggaaaattttctagaaaagtactacctaacaaaattaattctagagagtcaaaaagtctgagactttttggagtttgtaatctaccctaccaagaaacacaaggaccaaatcttttcagagtataattctattagtatttttcaggtgaaaggttttccttagagctggagctgacttctgatggtgactgagcaaacatggcttttaaatagacactatttattttaaatcctagccaagaatgattagatacttaaagttgaagcatttgacagcataattataaaaatatttctttatgtcacctatcaaatcaacaaagacaaaagcaataaaatcataaaaaccaaactccagaccatttaggaacaagatggaggaaagcaatttgtctttcctaaaataacatttcaggatggattagagaaaaacagagccttcccttgtaaaagcatcagagttcaatcatttcagcaaatttttactgagtttgtactagatctagatgctgggactgcaatgataataatacacagagccagtgttttcattgctaggaaatgtaagaactctttaaagagaatgctcaactcgggaaggtaatcattctgaccagatggaggagatttggtcccattttttttgaaattgtattaatacttgaaaaagcttactcttgatatcaattatcattgtacttgacatcaataatcattatcaattacttatgcttttcatttcacttttgttcaattttgtgggccagatttattttatttttgtaatttgtaatgttttggtatcttttagttttagggtactcatgcaatagaataagaactccaaagccattttaggtaaaaacaaattaatacatactctactcatgttctatgacctttcttggtgatctaggagccaattttactttctttaggtttagcttaaatgtagatcattttagagcataggggcagaatatttctgtttaggtcaaagggatgatgaggaaaatgtcataaagtctctgagcagagaggaagatagacttctcagaaaacctcagcgaagttggaatggtggtggcctttggggcaagaatttttcagtagtacttcagagtctcctggaataatataatctactggttggtacctctggctgaaacaagcttatctaattactagttaaattttcttccttttgcaaatgtaacatatttgtctttcccctcccttcagcataattccccatctagtgatgatagttcggactacagccttgattcagatgttgaacatacagaaagttcccataaaaaaagaactggtttctacagggattatgacattccatttactcaggtattgccatttttttgttttgtgataaaacatagatagcataaaatgtaccattttaacccttttaactgtacaattcagtgatattaagtatattgacagtgttgttcaatcatcaccacttatccatttctagaaattcttgatcattccaaacagaaactcagcacctattaagcaataacatctcgttttcccctgcccccagcccctgaaaaccactattctattttctgtttctatggatttgcctattctaggtatttcatgtaagtggaatcatacagtatttgttcttttgtatctggcttatttcacttaacataatattttaaaagttcacccaagctgtagcatgtgtcagaatttcattcctttttaaggctgaataatattccgttgtgtgtatatatcacattttgtttatccattcatctgttgatggacacgtgggtgttcatgaaaaaaagcttctaccttttgctattgtgaatcatgctgcttatgaacatgggtattcaaaaatctttttaagacttctttcagtttattggggtatatatttaggagcagaattgctagatcatatggtgattctatgtccaactgtctgaggaaccatgaaacttttccacagtggctgcactattttacattatttacaatgtttacatattatttacattacaataatgtaagtataaaaatacatttacattatttacataatgcctgagggtttcaatttctctacatccttgccaacgtgtgttttttttctttgttttcttttggaaacagaaaatgagtatgaagtggcatctcattgtggttttgagtattgcccttttaagagaaaaattaaactttcaattttattctttctggtattttatcagacataggctgtaaatttgaaatctttgaacaaaagaatacataatgtattagtttgctagagctaacataacaaaattttatagactgggtggcttaagcaatagaaatgtattttctcacagtctggagtctagaagccccagatcaaggtgccagcagggttggtttcttttgagggctgtaagggaaggatctgtgctaggcttctctccttggtttgtcactggcctccttctcactgctttgtcctaacatggtcatccctctgtgtgcaggaacccctggtgtttctctgtgtccaaaattcctcttattatagggacatcagtcaaactggattagagcccactttaacagcctcattctaatttagtcacctctttaaaggccctatctccaaatatacagtattttgtgctaggcaagttatgatgcttctcagagtcactaggaagtatttggatcagtgtgcacttatctgaaaagccccaaagtttctgagttctcgtttttgccagtctcactgttctggtctacaagagcactattttttctcctaatttggtgttcctaatctcttgtgagtttagaaaccaaaatactatttttgttagagttatttctatagtctgattcactgttgccgcctttatagttgagattgctaagtgaccattaaataaatgaggttttattaaaatatcttctcttaaaatttgaaaagaattatacactagttaataattttatctagttgggtaaatatcagaatgtttataaggtcaatatgtccagtgattttagagtcagtggttgttgctatttctcagaacattttataactgttcattaaaaatatttttaccacaagtgacaaaacttttaattcagcaacactgatatgtagttagatttattctttagaaatattcaaaagtcatttggagactcttacaatgaatgaaaagatgctaaggatgggcattattatttcaagtgagaagacatttgaaaatatcaagtaatgagacaggttctggattcataagttatcactgaaagtaaccccaaagaggaagttccaaatatttaaaatagtggcagcattattgtaataagtacatagccttctatgtggccactgtgggaggcaagatggatttgtatgtataaacaataatgcagttgttttaggtatctcacattttttaaacattatgcagttatttattgttaatattacgctgactattatatatccctgtagacatactgttttatttttgcttcaaaaaaatcagttaaagaaattaagaaaacggatggtcttttatatttatctacatttcatttccagtgttcttcactttttttgtagatctgagttttaatatgataccattttcttttagccagacgcactgcatcgtttagcctttgcttagcatatcttatagcacaggtttgctatcaaattctctcagtttttatttattaggccaatgtgtttattttatcctcattttttataacttttcattttgtcataatttcaggcttacaaaaaagttgcaagaatggtgcagagaactcctgtatatctttcatccagattccccagttaacgttttaccacatatgctttacctaatctttcttctctagtcttctcttcccttcagagagatctaatttgcctttatttatttatttgagacagagccttgctctgctacccaggctagagtgtaatttgcctttaaacctatctattaagtatttttcatacgtagaaatttggttctttaaaatcttctaagtcatttttatagtttcaagtttgctgctgaaatgttcatattgtcttttacttgaaaatagcagacttcagatacaaatttctatatctgaagtctgtatttcttttttttttttttttgagacggagtctcactttgttgccaaggctggagtgcagtggcgtgatcttggctcactgcaacctctgcttcccgagttcaagtgattctcttgcctcagcctcccaagtagctgggactacaggcatacgccaccacacttggctaatttttgtatttttagtagagacagggtttcaccatgttggccaggctggtctcaaactcctgacctcaggtgatctgcccacctctgcctcccaaagtgctgggattataggcgtgagccaccgtgcacggcctgaagtctgtatttctattgcctgttattttttgctggttctctttcatgtgatcctatctcttcataagccaatttttgttttcagttttttctattctgtgctgagcattttgtagaaataactttaggcctaggatgatgttcttttccttcagaaaggatttttacttacttctgccagatttctggtgacccttacaaactttattccaatttcaggatttgagacctctgagccactcagattcctgaaggctgggctgcagtctgtgattcgcattttgagatccccttataattgaggatggggtttactaagcttccaccttttccagactctggactccaccttttgtttccatagacaacagagacagtctaaagtgctgttggatctctcacctggttcttcctgatggggtgatactctcggagcaaatgcagctccaaatgctgcccacttctcaggattttcatctactccatgggtattggtctagtaatccttcactaatttgttagctgtctgatgtctacaaacggatttaagaaaaatattttgtctatcttttctactttttttaagagagacaactagtctgaattgcccagtctgctatttacaagaagagaaagttcagtaccatttcttccatatatatattttagagttgactcactgagaattaagattatatcctaattacatccaaaaatcccttttcttagataacaagtatctgctatataacttctacaattacagggcaaaatttgaatatactgttaaccccccagcagttaaattagagaacttaatttagcttcttttttcctcatcttttttcagggcctccttttcctttatttgtttccagtgattgctgtggggcttgtttttgttttacagaaaccaactctatccctgcagacattctagcagtttgtatagccaaataatcagttggcaaagtgattacaaaagctatctatttttgtggaatttgttgtctttttcatttatcttctctcggttggacttgaaaaaatacctgctagaccctcgcccatgagtgcgttttgttcatcccaatgatgaccatatgaaccataaggaatatatgaaccactctagaaaagcggggctgctctgtcacccttcattcatttcatgcttcctggaaaactcatacaacgtggtgtgaatgcgaatgtgaaggaccttagcagtccacactagaagtctttaaccacaaaaggagccctgggatggaacgtgcattcttaggggactattaagaatatttacagttgggaatctagggaggaggtaaatgaaaatttagggataattctacttaaggtaagaacacagagattattttgataaagctatgccaatcagagaactgaattaatgttaagaatttaaaacttgtatgagaagcatctaatctccagagaaaaattgatactcatctattaacaaagtaatcttcaatcataaagtgttgaaatatatcaagtattaatatagtcacagttttaataaaaggaaatataaccatcatttaactagttaatttaatcttcaacttaatctaagcaattattttttgttttgctttagttttcatagtggctttaaaaaatgtcagaaacactgttttggctacaatcataaattcccttttgaacttctgaagtgctagactaagaatggagttcataaactttaaaaagtactacttaaaacaaatcaaaaatatgatagtgtttttaaaatttaaaattgatgagtgaattggttttcttgattagttatgcattttttctctattttataattagaaagatctaatacttcattgcatttcattaaatacgtagtctcatgttggtattttgccagagtagtattttattttattttatttatttatttatttatttatttatttatttattttgagacaggttctcactgtgtcacccaggctggagtgcagtggtgcgatcttggctcactgcaacttcctttcacctcctggattcaagcagttctcctgcctcagactcctgagtagctgagactacaggtgtatgctaccacattcagctcatttttgtattttttggtagagacggtgtttcaccatgttggccaggctcttctcgaactcctgacttcaagtgatccacctgcctcagcctcccaaagtgctgggattacaggcgtgaaccgctgtgcccggccagagtagtattttaatatcacatttaaaatgcactaacctggccaggcacagtgggtcacacctgtaatcccagcactttgggaggctgaggcaggcggatcacaaggtcaggagttcgagaccagcctggccaacatagtgaaaccccatctctactaaatatacaaaaattagccgggcatgttggtgcgcgcctgtaatcccagctacttgggaggctgaggcaggagaattgtttgaacccaagaggcagaggtcgcagtgagccaagatcatgccactgcactccagcctgggcaacaagagcgagactctgtctcaaaagaaataaataaataaaataaaatgcactaagctaaagatgaattatttggtttggatttgtctagatccttaagttgtaattatgtgcaattttttctcgctttactaaaaaaaattgacagaggatacaatagaactaataaaaatatttcagtgaatagagacagacctgaatactgtcatttaataaacttctagtactaaagtgtattctttgttttcacatgctttagtaaggaagcaataaaactaatcatgtttgttgtaataaacagtttctaataagcaacttattcactagatgtttttcactattagggaaagctctgttttttctattagacccttgatatagacattttctttttataaaattttccacacatacagttttttattaaatataatgtaatttgagaattttccagtgttaggagaaatagtatgttttaccacactcctccaccccaagctatttaactatcttttccctattttcaaaaaggccttttcattttttggaggaaaaatttatgtatgattgtgtgtatttttactttttcctgtgtgtaagatactgagacatagaacatagaaagcaaaggctaaagcataaagataacaatatttaattatctcagggtaacatttaggcttttgaagttagtgttaagtagtatcatagataagtactgatcaagagtcagaactaataactgtcttttctcctttctccaaacttgctggggggaaaaggatgtcctgtgctactgtcaattgctatatataattgaaaaatcctgataatgattgtccattttcacttagcgtggacatatatcaggaagctacataacatcaaagaagggtcaacataacaaaaaatttaaaagtaaagaatatgatgagtacagcacctacagtgatgacaacttcggtaactacagtgatgacaactttggtaactacggtcaggaaacagaggaagattttgccaatcagctgaaacaatacaggcaagctaaagaaacctcaaatattgctttagggtcatcattttctaaagaatcaggaaaaaaacagagaatgaaaggagttcagcaaggtaagtttgaaattacagtctgtcttagaatgtgagaaccttattaaaacaggcagctatggagtaaaaacttagaaacttatccctgttcaagattagcttattcttgtagaacctaaattcattttcttttattttgtagaccttgagaacagaatctacaaatatttcaatctgtatgatacatgaatatttcagttggaaagatattctaatgatttaaaaatacataaaaatgcaatacaactttcttatatttttccccttgcttctgtgtcatgtcagtatacagttatctctgttgctgtatgtattgctttaaatttagaccagctgggaagctatacttttattaggctttaaaatacagcagtcatttttgctaagcaagtgtgcatggactatgaacatcttttaaaattggagataaaaacataatctaaagacatttctgcactgatcacctgtttatctgcaatattgaattacatggtccctggagagaccaggacaagttgccagctcttgacaataagtgaagaaactatgggtcatgtaagcctcaaatcagccttaagtattggctagtcaatgtatctgcttcaggaaaagtggagcaatatgagactgaaatgaagtagtgaggagccacactctgtataactaccctttaattatctttgcatacaggaatcagttatgagtaaatttggttatttctatgactttattttttctcgatttcctagcaggatttctttgaaaaatatgaatgtaggctttagctgaaataaagggaaaataatttttctacacatatgctgttgtactgagcaagtttgttcctgtagtctagatgttgtggtatcagggatcatcccacttggacaataagggtaatgcaaaaaagtcttgttcatcccttcccacctggggcttttcttttcaagctcctacttgtttgtgctcttaaagaactgagtattggccaggccaaaggcttacaccttaagtcccagctactcaggaagctgaggagggaggattgcttgagcccaggacttcaaggttacagcaagctatgttcttaccactgtattccagtctgggtgacagagtgagaccctgcctctaaaaagaaaaactaatttttgtaatttgggtatctttttacatacttttaaataccaagtttttcaaaaacaaaagaagtataatttttcctggagatatatgtgtatatatctactcaaaattaccagtggaaatttgatttgctgctaattaaccactgatacctacaatgtcttccttaaataggaatataatatttgattctcttaaaaacagaaaggcttgttaatgatcttatgctaaggaaaattaaaaagaataaaacttgatttcgcttctctagccatgtgtatccttgttccttgccttcctatgttgttaacatcccttaagaagcagtaccaaggagataagatacaaagatttaatttttttcattgaatctagaaggaaaaaaaagaatgcactgtatattatagactattaaaatgtgctgttccttataaactaataaattgaaaggtatgctgtttttcttttaaatttaagtacattttaacttttctaggtattgaacagagagttaaaagttttaatgttggtcgtggacgtggcttgccgaagaaaatcaaacgaaaagaacgtgggggaagaaccaataaagggcctaatgtgttttcagtatcggatgactttcaagaggtactaagaatttatgtataaggaggggaggagctttttcatcttttaatttatttgatggcaaagaaagcattgtgattttaatgatacttctctagtaaatgaaaaattaccagctcagataaaatgagtatcaataacctccaaaaaatagttgttaattagttgtgaaactaatttacagattttgctgactttgaaataaaattgttatgtttgaaagaacctcaaaataaaattgctaagtttaaaagcaaaaatatatcctctattagtcttcttttgtgcttttctttcctaggaatcatcttccccagatgtaactggcaatgaagtgctaatagctcaatatgtaggggggacaagaagggaggcagtggtaaattaacttcctttttagagttgaaaagattgaaagagaagaaagggggatataaatggttggaaaggtgaacttatgtatgttacatgttgtagatattcaataaatatatgtcaaattgagttgaactctgaacatgaacttttaaccttgtagtgactccctggattactgtggtccaattcctgtgttctactactgttctagtaagatttgattgaattatagaggcaatagtgggtcattaaaagctggagctttggctgggcacagtggctcacgcccgtaatcccagcactttgggaggccaagtcggacagatcctgaggtcaggagttcaagaccagcctggccaacatggagaaaccccatctctacaaaaatacaagaatttgtcggatgtggtggtgcacatctgtagtcccagctactcgggaggctgaggcagaagagtcgcttgaacccaggaggcggaggttgcagtgagccaagatggctccactacactccagcctgggtgacagagcgagactccatctcaaaataaaaaaaaaaaaaaagctgcaactttgtgtgagagctgagagggatagctatatactataatttgaaaatgcttggttttctgatctctcagtttaaagatagtgggcagagatttcttaatatgcactccttagtatactgtttcaggagatgttaacaggtgtgacctaaaaaaagaaggtcagacccaaataaatttgcgaaacccagcacatgccatctgcttttggagattctcagttgacattaatgtagtaaagcttgtgagcagcttaggcaaaaagaagcttattttgttcaacccatcatttactcaactacaaactatttttttccctacacacctactaacattcactgagccactcactgttccatggaacagcagctttggaattactatggttattattttagaattttggggtgactaaaaacctgcctgtcatcttcttagacaccagtagacctttagaatatgctgatttccctaacccaaactaatacaaatgctttctaagtaagcctgcacctatacccagttcttacaccctatacctttaaacaaaattagcttccaggaaagtgtgactttgagcaagttatacctgtctctttgcctcaatttgcttaatctgcaaaatgagggtatagtattaagttaactctaagggccccatcaagcacagcattttagatgtctgtagatctgggctatacctaaaagataatcatataacagaaaaataaagataaaaatacattatcagtcatgtcaatttattggctatcacgagagacatttcttatgattccagaaacaactgggagtgtgccagagcccacggaagcagttcatgttcaggaatggtctgcaggtggcccatccagaatagcatgaacatggaggccacagcagagtggccaagatagatccgtctctgtcctaggcctttcagagactatgagagtctccaaagccaaatcaattcggggtaccttcagattcatcataatttttttgaaaaatcaagagtagtcacaaagaagcaaactttcactgaattttaaaggcttcttcattttattggccataatactcttaaattgttttagtatttactgtacctattacatttttttgtaataaatattattttcctggtagatccttacatttcctctacctgatatatattaatattttatgctcttgtctcttgtatcaatatatcttctaaagtaaataagttttaaaatgaccaagtacagtaggtagcttggttttttttctccctccatctctccctctttctctccttcattcttgtatttttttttattcgcagtactgtcttgtaatgcaaagaatataggaggagttgcaaggcacaattcctgagttctgtcagtctgctaactcaccatatcttctgggcacttaattttgccctaaaaatttatttgttaaagttgctttagattttctatagtaccttgattatagtcaggtttcccatagctgtggacactgacatactttctactcatttaagtggaactaaactaaaaaacaaaacaaaacacttcctcaccacaatcctctattaaaacaatgaaacattatttggaagtaatgtatacagaaagagtaagttattaatgaaacgctaagtacaacttgttgcatttttcagggtgtgtgtgtgtgtgtgattacctaatttttttactttttaatttcagagttatattcctcaggttgctcattgatttttgcataatttactttctttggctgtttattttattttataacagccatgattctttgtatagaatgcctatgtgagctggtcatttatatctgcttattctaaacgaatctctaaacataaaaatgtttgtgaatcaaatttatatagatttgagacactttaaatgattctgtcatagtatattataagcaatttcattgtgttttcctggggtaaattaggtatgtttatatttttaaaacgaatctctaggattatctgtttactttgtattcttgtaccttttttagaattcttacagtaaaatgtgatttgagctgtgaatgctggggatcagatttcaatttagacatctattgcctcaatgtttgctgtgaggcaatctcttgttttcagtagattgaactttatgctctatcttttagcaaattaagagaaaagggaaaacagaaatcaaatcagaagagtaaatagtcattgaactcctatgatatacagggcacagtgcatgccaggtgcatgaaaaataatgttgttttttagagttgatgaatgtaactcattacatttagcatggctaagcatcatactctgccttgttacttaatcttatacttaaagcagaagttgaataggggactcaggagaagtaaggaaaacaagtagggctataagatttcttttcctttaattttcttaagtttttttcttaactttttatatttaaaagttaaaagtaatacacgccgcctgtttgtttgccctttttttcccctaaagaaagtacaaaataaccacacacataaaatctctaatcctgccatccagagacatacactgtaaaatatgggggtatattctttttgtcttttttcctttgcctttatttattattgtagaattgggatcaattttttacttcataaaatattgtaaactttttttttgttttttttttgtttgtttgtttgagacactctcactctgttgcccaggcaggaatgcagtggcgtgatcttggctctcactgcaggctccacctcccaggttcaagcgattctcgtgcctcagcctcccaagtagctgagattacagaggtgtgtgccaccacacctggctaattttttgtatttttagtatggacaggatttcactatgttggccaggctggtctcaaactcctggcctcaaatgatcccaaagtgctgggattacaggcatgagccaccatgcctgatctgtaaacagtttttatgatccaaagttgttgattttttaatgactgcataatattctaccacctaagtgtatcataatatatttgaccagtcttctagttttaaatgtgtagagtgtttctcgttttgctgtttgttttactatgtcagtattttattatatgactagatctttgtgtctccctgataattctttcaaaataatcccaaaaagtacaagttgtatgtcaaacaatatggatattttaaagtcttttataacatacctatcaataatatgagtgcatattttattgtgtctttgcccaaattgagaattgtgaatttttaaactttttataattttatttaaaaagttattcatcttcattaaaatagaaagaaataggcttttttttgcgatcactagtagcataagtagattactagacacatatctctctccaaataaatgaatagcatcagaatgttcaatcttgatcactttttgtagtcaatttgtacttttttccagatcaacttaatcatacattttgatacctattaatatttcatatgctgcattcaaatggaatttttttcttgcagtataataaaccagggaaaaaatggaaggttatgactcaggaatttattaatcagcacacagtggaacacaaaggaaaacaaatctgtaaatacttcctggaagggaggtgtattaaggtaaatttatagaggtatcataagtcattttaacttccaaaataatctttaaaattaaagtcttttgggggatggttaatttttttctcttctcatatagttgtaataaaactgggtctttaaaatgtatcttgcatggaaataccgtacattagagctcatttaattatgttctgggacaataacataatttgttgaaatcggatttgtttaaaagacacataatgctacgtggcaagtactgttcaaagtacaactaatattaaatgatttaatcctacagtgaccctacaaagtagttaatgttattatccccattttattcatggcaccaagaggttaagtaagttcccatggtagctcagcaagaaatggtgagtgctggttgccaattcaggcagtatcctgtgaggtcttgctcactgtgctgccttaatgcatgtagctacatccactgtcttgggcaggaattctaaggggtcatttgagttattatttgttcattattaaagactgaagataatgaccataattttaccatgagacaccatgtagaaaattcagctgttgtttctttgtttctcattgtttcttacctttttttcttttttcttttttttttttttgtgaatagggagatcagtgtaaatttgatcatgatgcagagttggagaaaagaaaagagatctgcaaattttatttacaaggatattgtaccaaaggagagaactgcatttatatgcataatatcctttatttaaaatgtatgttaaataaaatgctggggttttaaagcatcattgaggttttaaaaaataataaatacaccctataaagcctagtttggttttaaatttaaaacaacacattacataaacccagtctagtcaaactttgtacttcaaaagagcaaactgacctttattctttagggaaatgagataactgccctttggaaaaaattctgtgaagggaaggtactttaatataatcagcttaaagtatttcaagagattgtgcttcctgaaggagtagttggcaaaatacttattttattccataattattttacttaagttcgggagtaaaaaattatcattgtgaagattataagtcttatcaaatcttaccactcaatgatagatgctgtatattcttccccactctcccttgggaaatatatacatttaaattgtattcctgctcctacccaaattggaatttcactatatatagtgttctggtcctttaaaaaaatgtattctgcaatttttccatgttaattttcccccaaatatctgtcaggttgctcactacgacttatgactaatgaagctttcccccacagaattgaaactctatcacagacaaaatgtttacatatatggatttttcttctggacttcgtgtttggctccatggatttgttcaccctcatgtctgtcttgctttgctgtgattatttctgccacaacagccacggtaatatttggtagattctgatgtttatttttccagataaatttttaaattctgttgtcgtgtttaaaaaatgtgaaaaaaaagaaagtgaataaaatgaaaaatgcctgttatcatagatcaaaatgtcaaaaaatggaacgatgtaattaccagaggaatacatgatgaattggaacagaaaaatttcctgtctcaaaatccagaagcaaaaagggaacagattgaaattttgactccatgaaaaagcttgcatttgcaaaacaaatacatataacatgagctaaataataagataaataatgaagtgagaaagattatgtgtaatttatatcacttacgaagaggtcatatccttaatatatgagtttctaaacattgagaagaaaaatgagggaagagatacagataattcccagaaagagaaatgcaaatggtcccaaaacatacagaaagatgttcaatcttgttcctaataaggggaatgtaatttaagctacactgagataacatttgcagctgtgtcacgtttgcaaaaataaaaaaatcgtgacagtgaagtttgttagcaaggatgtgagaagaccttgatgctggcaatgtcaaaatggtgcattcctatggaggagagcttggtaaatgcaatatgcatttaccctttgacccagcaatcccacgttttgcagtttctccacaatagacctgggcagtgattactgatggctgctaaaatcatgaggtgaaaagttaattaggaactttacaactgatggatggagctgacaacacctgaaaggactgatcagtcttaacattactaaaaagaaacaaccagatattaaatgccttttgatatgatacagtagagagtatttgaataccatctatgaccaatattaaaattaacaaatgatacaaaaataaaagggaaaggggaacttctagaaatcagtaaaagtaacttgggagatgtattaactagatacaatttgtggatcatctttatgtcctgatctgaagaaaggaattataaaaacatacttttttaaaagtctggaaaatttgtatattgactggttactagttgaaattaacacattaattttgccagggtggtaatgaagtcgtgattggtaagaaaaagtattcctggccaggcatggtaggtcacacctgtaatcctaacactgggatgctggggtgggaggattgattgaggccaggagttggagaccagcctgggtaacatagtgagacacctcccccactcccataactaatttaaagaggaaaggggccaggcacggtggctcatgcctgtaatcccaccactttcggaggccaaggcgggtggatcacctgaggtgaggagttcaagaccaacctggccaacatagtgaaaccccatctctactaaaaatacacaaattagttgggcatggtagcgtgcacctgtaatcccagctacttgggaagctgaggcaggagaatcgcttgaacctgggaggtggaggttgcagtgagccaagatggtgccactgcactccagcctgagcaacagagcaagactctgtctcaaaaaaaaaaaggaaagaaacaatagtccttatgttgagaataggtatggaaatatttacaacaaatgatgaaagttgttgaacctatgaggtcaacatgagagggacttcattttattattctctctactttggtatggttaatgaccttcaaacaaacttagaaaaaaaatcctaagtaatgtcatcctacagagaaccatacttggagtatggcataaagcctttcagactttttttctatgctggtatgtatgtatgaatggatgtgtatatgtttatacacataattttttatttttgtgagacggagtttcacttttgttgcccaggctggagtccaatggcgcgttctccgctcactgcaacctctgcctcccgggttcaagcaattctcctgcctcagcctcccgagtagctgggattacaggcatgcaccaccacgcctggctaatttttgtatttttagtagagatgttgtttctccatgttgatcagactggtctcaatctcccgacctcaggtgatccgcctgcctcggcctcccaaagtgctgggattataggcgtgagccactgggcccagcctatacacataattttttagaaaaatgaaatctataatgattgtgaatattgtatttttaaatttaacatttacattaatatggactgtattttaatacacagtgtgttaataaggacctttattcagatgattaactcattgtcttatctttactgatttaaaatggcatcttcaccagaccctaaattctcatttgtacacagttctgcttctatactactcttatctattgtggtatttgattattcacctctgtaagagtatgtttgatatttggtaaggcaaatactccttcctttttaaaaaaaatgttgtaatagtctcaggtcagaagtgatttggcaaataataaaaacaaataaaatgtaatgaatttgtcctattcaagaaaaataaattttttcagatttgacatatttctttagaaagcaaatactttattctgtttctgaaagctttccatctattcttatggggtttttgttatatagtcatgctgtttgtaaataataataattttacttcatttacaatatttatacctcttatttaattttaattgtattggccacatttccagaagaatgttaaataatagtgactgtggcagacataaaacatgttttaatgatagtgcctttttgttttagcttgtggctgcagttttaaagtaagttttaaaaaatcaattaagaaagtatatttttattttactaagaggatttttttaaacctaaaaaagaaatctaaaaaagattttgaattttatcagttgccttttgcatctgccaaaatgatcatataatttttttcttgaccttatcagtgtttacaataataaatttcctaaaaccatccagctattccctgaacatacatcacctgagagtggtatatttttcactatacttctagatttaatattttctttatacgtttgtctccaaaatcctaagattagtctgtagttgattattgggatatttgcctttaacatgacatattaagcctcttaattttctttataaatataagctcttgctacaaaatttatataatattttattttattgtgaaaagtaacagagcttatgtaattaaaatataatagtgtttgctataatagtgataaatgttttttttcctttaaaaagtggctttctagttttaatagagaaaaaagctgtttgaatgtttttgtataattaaaatatctaaccttaatagaattaaaaataagctgatgtgattatagtaaattcagtataatatataataatacagccttattgattcagcacagttgtggttttgtgtgtgtgtgtgtgttaagaacacttagcatgagttctactcccttaacaaaattttaagtatacaatacagtattgttgactataggtacaatgttacatagcagatctctagaacttaactatcttgtctaacagttgtaggttttggtttaaaaaaaaattagaccttgattttacttggtcttttccttaatatttttatttacatgaatttccatgcaagttctatcatagtggagcaaaatgttaccagggagacaactgtaaattttcccatgatgatctaactaaagaaacaaagaaacttttggacaaagtgagtaatatttttgtaccttgattatgtctctccacaaatacatttgacttgaatcatattttataagtgatattttatgaaactgctgagaaattgaaagtttactattttatattttattctatttgagcaatattctttacctttttgaacctcattctgtttataaaaaatgaggagttagctatctccaaaccatttcaacttttttttttctttctctcccccttccctccttcccgtcttccctccttccctccttccctccttccctccttccttcctccctccctccctcttgcttgcttgctttttctttcttatttctctctctctctctctgtctcttttcttttcttttcttttggcaaggtctcgctgtgttgtccaggctgggtgtagtggcgtgatcttagctcagcttactgcaacctccacaccctgctccttgccaaccccctgccctgcaccgccccccacccctgcccctggggtcatcctcccacctcaaccttctgaggtgggcactaccatgcccagctaatttttgcattttttgtagagacaggggtttctccgtgttgcttgggctggtctcttgggctcaagcgatccagctgccttggccttccaaggtgttgagattaaaggcgtgagccactgcgaccagcccatttcaactttaatattatttttctactaaccaaacttaagtcttctagttttaaatgtgaggaaaagactcgctttgaaatagtaatctttgccaattatttttaggtgttgaatactgatgaagaactcataaatgaagatgaaagagaattagaggaacttagaaagcgtggcataactcctcttcccaaaccacctccaggggttgggcttctgccaacccctccagagcattttcccttttctgatcctgaagacgattttcagacagatttctctgatgattttaggaaaattccatctctttttgaaatagttgtaaaacctactgtggatttagcgcataaaattgggaggaagtaagtgaaaaactttcaaaatgacatcaaatatttttttctgaaaattatcattaagaaactaagtcatactccaagctaatcatgtaattaaacttggttagagatagcacatatctggcatgcacgcagattgttgcttccacctttgttttcggttcccacctgctgcttgccatcagtgctttcccatatggaatccttatacagcttctgaaacttctcagcatagtaatcctgaagaaccctgcctggtgggtggatttggcattttcacttgattatgaggctgcattgtcattgataatgccttcagattgtgggaaataggtctccacatatttgattattttgaagagcaattccttaggctattggcggaagacctctggatccagattttcattttctaacaccaccatttcagccctgctgccagtccccaagcgtctgtgcacctgggccctaagtcacattgttgagcattcgtttagtcctgacaactcaggaaagcaaggaggtctcagccaatgaggaacaagaaatctatagcaaatatcacaattcatttgaaccattaaaagtatttctactaatgtcaggaagataagtatgtccactattttggtaatattatatattgtatcctggtcaatgaaataagagaaataaaagttataaagattagaagtggagtggcagcctaattatttgggaagtttccctcaacccaaaggaatcaacagacaaaactattggaaataataattaaattagcaagatgtcaggaaagaagagcaacattcaaaaactgaatgtctttttatatgccagcaataaccaattacaaattattataaaaagttggatgtttatatagtagattctaattttactgtaaaaggttatatatgcctgaaaaagaggactagtaggagagaaccaataaaattttatctctgggtagtgggattaggggtgattcttatttatctttgtacttttctgtgtttttcaaaacagtaagttttagaacagctaacggtaagcagcaagtgggctaaaatgaaagcatgaggtctatttcgtgtttctacctatcgacgctatggaacaaattgcttcttaaacacacagtattctattctgatgtaaaaaaagtacttaaccaatatctgtttagaagtgttaacattcttgtttgtttctttttctttgaactaagaaatattattatttctgtctacaggccaccagcattttataccagtgcctcaccaccaggaccacaatttcagggaagcagtccacaccctcaacatatctatagttctgggtcaagtccaggtcctggacctaacatgtctcagggacacagtagtcctgtgatgcacccaggctcccctggacatcacccatgtgcaggacctcctggtctaccagtgccacagagcccacctttaccacctggtccacctgaaattgtaggtcctcaaaatcaagctggagtgcttgttcaaccagacacatctttgacaccaccaagtatgggtggggcttaccactccccaggctttccaggacatgtgatgaaagtacccagagagaatcactgttctccaggttcatcataccagcaaagtcctggtgaaatgcagctcaacaccaattatgagtccctgcaaaacccagctgagttttacgataattactatgcacagcattctatacataattttcagccacccaataactctggtggtaagtttacttttttgaaataatttattcctaatttaaaatacagtcctatttttcattaaaagcatgacagaaacgtaagttttaagtaaagctgagtaaaattgataagattgaaaccttaaaatgttttcagtttgccaaacttttgaaacaatagaattttagataacttttagaaatattttaaatgatataatttgataatccagtgtgcctgtgatgaaagctttcatttcttatgactggtgaagttttgtgctcactcaatgactgtctctccccatgttatacatgtagatgggatgtggcatggtgaatttgcccagcagcagcctcctgttgttcaagactcacctaaccatgggagtgggtctgatggcagcagcactaggacaggccatggccctctgcctgtaccaggcctcctccctgcagtgcaaagagctctttttgtaagacttactcagagataccaagaagatgaagaacaaaccagcacccaacctcatagggcaccaagcaaggaagaaggtgtgtcagaagttattaatagcatcttacctatttggatgggttaaaatttttaaatggccgaggcaggtgaatcacctgaggtcaggagttcgagaccaacctggccaacatggtgaaaccccatctctactaaaaatgcaaaaattaggtggtcgtgttggcatgtgcctgtagtaccagctactctggagcttgaggcaggagaatcgcttcaacttgggaggcagaggttgcagtgagactaggcaacagagtgagactcagtctcaaaaaaaaaaggattaaaaatgagctctgtcttctatttccaatgtatttcatagccactatcttgtgattgattgtggtttcagtgccattaattgcattaatacttaattgctaaaggtttgacttgaagcagtgaaaagatctgaagctagagttcaaggttgtgcagacttgcaagtaattaagccttttgctttttttttctgaagaaaataaatagaacaggaaaaggacaactttcagtttaaggattttgaattctagcccaatttcaaaatgattcagttattagagatatttttatgtcataggctctataattaaggatctgctataataagaaatatttttaaatataaaaagattatatggaaactaagtttatcttagtatttttgatactggtaagtatacaacagttagttaattcagtaaaggatgagaaaagtttaaagcatccagttctgtttatgaattacaaaactgatgtttggccactcttaaacatgacatttatgaaaaactatgtaaaactatgtaacgctaggtagctgcaagctattatatgagcatttaaaatatatatatttataatttttaaattatttttgtgggtacgtagtaggtatatatatttatggagtacatgaggtattttgatagaggcatgcaatgcataataatcacatcagggtaaatagagtatccaccaccttaagcatttatcctctgtgttacaaacaatccaggtatactcttttagtttttttttaaatgtacaattaaattattattgactatagtcaccctgttgtgctatcaaatactaggtcttattcattcttttaaacttttggtacccattaaccgtccccacttcctccctatctgccagctacccttcccagtctctggtaaccatccttctactctctatgtccatgagttcaattgttttaatttttagctcccacaaataagtgagaatatgagaagtttgtctttctgtgcctggcttatttcacttaacataatgacctccagttccctgttgttgcaaatgacaggatctcattcttcttatggctgaatagtactccattgtgtatatatgccacattttctttatccattgtctgttttttgttttgttttgttttaagacagagtctcactctgttacccaggctgggattcagtgacacgatctcggctcactgcaacctctccctcccaggttcaagcaattctcgtgcctctgcctcccgagtagctgggattacaggtgtgcaccaccatgcccagctaatttttatatttttagtagagatggggtttcactgtgttggccacgcttgtcacgaactcctgacctcaggtgatctgcccgcctcggcctcccaaagtgctgggattacaggtgtgcgccaccgtgcctggccattgtctgttggtggacacttaggttgcttccaaatcttggttattgtgaataatgctgcagtaaatgtgagagtacagatatctctttgatatactgatttcctgtcttttgggtatatacctggcagtgggattgctggatcagatggtaactttatttttagttttttgaggaactttcaaactgttcttcatagtggtcgtactaatttactttcccaccaacggtgtatgaaggttctctttcctccacatccttgcctgcatttgttatttcctgtcttttggataagacccattttaactggggtgagatgatatcttactgtagttttgatttgcatttttctgatgatgagtgatgttgtgcaccttttcatatccctgtgtgccatttttatgtcttcttttgagaaatgtctattcagatatttcgcccatttttaaattggattattgattttttcctatagagttgtttgagctccttatatattctagttattaatcccttctcagataggtagtttgcagatattttctcccattctgtggattgtctcatcatttgtttccttcacaatgcagctttttaacttgatgtgatcccatttgtccatttttgcttggttgcctacgcttgtgaggtattacttaagaaatctttgcccagaccagtgacctggagagtttacccaatgttttctggtagcagtttcatagtttgaggtcttagatttaagtatttaatccattttgatttgatttttgtgtatggtgagagataggggtctagttttactcttctgcatatggatatccagtttttcccagcaccatttattgacgagattgtcctttccccgatgtatgtttttagcacctttgtcaaaatgggttcactgtagatgtatgggtttctttctgggttctctgttctgttccattggtctatgtgtctgttttttgttagttcatttttttgtttttgtttttgttttttcttaagacagggtgtcactctgttgtacagtggtgcgatctcggctcaccacaacctctgcctcctaggttcatgccattctcctgcctcagcctcccaagtaggtgggactacagatgtgcgccaccatgcacagataatttttttgtatttttagtagagacacggttttaccacgttggccaggttggtctcaaatgcctggcctcaagtgatctgcctgcgttggcctcccaaagtgctgggattacaggtgtgagccactgtgcccagcttatgtgtctgtttttatggaggtaccatgctgttttgattactatagctctctagtataatttgaccaggtaatgtgattcctctagttttgttctttttgctcaggataggtttggctattctgagtcctttgtggttccatataaattttaggatagttttttctatatctgtgaagaacactattggtattttgattggaactgcattgaatctgtagattgctttgggtagtatggacattttaacaatattgattcttccaatccatgaacatggaatatctttccaatttttggtgtcctcttcagtttcttgcatcaatgtaagtgaacattttttgttacattttcaaagaagatattattaattcttcatttacctaacatcacaggagaatgaaggattcctaataagtgaatttcctgtacaatttcaattataagcattttaatagcaatctttcagccgggcgcagtggctcacgcctgtaatcccagcactttgggaggccaaggcgggtagatcacgaggtcaagagatcgagaccatcctggccaacatggtgaaaccttgtctctactaaaaatgtaaaaattagctgggcatgttagtgcatgtctgtagtcccagctactcagaaggctgaggcaggagaatcgcttgaacccaggaggcggaggttgcagtgagccgagatcatgccattgcactccagcctgggtaacagagcgagactctgtctcaaaaaaaaaaaaaaaaagtaatctttcgatagtcttaaaagttttatgttttcataaacaaagatattaaaacttttagataatagaaaattttattctataatgttatataattggtagtgttctatgggagttgttggctctgatacagaaatattttgaacagctaggtttacttgtgtttgtgttaatttttatggattttaatgcttttatgcattttatctctgctttgataaaagctgctaattatcattttttatctaatatctgttttccaccagcctgtctctattcttctactctccctctgttactattttcactctcatttaagaaagattttaagtatgctttataaatcatgaaatatatatataatgcttataaaatatattgatatgggaatgaaaagaaagtaaggatagaagtaacaaatactatgaggagtgaaattactatacagaaatatttaaagtaattgcagcaggtaaaagtgaatcacaaatccatctgtagatttccttgatgtcaaagagaagaaaagagatctagtgtctagaagtagttttttcagatattgagatctgagtaaaactttttgcaattgtgacataccatatgctgttttaatccacattctaccctaaataccaatgcttgttttgtaagcactgctttgttcaaactaaccctgtaacactaaagttccatgtagtaggcatgcattagtgagcagtgagatgaggtaaaaatgagaatatctaggatagtctgctgatccaagatactccaggatggagatacatatatgcatatacagtatatctatacatctgtattccatgttctgactcttacgttctggcaagaatgtgaacagtagataccttgtggccaattcagagccaacctgtgtatattttaatggagaggagggagaatcacccttctgaaacatcagtttgtaattccttctgctagagaaaagacttacgataggtaggcttctttaggtaggcttcttaaacttgcatctaatatgctagagttaaataggctttaagagtaagactcaaagtgttctcataaagtatgtaagttttaggatggtaggtttttttttttttttgagatggagtcttgctctgtcgcccaggctggagtgcagtggctagatctcagctcactgcgagctccgcctcccaggttcacgccattctcctgcctcagcctcctgagtagctgggactacatgtgcccgccaccgtgcacggctaatttttttgtatttttagtagagacggggtttcaccgagttagccaggatggtctcgatctcatgacctcgtgatccgcccacctcggcctcccaaagtgctggaattacaggtgtgagccaccacgcccagccagttttgttatttttaaagttaatgtttgaatagctaatatagtcacacaggtcaaatatctaaacatataataaagagtaaatgaaaagtctctaccccattcctcatttgctcagtttccattgctaccttaaccatcactttcagtgttttgttttctttttagtccattgttaacttgataaattcagagctaggaagcttaaggaatgcttgatttgaagagacctagcatattttagaatgctaacagcattttcctttctcctacagcccaccacacatacaacacacatatctgaattccctttggccagttggaaggaaaggtcctgccttttctctgactggaaggacattacacatattctagtatcaccccacttccttaatagagtataatgactgaatcgatagttttcttaccacatcttattttgttccagtattgaaatctggcatttttgttatgcattttcttgaagttagattatacttatttcagaaatagtatgtgttttttaatattaattaaggctacatataaatgtagccatattataaagaataatttataattataatataataattttattatattataagtttataatataaagtttataataagtttttgtctgcatttagatgatacagttaactggtattccagtagtgaagaggaagaaggaagcagtgtcaaatcaatactgaaaacattacagaaacaaacagaaactttaaggaatcagcaacaaccttccacagaactcagcactcctactgatccaagacttgctaaagagaaaagtaaaggaaaccaagtggttgaccctaggcttaggactatcccaaggcaagacattagaaagccttctgagtctgccccactggatcttagacttgcgtgggatcccaggaaattgagagggaatggaagtggtcacataggctcttctgttggtggagcaaagtttgatttgcatcatgcaaatgctggcactaatgtcaaacacaaaagaggcgatgatgatgatgaagatacagaaagagaactgagagaaaaagctttcttaatacctttggatgcctcacctggcataatgctccaggatccaaggtcacaattgagacagttcagtcacattaaaatggacattactctaaccaaacccaactttgcaaaacacatcgtgtgggctcccgaagacttacttccagtacctttacctaaacctgatccagtgtcttcaatcaatttacctctgcccccacttatagctgaccagaggctaaatagattatggaatacaaaaagtgatcttcatcaaaatacagtgtccattgatccaaaattagcagccaaagccaaaattaacacaacaaacagagaaggctacctagaacaatttggagactcacacggttcaggagctaaattaggagatcctagactacaaaaaaattttgatcctaggcttcacagactgcccaatacagagtctcatcaagtggttatgaaggattcacatgcatcaaagggtgcccctcacttacccagatcaaaccctggttcatcacagccctcaggggcaggaactagcaattctggttccggggctctgcctccatatgcccctaaactctcttcctcagctggccttccactgggaacttccacttcagttcttagtggtattagtttgtatgaccctagggatcacggttcatcatccacatcagagctagcaacagcttcttcaggagaaaactcaaagaaccagaaaaaaagtggtggcttaaaaagtagtgacaaaactgaaccttctcctggagaagccatccttccacaaaaacccagtccaaacgtgggagtcactcttgaggggccagctgacccacaggcggacgttcccaggagttctggtaaggttcaggtcccagcagtgcacagccttcctgttcaggcattaacaggcttaattaggccacagtacagtgatccaaggcaggcaaggcagccaggacaggggagcccgaccccagataatgatcccggtagagaaacagatgacaaatctctgaaagaggtttttaaaacttttgatccaactgcttcaccattttgttagctattgtgtaactgagcaattcttttcactcttgtgactatctcagtcctctgctgttttgtaactggtttacctctatagtttatttatttttaaattataaacacttttcagctgctagtatcagaaccacatgaagttatagcctctaaagcctgtggtattttatataatatttttataactttaagagactgtagtaattgacctaaaaacttatgttagcttcagtaaaagtacttttattgtaaataaacaatcatgaactcaacactctgcctgaatatatgccagttgtctttcataatcaatgtttagataaatgattgccactttttatatggttgtttagtttcaagcaatatgatgtacattacttttgagaaacagtattttgactaggacctctcttatttgtcagcacagaactgattaatatgtaatgctacctgctaattaaaatgtaaaatcaagtaaagaaaacattttaaaattacaattagcagagcagttcatgtttaagggcatcacttttattagtattggcaatattatttgtgtaaatgaagcatttgaatgtcatatctttttaaagtattttattgtatactgtatcatagaagttggaggtatataaatagaacattttgctaaagtgaaaaatttccaagttctctagcataactttttacatttaatttttcatatgaaatagcaattagttactgctgtgttacattgtgatgtttatgtatgtcaatgtttttgtctttaacagcataatttatattgctttttcaaatgatgtagctgcattaattgtgttcatcatgactttggcgatttttaacaaaatttttaaagacccagtgagagtctgtagtgattattacacggataatgttttaaatgtctaggttctgtatttttttcttaaatagcaagaaaatacagattgctagtatagtcaacagtatttggctatcaataaagaatctctttaagatctcacccggctggcattctgtaacagaggggattacctggtgttttaagtatttaatgtcctcatagtgtggaaatcccctaaattgattagaaattgtattttatgaaaaataacttgtattcattcttgtgtatttattacaatatataaataatggcaactctttgttttatacatatataatttataactgaatctaagtattagactgctactcatattttgaactgcaggtgtaggacagtgtttgctggtaacaactccaatgtgtattaataacttgaaaaggagcatttcactataaaagataatgaagtaggtaatgaaatcagtccttgaatgaaagcagtgcccttgagaagggatttttttttaaatatacagtaaaatatttcgtgggaacctaacactcacatagcatatggtttattaataatgcatatcctttctaatcacttcttcaattctttttgctgcagttctgtgctaaaatggggttgtggttaagtgaacgagaactctgcctacctaagaagttcattgtgttctaagtggaaggagagttactgaagggaatgtgaatttttaccgtttgtacttaagatacatttgttgtctaaaatggctctggataacatttttgggttaaaaaatgtaatttaaagccaccatagaaagtattttctgatttactgtccaaatgaattttgttgttaattgagaagtcaataaaatggattaaactgacagaaaaaaaacatatatatatatcccaaggtgtaatttactcttttgtcaggataaaatcagaaaaatggctgattttagtaaatgaaatttttagcaaatctttcattcatgtagtttataattattgtgtcaagcagtgctgtttacattttaagcatcatacaaaaaagataatttggcttgctaaacatcaaaatagaatccaaactcttaaccgaatatcttttttacaactaaaagagatattccaagatttattaaagagtcaggtttaaaagttattaatgcaaattatgtaatgttcatttattcagtattcttgagtccctgttacctcaattggtgttctagaggctattttacaagaaagtttgaacttagtttcaaatttgacaatatattttatatgaaaatgtttatgtttaaaataacttatttattatgcagcatttttattgtgataacgttagtttatgggatattctgtcatatcctgtaaacatagtttatttttcttcttttttcccattttctcatacaaattgaataagtagccattttcccccaatgaatacctcttcttttaggtcaattggtgtttttagaatccatgtaatttgatttgcactgttagattgaaaagtaagttacgttcctgttcttagaagccacacatttagagataacagaaataacttgagtcttaagagtatggataggctcatccaatgagatgtaacttagctattcatactgtttgtgatggaaattctatacctgtttactgtgatgatgaatacagtggatatagcagggggttgaaatggaacacacagaagatcatgacaattgagattcagcaactgctgtctcatatcttggttaagacctcattgtgaaccttgaacacaaatcagatgttggagtgatttcaaactctatttcaacaattgggtctgtttctatatggaccctctatttcccagctgaatgtttcaaacccccaaattaggctgcaaccgaaagagcctaattgtgaaatgatgtgcgcttatgtttctgtttatcctttagccatggaactttaaagagtagtgttcctcctacttactttaagctggaagaagagttgagtagtaaatcctgtgtgaacttttagctcagctactctgctgaattaattagaggtaggaaggacttacaagggctggaagtttaaagagaataaattcatattttttgttctgaattgatttctgtgtaatttatatcagtatctagttgcttatctgtgaaattgggttaatttttattgatcacatttgatgtaaagaatgaattatttttgtaaagtatttgtaaatataaaattgctttataacttgaatgaacataatcattatgctcccattagggtgcattaagttgtacaaattccaaaataacatggtatggtttgtatggtttagcaattttacgaagcttcagatgacatgcactggtgacacaacagtagaatttcctgagaggttgagtgaatattaacccatcaagttagcaatttccttaactacatgagtatcaggaagacaggacttccctgccttagagctatatagacttgggcctcttcaagatctgacttctctgcacattctatacaggttggatattgatggagggttaaaaatgctatgacagttcatggtgcatggtgtgtttgtttaaatcatagcatgtttaggcaaagtggccagctcattcaatataagagccaccagctcttagaaacaacagatatattcacacccagtctgtaatatgtatttcttcaggcatgtcacactgcggtcttcctgaaagactacttacttcataaaggtattatgtttctttaattaatggccactagaagttaggaagctcctagggaccaggatatgagatcttaaagaggctgtcagaatctcttcatttgcatgacatagaatctgtggtggagatgttttccctgatgtttttggagggttggactgtgttgaaggctgtaccttggtgggggtggtctgcagtcatgcagtccactgatagggtcccccaccccgcaagcttcaataattgagctttctgttaatttcttgaattatcttttcaaaaatggtttggcagcacttgatgacattatgttcaaaattaagtccagtaaaatatataagcatttgtaaactataattatagtttaaataagacttagtttaggaaatccaagttttgacatatataaccaaacggcctaagagttcaaagctattttcttaggtgttacaccttagcatttacataatgccttctccccaagcagtttcatgtggtttgcagaaagttttggcagctaccagtcactatattgctggagttttgtgtttgagtatgtcatttatgtcatttatcagcagtatctgccagttgtgacaaagccctccctattatcctgcctttcctggaaaggatacagacccaagaaaagttaacatctacatagtacttagaatttctaattttaaaataagaaacaaaaagcacatttaaaataatattttatgcttttggagacaggacccacatgtatctccttatttttatacttgccatagaaacaagcctagttgtaggcctacagtgggtgctttgttaactgcttgttgatggcttcctgacatccatccaaatgtcacttttacagatgctgtcacccgttaaacaggtgtggcagaagtattccatgactgcattaggaagaatgcaccttatgggttatatctcttttggtagacagcccacctgctcttttttgtccccaccctcagcccaagcaatgtgaagacagattatggcaacttaggagctccatgtttccataataattcataactttaagagtcctccagacttacaagattacttcatggtgaaagtttggattgatcaataatttattcctataaaggtctgcaggattttttctgtaaccagaaaagtaactgcatagccattctttttttttttttttaatttgttgttgtttttgtttgagacagagtcttcattcttgttgcccaggctggagtgtaatggtgcaatctcggatcactgcaacctctgcctcccaggttcaagtgattctcctgcctcagactcccaagtagctgggcttacaggcacgtgccaccacacccagctaatttattgtatttactagagacggggtttcaccatgttgatcaggctgatcttgaactcctgaccccaggtgatccacccgcctcaacctccaaaagtgttggggttacaggcgtgagccaccgtgctcagcctgttttttatttatttttttgagacagtctcactttgtcgctcaggctgaagtgcagtggcgctatcagctcacagcagcctccgcctcccaggttcaagcaattctcccaccttagcttcctgagtagctggaactacaggtgtgtgccaccacacccagctaatttttgtatttttttggtagagacagggtttgaccatgttggccaagctgatcttgaactcctggcctcaagtgatccaccagtcttggcctctcaaagtgctgggatcacaggcatgagccaccacgcctggcccagtctttttttttaattattatttatttttatttatttattttttgagacggagtcttgctctgttgcccaggctggagtgtagtggcatgatcttggctcactgcaacctctgcctctgggttcaagcaattctcctgcctcagccttctgagtagctgggattataggcatgcgccaccacaaccagctaattttttatatttttggtagagacacagtttcatcatgttggcccggctggtctcaaactccttacctcaagtgatctgcccgcctcagcctcccaaagtgctgggattacaggcgtgagccactgtgcctggccagtcttttattttaaaataaatacttagtcctaacctagtgaattatcaatagcatttaaaattccttctatcctgataccatgaacagtaattttcccttttaagttatgatttgactctaattttgggtcttgtatctggtctttaaacacctttcgttaccctttggaatagaacaatcatgctactgttagcaaaattattgtaggcataaggaagagctgtgagttcaaagaagattgtgagttcttggaatagtattttacagcgttgtttattcttgaccttcttgttttttaagcttagagtttataagaaaaaagtgaatatatagctaattatagcattttagaaaaaattagctctgcagatagtcaggccccatacttcttggctcattactgattttaataccttcatgagagtattaaggttgaaaggaatggtgaaatttgcattatcagaggtctgatatgtaatttattgtaaagaaattaaatatatagaggctcaattaaaaaataaccatattctcaaacctccattaccactaatatcttggggttgtcaatgatagactatatatatatgtatgtatatgtgtgtatatatatatatatatatatatatatatatatatatatatatatatatatatatataattttttttttttgagacggagtcttgctctgtcacccaggctggagtacagctcacagcaacctctgcctcccaggttcaagcaattctgcctcagcctcccgagtagctggaattacagacgcctgccaccacacccagctaatttttcgtattttttagtagagatggggtttcaccatgttggccaggctgatttcgaactcctgacctcaaatgatccaccgacctgagcctcccaaagtgctggccttacaggcatgagccaccacacctggcctagactataccttttatacactttttaaatagagaaagtgaaaaatgataaactaaccattataaaatagaggtttgagtccacctgtattttacagaaatttgccctcaaatgtttgagagggaagtcacatatgatagaaaaatatcttttcaagggtagaatgatatttccttataaaagtgacaatcaaaaaagactcatttgtatacttgccaaagtttaaaagttttttacattccttaccctaaacccactgccccatccacccagaattcagaaagggtttggcatagatccagggctccagggcccaggtcattttgttattagtctagggcttttgtcctccacagtctaggcagggcatctttgtatgtgtgttgctggttggggccagggacgggggcaggcgggagttgtccaggtttaagattgtttgttttccatcagatccacaagcaatatctgtgggctgaaatccaggttatacctattcactatgactttttttttttttaactttctactgtaattatttcagttccccgaagttgtatctcaaatgttggggaaatgctgccttgactattttactttggaaggttttactagatatcagtttagtagattaatgacgttgttaatctgtctgctcaaaagacaccagcaagggggtatactttgctgaactgataaattattctattaaggactaacccagtacttggcaaaattaggaataacttttcccctccttctttactaataaattttccaagttgcatactgttgttgcaagtttctgtaatttttttctgtatacctttctattgtctgaatttaaataaaaatgtttctaataatatc

SEQ ID NO: 1359 - DNA, 265490 bp, Homo sapiens
ttaaactctaagtattttattaaaaacaaagatattcaggtctcttaaagcgggcttccaaaactatggattagttgcttgtgaaatggccaacctgtctataatgtaatattcttacaatgaaacatcagtctgggaaatctacacaaagtgaatgatttcaaacaactcaattgaaaacgtatttcctttctttcgtgtaaaacaataataattaggaaggaagtcagtaggagatcctttttaggttattgtacatgaaaataaaatggcaaaagcaatttccccccaagggaatgagactcaacaaaacttagcctcctatttccaatgttatttttaaaatttcatctaaatatgtcttaatctaaactagagtaaaagaaaaattgagattcgaatacacacgcatatacacacagaaaatgaacacagatataaacggtggcacaaataatacatttttcacagcaaatacttcattacttaataaaaaaacacatttgtgtactagcgtatacaaaaatgacattggtgtagttatgttatacagataaacaatttatctttagcagtgaggagagaggtaccaaacatgcaagaacattcaaaattaaatttaaaaaagtacaaccccaaattactagctgaagacaaggtcatgacaaacagtgtcagcatgacattgggcattgctaaatctaaatgctcatcatgaaattctccagatacacctcattttatttctgccctctatatgttttattctattattcttcacttaggaagctggtgcaattttggccttcttgtagtcagacttaacctttacatttcctgatacatttgagttttgggagttctttacagcatgtagcagaataacaatttcagagactgttactctgaagcagataatgaaacttcattacagtggcattgccagagtttttagggtcccaaattaggttttgttctgttgctttaatgaatcctttttgtgttttggtggtttttttttttttcagccaaggcatttttctttatatttaaatctttccctagtatgtctaggtttctgtcccactggaaggaaattgtttcacactattactggagatgaaactggtttttgtctttctgcaatttctaagagtcagcaggaaaaatagattttaaaataattttactgcagaataaattgggcagattctgtttaattacctagtgttaagtggaaaaagttatgataaattttgatacacagaaaaagcaactggattctggcagcattaatattagataatattgttattacactaacacaaaatgttaaagatgatttctaacccaatgtatttgcaaatatacaatacctggaaatgcatagacatctcagattttagaaacaaaatgcatgtgcaattttaacttctcttaactttataaattcacttctaaattaatgactaccatttatgggatatgtgtgatatcagataatctaaaattgttttttatgaaataaaaggacatataaggtgggtgtggtggttcatatctctaaccctaacactttgggaggccaaggcaggaggattgcttgagcccaggagttcgagaccagtgtggtcagcatagtgaggcctcgtctttacaaacaatacaaaatttagctgggtgtggtggtgcacacctgtggtcccagctactcatgaggctgaggcaggaaagatcacttaagttggagaggtcaaggctgcagtggctgtgattgtgccactgccctccagcctgggtgacagagcaagaccctgtctcaaaaaaaggacatatctttttttaaattgtattgatgactacatctttcatcataattagagacaggctcaagatacatctgtagtatgattgtgcttacatctaccccatatatgtaagttttattatgtctttattaagaagatgactgctttaggtttgttgctattttatttgagaagaataaaaaagaaaattatctggaaaatttctttaaagctaaacacgtcttggtcctttggtgtggggactgaataaaagtcagtgcttttatgtaatagatggagattctaagacttggagagtcctaagattacaggttcagctggtggccaagctaggagggagttccagtctgctatgcactgaatggcaccctttgcagtatgtgaagctgtccctacccaccaggattgccactacattgtagattgtgcacataatagctacatagtgactagtaagaataaatatgtctgaaaaaaatacatctcatcgaaaaagtaggatgaagttatttcaacaattaatgccaagagacctgaggaagcaaacataatctggtcagtttgagtttttacaagaaggctcatatttcaaatgtctttctccaataggaaataaacattaataataaggactgggaaacttcctttctcttttttggaaaagcagattatatggataactgcatatgcctcacattcttgcaaaattataaattgtttagaaaagggattaaaaacgcctgaaacccgcaagagttcaacctctaacctctggggttgttggcaccaggaagctgctaccttcctgtccactgcttcatagtcatggagacacagacccatggcattagtcagcagtttctaaatcttgacccacaataggaaagatacctcaagacaggagaaatagatggaggcaattacaaacagctactagattgatggttgacattgtcagggctccactgtatggcagattgcaatggtgttgaactccccttgctaccagtggatgttgctattggcaaccatgcagtgaagccaataaaacggcaagaaaatgagaggaaaactcaaccttagtggaagcttgtagggtttatgctataaattatgttccccttagcaatatgtagcatcaatgttcaggatagctacagtgctcacggcagcctgcagtctctgtcagaccctgggtccagttttgtcataaagcacatgctttaaaatgttgctgtagatggactggcatccatttgtctgggctatttatttatttattgttggggaggataacagatgtgggctcatctctgcctcacacagactgattttcaattcccgttcgtgatataaacatgatgtggcacattacccagaaacacctgcagtgcttcggagctgcagacacgtcacgatctcgcagaccagactctgtccctgactccacccaccctttgttccccacctgaaggaggagagacagccctgcagaagctattttcctttatagcagagtgatacagaaaactggcttaataaaatccataaatctgaacaacctcctcttacctgctctgcagaggcagtttcttcctgcattcatttccccctctactttctccagtcttccctgcagagacagctgtaaagggtagctaggaacattattttttagggctctcactccttccttctcccctttctcaaacccctccctgctcaagtgtctctcttttctgagcaattgatgacagggttctacaccttcattttttttggttggaagtgccatttttctttgtttggattgactttcaccttttttttttttttttcatttcccttaaccacctgtctcggtccctgtctttcctttactggtgttcttacgtttctttttcttcttgcttttattcccctcttagtctggtttatactttttttttttttttttttttttttttttttttttgagacggagtctcgctggtcgcccaggctggagggcagtgacgtgatctcgactcactgcaagctccgcctcgcgggttcccgccattctcttgcctcagcctccccagtagctgggactacagacgcctgccaccgcgcctggctaatttgttttgtgttttttagtagagacagggtttcaccgtgttagccaggacggtctcgatctcctgacctcgtgatccgcccgcctcggccttccaaattgctgggattacaggcgtgagccaccgcgcccggtctatacatttcttttactttgtttcttgccataaagagtctttttctctacaattacctgctctcccctcaattccattttggtatcttaattttacccattccttcttcagacatttcctgaattgtctactgtgtgccaggaaaacaatgtcgcatgtagaacatggcccctatttctttaatatctgtaaagttaatgattgataatgattaataacaataacaagggccgggtacggtggctcacgcctgtaatcccagcactttcggaggcagaggtgggtggctcacctgaggtcaggagtttgagatcagcctggcaaacatggtgaaaccctgtgtctactaaaagtacaaaaattagccaggcgtggtggcaggcacctgtaatcccagcttctcaggaggttgaggctggagaattgcttgaacccaggaagcagaggttgcagtaagccgagatcacgccattgcactccagcctgggcaacaagagtgaaaactcagtctcaaaaaacaaacaaacaaagaaacaaaaacaataacaagaaaaatggtttgtaaatttcagatttttttaagagctagaatggctctcaggtttaatctaggccagggattttcaaactcttcagagtccctgtggacccccatgtacgtaatcaaagagatgaaggtttgtaggtgctctggatgtccaaaccctgcttataattcacataggaattcagctttttgacgttttatatgttggggattcattgaaagatttatttgaacaaagagttgtaaggttaaaacatgttcgagaatcgtttcctagtgtaatctaatttgacaaataaggaaacaagcttgtagaagttaagtgacttgttcaagtcaatccagtcaataatgccaaagctaaggatagaaatctatcttctagcccaatgttctttggataacacataccatgtccacaatttctcaatatagggagcaaagcagctttctagtcattacatctacttaatacagtttattcttacctattgtaaacctggcttcctatagaatatgcgttctttgcccagactgttatttcttaacatttgaagcattgtttcttacacttaaggaaaaatccaaaattagggacccctatagtttgctttaagttggttactggtagtaatcttaaattttataccagaactcctcactaggagaactcaaggtagtcaatgcttagtctccatggctctgctctgtcctgtgaactatagtttctagatgtcacttgtggtaaatccagctacagatttccttccacccttactttaatcaaaatctatcaatccattccttctgggagaaaactttgtctgtaatgaaggttgaattttaaaactctggaaaagggtaccatagtcccagtctagaattacccatcaaacacatttgctatagtcctactatgtattcatttttagggggagaactgggattgatcagtatttataaggatagtatagtttaccttttaggtaggcaattctaaaggatccatcaataagaagctctaggattaaaaataaaatacctctatggaatacaaattaggattcttgggacagtctggcacaaaaaggcattcagggacaggaagcaaagacaggcagtgtttggcttgtaacaaacagaaaagccctatacaaaacgaagcagcgctaatgacgcttttactgttcagtgttccctcagctcagagtaagtaggccgactgtccacaggtccttggatccaaaacagtcccctacccagagccttcatttcagcccatgcgtgttcattagggaaaagtgagggtcctggggtgtgctccctgccccacctctttctttgtccttcccgttgctctctctgctgctgaccatgcttcaaggtgaaagcccaggcatgcttcccagtgcatccttgagatgttaggtctttctgagctaaaagaacaaaaggatgacattgctggactgaaaatggcccttcaggctgtagtcattttgcagctgcagctgacctggaggtttagttcctgtcttccttggctaccataacactggcaggggaggatgaggcagttgaggccagcagtcgtttttggtgtagctcttcccacttacttctgtttgtagctactgaatctagcatcggcttcagtttcacgttgaccttcaccagtgcctaaaacaaaacaaaacaaaacacaggtggaggagagaggaaacagagtaactgacatgattttccacctttcacttatgaggagaatggaaactggctataggaaatgaaagtgatgattattttggtaaacaagagctatttacaagaagtaaatatgcatttaacaccaatatgttgtattaatagagcctacttagagaatgaaaaaataagacatcaccagcatagctgtgtacaactctaggggacaccagccatgtagactcaaatcctgttttacaactacatcaagcaagacaggaaacaaaatatccagctcacatatgcctacttacgtgtgcatctttgcctgccacagagggctccagatctcaattgactatgcacttaaatttttacaaaataatcctacaattgctttaccatagatgactctgggtggacttacttgaataggaaaggtcaggtaaaatcctgaaatgaggaggtgctcatttttaaagctaaagatctgggagttgtgctaaatatacaaagcatggaaacatgcatggaaatagacatggcagaaagggaagcagtgtggaagagagtgacagagggatgaaagggggatgagggaagaggaaatgtagggtgtggccaggggcagatggacgaccaggctgatgaaagtcaggcttcagcatcctcacttgtgccagacccttctaagtatattcttttgtgcttaattttgtgtgtgtgtgtttttaagagtcctcctgttcccaaatggtataagcttgtctcaccgctcctgggttgcccctggtagtggaatgagagccctaaaagtaagatggcttactttaatttaatgcaaatgagtccatcttcagctttcatatcagagggcttctccaagatagggggtaacatgggggcagggccgaggattttgtttctgaactgggactagaacaaattcaaggagctcagattaaagagcaataggtaaatattttacaggtcagaggagcatggaatttactctgcccaacaggaaaattccactattctctactttactgattattttctttcttttaaatgcatgaatatctacattttccttattttaatttttttttacttttcataatgaaaggcttctaacatattcaaccagtaaaatatgatcagcaaaaatctctattatgtatctatatgcctgtaaagatgaataataagtaaagccacccatgtaaaacatatgtaacaaaggatctaggagccttttaattttctggacagctcaatgaaaagggaaataagattttgatgacatttaacttttagaaacatggtctttgtccttttaaaccatgaggttttggggggttgttttaaaaataataccttttcttcccttcacagttattttatatattttaagtaacatgttagtgttagaaaatatagaaacaataggtttaaaaagtaggaaatggagataatttataatctcataactcaagagatagacactactaacttttgggttttgccttgaatggaatctttctattatgtttctaactggtgaaatgatcagaacatctaaaatatggctcatgcctgtaatcccagcactttaggaggctgaggtgagtggatcatttgaggtcaggagtttgagaccagcctggccaacatggtgaaacctcatctctactaaaaatgcaaaaaaaaaaaaaaaaaaacaaaaaaaaaaacaacctaggcgtggtggcacatgcctcacatgcctgtaatcctagctacttgggaggctgaggcaggagaatcgcttgaacccaggaggcagaagttgcagtgggctgagatcacaccactgcactccagcctgggcaacagagtgagactctatctcaaaaaaaaaaaaaaaaaaaaaaaaaaaaaaaaatatatatatatatatatatatatatatatatatacacatgtatatatatatatatacatgtatatatatatacacacacatatatatgtgtgtatatatatacatatatgtgtgtgtatatatatacatatatatgtgtgtgtatatatatacacatatatatatggtattttataatctcagtttaaaaatggacagaatcaatgagaatgtatggatttttaagcattcatacttcttgggcctgttttccatctccagggtctgaaagaagtataaaaagctggcatcccacgtggatgagggggagcttctgttaacacctaacacctcctatgtgttaaacacattgccagctgctctgcatacttcatctcagctattcctcacaatgactgtgcatcttacagatgataaaacatgtcccccacatgttaggatcataaatgatccttagcctttccatcacaggaggaaggtaagaatccatataggaagttagggcttccttttgtaatctttccatttgttttggaagctatggagaaaaccattgtttttctcaagtaaaagtcagggataggacactagcctgccatatagaatgaagatatagagaaatctgctgaggatgtaacataaaagggaagctcttaaagagtcaagaagaaaaaccaaggaataataagatacacgtcttgaaattgtatggcttcaacctttgtcaatgcacaattccaaccagctagtaattgtatcattcctgtttttagagactgtgatgatgatgaggagactgaagacatgaacttctgaggacacattgaatgtgattgctgttgtcatcaatttggggtaagggttgacaccaggacctttcttctgacttattcatacccatctctcctttcttctctcctcttatccattaattctatcacccatcatcttgcatatgtatacaactctcatgaattctgacattgttctttgaatgtaatcttatgtcacttgaggcctccccaaccctttagacttgagattagacctcaaatctatttcatgctctgggggacctttcagactcctgccagtgatttccaagtcttacttccttgtactctctgacttcttcttgagtctatttggccctcttgactccattctgcatcattcctaatgcagtatttcactttatttccccttttcacaggaaatcccatcaccctcaacattttggatgcctactaactgtaccgaactttagaggttgtcataggggaagtgacttacccactgacttactcttacatactccttttcatctcaaagggcacagtcttttaccccatggagagtaatccagttttctccccagccctagctcactgcttttatacagatctggactgccagccagccagttttttcccaggctccccagaattctgacaaattaaagtttccctttcttgttgcactaaggcctataaggtagtttttattttccttataaagaaataaaagaaagaacacagaagttgtgagattattagcctatggaaaggtgatttcccactttatgctttgggttagttagctattttttgttctgtggacagggttatatccctggtcccgtgtaaacaccttgcaggtgcatcccattcatcacaagggggacaaaaggtgaacatatcattaaaccactatgatttcagcacaccttgtgaaaagccttctccaagcatgactgtggttagggagtagtcaatagtaagtcctccaacaggaagaatagctctttttctgttagaatgccagagtgtatgactccaagcacaactgcaaaccacctgttagtaaacctaatttatctgctcaaataatcctctgctccagggagttatatgaatatgagtaaaatgtaactagatgtaagttaacggagtgggggtgggggttgaaagcccgatgtccttaagacagagtatgttctgtctctctcttaacagtgatatttatcacactaaacagaaacatctaattttaaatcaaatttactagttatttcatatgataataaaacaaagcaacattgtaactccagcagcgatcaaaatcccctttatttccatgagaaaaatacaggtgcttgttttccactcaatgcatagtgtttttatttagacaatagtgtgagggagccacaactgccatggttttatttagtatagcttggcaccagctcctctttactctgatcaagccttttaattaaactgactactataattcctatggaaattagtgtttatgttattttcctgctacaaaagcatttctccagaacttattttttttaatcccaggagcataaattagaatttttttctgcttgatatgtaattaaaaactcatttgattacaatatttctggctctgttttacttattaaattcctgtaatcagttttcttttatgaagctgctgggaaatgatcttaaaagcaacacatttttttcttccctggcaggtacccaagcatttactaaattacattcatagcacctgcccatgattcgaatcattccaccaatttattccttaagccatttaagtttatttggcatagccccaaacagctttcttccctttatccttgctctttgttctccttcttgcttcctttgtatggaataaagaaattggggagggaggaggaatacatatttctcagaattcctttctctttgttttatattctcctgaaacacagaattgccatactagaatatcgttttcctgtggccaggtgctggttctaggcaaaggtaacaaaactcctatcttgaaaacttactttttctctctctcttttttttttttttgtgagaaggagtctcgctctgacgcccaggctggagtgcagtggggcgatctcggctcactccaagctccgcctccctggttcaagcgattctcttgctcagcttcccgagcagctcggactacaggcgcccgccaccacgcctggctaatttttttgtatttttagtagggacggggtttcaccgtgttagccagggtggtctccgtctcctgacctcgtgatccccccgcctccgcctcccaaagtgctgggattacaggcgtgagccaccgcgcccggccgacttattcttacactcttaatttgttacagaaatgcagttagctgagagaatatggaactattaaaatactagtaaagcaagggtttatccacgaacctaaattccaaggcttatggtgattatgtgtagtgagtcatcagcaagagaattgcttctagtatttaaaagtttcttatcaagtgatacgggatgggttctgtgagaatgctattgtctagtttgacttgctcctcagtgaaagagaaggggggaaacttagcacccatctgatcactctccatatacacacggaggaactctaaaggttatgtatgcggctgcatcagcctcaagacacctgactctcctctgtggcatccctgctgcgtgaccacacagctaccgttgaaaccctttcagaggcagtgcgtgcacaacctcccaggggagtccatttagtttttgattgttctgtttttaaaatgttgttcctttatgttggactgaaatctatacccctgtaacttctacctaatggttctaatccttagggtgctctttctttaaaccagaattttctttagtagtgtaggactgataactcaggttttgtttcaagtgtaggttagagttgatgctgacctaaaaaccctatttgggatgcagtgcttctcccttggggcaacctttttgacatcactggggccccatgttccttccagttccctcctggcccatcgcagacaggacctcggatacttgccccactatgggacacagcctgggcatctggtcatctaggtggccaagggaccccacttatttcctgatttcattcacactccactgttgagttctcttgtgaccagcatatacagtttattccgtattttatttatgttttgaataaggaacacattcacatagttccatggatacaaaacggtacaaaggtgcaatataaaatctccgttctactatttcccagacactcagtttcctcccctagaggcaacagatgttttcagtgtcttgagtagataatcaagaaaaattttctgaatgtgtaagaacataaatatatttgcccctttttacaaatggtagtacaccatacagagggatctgcactttgccttttattcttaatatatcttgggaaaaactcatatcactacaaaattagatttcctcattttttatggctatctagtattccactgctgtcaaaatttgtttaaccagttcctttttgatggaacccaaacattgtttatatttggccattacaaataatgctgtaatggatatccctgtacatagcctctccataggtgtgaagtttatcagagagtcaaattctagaatgggtattgctgggtgaaagggaatgtgtatttgcgttttggtagatattactgaatcaacaaatataattttacttaagatatatagcaggatttttataatagccatactaacaaaagagagggaacagaaaccatagctactgtttagattaaggccttggaaagatagtgtgagggtgggtagagctaagaaggatacacaaatctagaatttgatccctctcttctctgtatactccagatgctaatttctacacagtacacttggtatcactgaagcatcataatcatgttgtccagaaggttttgattttactccctctctgaaagaaactccccaaatggtacttgaatctactgaaatctcttacagcatatcaatcatttttgaccagttacaggtgttttcagtgtgtttcatggactcttactgtcattagcaaacttttactgaatgcttagttggagtcagactgtaataagtgcttaacactgtcatataattttctcaggaactttatgaaatggttactattattatcctctttatatatatataattaagaaaaaccaaggcctggatgaagaactcactcgtggtcattcacttggtaagtgaagaactgaaactgcagggtttctctacctcagtactattgatgttttgggttagataattctttatggtgggggctgtcttttgcattatagaatgctctagaagccagtagcatccctccccaaagttgtgaccaccaaaaatgtctccagatattgccagatgtcctctggggagcagcatcttcccagttaagaaccactgctctgctgcctctaagcattatctcgtctccatcaggtcttcaatgaactcagcttcccctcaaatagaaggaggaataaaagtaactagctacagtctgaaccccagcagcatctctggtagcagagaaggaaagacttcttcttgggccaaatacatactcttcctcacctcctttttctgaagacatttaggaaggagaaataagaggagtttctatatattgaatgttcactgtgctgggctagggccggggcctaaaggccattatctcataaaatctccacagcagtcccacgaagtaggtacttttatcatcttcactttatagataaggaaattgaggttcacttaggttaagtgccttgtccatggtcatataatgagagatggagccaggatgtttacctaagtctttctgactctaatgcattgtgtaaaaaattccttccctagagaactaatccttcgccactcagctcacattctgtcttctctgtgaagtcttctctggtcttctggtatggaaccagaactctccttccttaggcatgcctgtagcacactctccatctctccaattctatctatcgcactgaaaaggtatttgcatttttttgcagttcttcaaagatcctgttctggattgtgtttttgtctctttgtacttgtcttttttcccccttctgggtccttttaagccaagttttaaaagtgctggttttcagcaatttgattctcatgtgcattgctgtagtgtccttcatgtgtcttctgcttggcttcattgagaatcttggttctgtacatttatttccaccatcctgtcttcagctatgttttacatctgtcttttccctctgggactctaatcatacatatttagccattggcattgtctcacagctcaaatgatgctctgctcatttctcttccatcttttctatatcattttggatagtttctgttgcgtcactgagtttttcttttgcagggcttaatctgctatggatctcatctactatacatatatatatatacatatatacatatatacacatacatatatacatatatacatatatacacatacatatatacgtatatatatacacgtgtatatatatatatatatattttttttttttttttttttgagatggagtctcgctctgtcacccaggctggagtgcagtggcgcgatctccgctcactgcaagctccgcctcccaggttcacgccattctcctgcctcagcctcctgagtagctggaactacaggtgcccgccaccgtgcccggctaattttttgtgtttttagtagagacagggtttcaccgtgttagccaggatggtctcgatctcctgaccttgtgatccacctgcctcgccctcccaaagtgctgggattataggcgtgagccaccgcgcccagcctactatattttttttacctcaaaaattagcgttttcttttctagaagtttgatttgggtctttttaatatcttccatgaccccttaatcatgctcaatctttcctctaccctctgaaatatctaagtataataactatcttaatgtctttttctaccaagtctatgatctatataatctctgaatttgtattgattgatttttctaattattatgggtcagatgtttttgcttctttgcatgcttgataattcttgatgaatatcagacattgtaaagtttatattgttgggtgatggattttttttcctttgctttaagccttcttcagttttgttctggaatatagtcaggttatttggaaataattcaatccctttgaggcttgcttttcagctgcgcaagctgggtccaaagcagcctttttttttgtggagggctaatttgctcccactactgatgcaatacccttctgagaactgcatccaatgcctcatgtatttcaaggcttttcttgggtactctagctggcaggagcatggactattttccccaggctgtgtgacctctgtggatcactttacttgctcctttttgcttcagcctcagtagtttcctcacatggatatgatgaacatcactaacctgaagactcaaagtggccctctgcagatctctgggctttttctgtgcagtcctctcttctctcttactcttccctgggaactgtaacctctttggcctccctagactcctagctctgcctccttaactcagcaagatcactgggctctgcctggattccccctgcctgtgccgtggcctagaaattctatccaggccacaagctggaacagttgtaggactcacttcattcattccccttactcaggaaccactgtattatgttgtctgttgcccattgtctgaaaagtgttgtttcatatatttttcaggttttggggttttgttgttgttgttgttttgttttgttttggcccgttactcaaccatggctagtagtagaggtcccttatcactggttttaaaaactctgtcttgcttagtatcccacaagctcagagagacagtggaaacaaggccttttatctttgtatcttcaacatctggcacagtgaccccaggaagcagcagcctctcctccattcttccccatagaacagtggcaggaagaagggttaaggctaggacagctgccagtggctgagagtggggttaggatgttctgacctgctacaaaatcctgctgtaaaaacacatctagaatgagccacttgggaaatggatatattttctcttattaccattattcctgggcctttgtttttatcagtttgccaacctgctaggagccagatcctggcctttgtgtttctctgccatcgtggtccacatctgttatcatctggctcagtttgtgcttattagttgaccacagttacctcttggaacccagctgctggatagatagggcagatgtgggacaagggaggagcagagagaagtcatgctcttagaaaatgtgagtactcctatactctgttgttggaaaggggcatagaggaaccccatcaaattaaaaccagattagtgtttgaacctgaaaatgtccaacggtgtcattaatatattttttaaaactttgaggaaattgtctgactattcatttattaagaaaaaaagacatttattaagaaaaaaaaggacaaagagagaagatggttttggccccctattgttgaaatctatttccagagttgctagtgacatcacttagtattttttgccttctctcacccccaccttacccaagagaatcagaaactaagtgacacaatataccatagaggagaaagaacttagagtattttttaatgttgatttttaaaactataaagttagacttggaacttatcttacgtatctgtttgaggcagcgtattcctgttatgaggtcatgatcactttactaccatgattattccctttctggaggaaaatatcaaaaaaatcattggaagttggtattttgaaatggaaaaccactgatgatatgaccaactgttatcatctctgctcagattcttcagcaggagggacaagagaacatgcaaatggtggcaggccctgaaattctcatgaattcgtgtgcctgtccagcagttacagatgcaaagagcatcttcaagaaacagcttcctgttcaaggtgtatgacttcagagacaggtagccaattgtgggagcagagcctaagttataaattagtgaattgttgaactgctaatccctcttaggtccaaaggttaagattattcatgatttaatctgagatactcccagattttacatgccacacctcagtgctgcagttggctggaaatcactttggctttccagccttctacttttttatgggttgtagaggccagaaactcagtggacggactgtttacaactgaattcctcaccttccctcaagccttcctcttacgtttactctgtcagggaactgggcattatcatctatctagctgtcctacccagaaatccatgggtcatccatgacatcttcctcttccccttacatccaatctgtcacaaaagtcctgtcaatcccacttccaaagtttctttgaacatgattctgttgccatttccacaaccctggtttaggctaccatcatccccctgactgttttaaatctgctgcagcctcctaaccagtctcccagccttcctctgccactgtccaatcggtactccatatggaagccaccatggagcagtcaatcagaaacagaaacctgagcttgccattcacttctctgagactttcagtggctcctatttgatatgaatatgctcatcatcgcaagtccaaatccctcaatgtggcctataagaccctatcagaaaagagtattgtggtagtaagagagaatgaaatccagaaacaaaacaaaacagaaacaaaaccataaagactgatggaaaacttgggttatggtacaaaaacagaactttgaaatgccaaaataatcccactaagttttctagaaatcctgaagtacacatctttatatgcattttcacgttttactgagtcaaaaaaaaaaaaaaagctagactccacatggtgcgtttggcaggagagagctaaaatgttagttactatatgtgagagcagatggagctggctgtggagtccagatgggaggcagcaaacagactcctcctaaacctcactccttccctccccagttcaatggcttttgaaactcaaggttgtgtaaaaattaatttgtattaaattgcttaagataatgtattaactaccatagaaggcttccagcagtttttaaaacttgctttgaaaaacaaataatcaacctataatggtgaacacagaaggaagcccagacttccttggctgtttttaagcattcacattaaagataccagccttaaaaacatatcttttttgtgttatttgcagaagttggaaaattaataataattatttatgtaggttacacatgtaactgtgtaagacactgtggtatatttgtgcttcatatagtttatctcattaaattctcaaaactaccaggtatgtgcattatcaacccgttttagagaggagaaaatcaggctcagaaaggctacataatttgcctggggccacagagccagggtttggtcccaggtctctgactccagagcccaagttagtaaccacctaccatatgtgtaatgctggcatgtgagtttgaataggtcagcctgctggttagaattatgaatgaaaagtgcatttctagataggaattgcctgtttatcttcaggaatatctcattagctaataaatgttttccttaacagactcaagtgctgctgtggtctcagacatgttcatatgacataggtctatggaggtcaagattggtcagaaggcaagtaagaggcagagtcaccctggaaaagagtgaacagggttcaaggttacctacatacaaggctgaagtttggcaacacgaccaagggtgaaataataagaaaagacttaggcagaggcaaggacttaaatagctgattcagtgggttcataacagctgagttcttctcagactagaaaacaatggagtttaaagggctctagctttataattcctgccctgtttaaggacatggtcatttattctgccagaactgtggtatccctagcagagtttgttagttgcctacccaatacacgttttaatttaccttgagcttaggagtggccagggagatgtaagcagaattcataaaggctcagagaaaactctttaaatggggcttattctgctgggaggtgcattctcttgctcttgtccctatctgtttcttgctgttggaatattgatatggtttggctgtctccccaaccaaatcacatcttggattgtaactcccacaattgtaacctccgcctaggttttagacgtgacatgtcatgggaggaacccagtgggaggcaattaaattatgggggcaggtctttcccatgctattctcgtgatagtgaataagtctcacgagatctgatagttttcaaaatgggagtttccctgtacaagctctctctctttgcctgctgccatccatgtaagatgtgacttcctcctccttgtcttccaccatgactgtgaggcctccccagccgcatggaactgtaagtcccttaaacctctctttcttttgtaaatcacccagtcttgggtatgtctttatcagcagtgtgaaaacggaccaatacagtaaattggtaccagtagagtggggcattgctgaaaagacacccgaatatgtggaagcaactttggaactgggtaacaggcagattttggaacaatttggagggctcagaagaagataggaaaatgtgggaaagtttggaactccctaaaggcttgttgagtggctctgaccaaaatgctgataatgatatggacaatgaaatccaggctgaggtggtctcagatggagatgaggaacttgttgggaagtggagcaatggtgactcttgttatgttttagcaaagagactggcagcattttgtccctgccctagagatttgtggaactttgaacttgagagagatgattaagggtacctggcggaagaaatttctaagcagcaaagcattctagaggtgacttggctgctgttaaagggcatatgaaacacagcataaaagtttggaaaatttgtaggctgacaatgcaatagaaaagaaaatatcattttctgaggagaaattcaagccagctgcagaaacttgcataagtaatgaggagctgaaagttaatccccaagacaatggggaaaatgtctccaggccatgtcagtggtcttcaaagcagcccctcccatcacaggcccagagtcctaggaagaaaaaatggcttcgtgggccaagcccagtgtccccctgctgtgtgcagtctaggacttggtgccctgcatcccagccactctagccatggctaaaaggggccaaggtacagcttggacagtggcttcagagggtgcaagccccaaaccttggcagctttcatgtggtattgagcttgcaagtccacagaagtcaagaattgaggtttgggaatctctgcctaggttttagaggatgtacggaaatgcctgtatatccagaaggaagtcttctgcaggggtggggccctcatggagaacctctgctagggcagtgtgggagggaatgtgggggggagcccccacacagagtccccacctgggcattgcctagtggagctgtgagaagatggccaccatcctccagaccccagaatggtagatccactgacagcttgcattgtgcacccggaaaagctgcagattctcaatgccagcccatgaaaatagctgggagggaggctgtaccctacaaagccacaggggcagagcttcccaagaccacaggaacctacctcttgcattagcataacctggatgctaaaactcttgttttaacacggagtcaaaggagataatttcggaacttgaagatttgactgccccactggatttcagacttgcatggggcctttagcccctttgttttggccaatttctcccatttggaatgggtgtatttatcaaatgcctatactcccattttatctaggaagtaactaacttgcttttgattttactggctcataggcagaagggatttgccttatctcagatgagactttggactgtgaacttttgagttaatgctgaaatgagctaaggctttgggggaccgttgggaaaacatgattggttttgaaatgtggggacatgagatttgggtggggccagtggtggaatgatacagtttgggtgtgtccccaccaaaatctcatcttgaattgtaactcccacaactcccacatgtcgtaggaggaacccagtgggaggtgattgaattatgtgggcaggtctttcccatgctgttctcataatattgaataagtcttagaaagtctgacagttttaaaaatgtgagtttccctgcacaagctctccctctttgcctgctgccatccatgtaaaatgtgatgctccaccttgccttccaccatgattgtgaggcttccccagcaacgtggaactgtaagtccattaaacctttctttcttttgtaaatcaaccagtcttgggtatgtctttattagcagtgtgaaaacggactaatacaaatatgcacatgatagttggaaccagagtggccatcttgtgactatgaggcaaacttgactacggcagccatgtgctaaggaaagataaaggagaactaggtttctttatctttttctttctttttttgtttttacatagagtctcactctgtcacccaggctggagtgcagtggcacaaacttggctcactgcaacctccacctcctgggttcaagtgattctcttgcctcagcctctctagtagctggaatttcaggtgtgtgtcaccaggcctggttagtttttgtatatatataatctttttagtagagacggggtttcaccacgttggccaggctggccatgaactcctgacctgaagtgatccaccactttggcttcccaaagtgctgggattacaggcatgagcaaccatgcctggccaagaactaggtttctgatggctatggaactgccatataatagcagtatagcattggcttttctagattatttttattttttactaggagctaaatataattcctaaatgagaaaattgatttcatattgtaggtctctattttctgactatctgtgcaggtggcacagtgttttgggcatcttgatactcaaagataatgcttagtatgaaggcatattagctcattagaatccaacacaagaataattcagatttgcagttggaatattaagggcatagtctacccaagttataacaaaagatgatgtttgtagcatcaatgtctaatatcctgtaagctaattatactattagtaataagttaggaagagaccattttttccccaagatttgaagcagattagtcgtgcatgtaaaagtgaaaatgcaacaatgcattacagcagttttatctccttctttcttttctctttccagttccttcctgacctctcaagttacttgttttgcttatttatatgcacaagagattcttttgtggaaaataatattcacaaatgacattaacattctgaattaatgaggcaggaatgttagtctttttggattaactgcattgttatttccataatatagggcaagagtctgaaactaaaatgtttacagggccaggccactaaagttaatgactgaaataggctgcatgatagagttgggagtggtggggactatggcaaactggacattttacaattttaaaaactgtattcaactgaatgaaacaagtctgtgagctgaatctattctgtgggccacctgtttgcttgctgtgatagaaagtaaagcacatcttgctaacatgaattaactactgagtattcatgtgccctatgttccaggagccatacttggagttcttcatatgtgacctgattacaactcagaatggtgctgtgagatagctattattggctctgttttggcagatatggaacctggaattggaaaaactaagttaaagagccaaagtttacatggttaagtacacagcagagctgaaatgtcagtccaggcttggctgagtaccaggctcatggtgtctttacatcaggggtctcaactggcacactagtaacaatgggtatctcacaccttactgcagtgttgaggacaatggtgcaactttttttgttctatgtctctgatgctggttcagaacagattcacaggaaagtggaggtcttgctgagtaaagaagaaacaccacttcccaaacgttagatgtagtctgtgcatcttttatctttgactcatctactctaccctgccctgggaaaataaaacaagagttctaagttgtaaaggacaggcaagcctaaagacagctcatgtaaatgggagcaagaacagtttcttgtgttataatgagcccctccagaatgctgtccttggttatcctgttagttggattttcagagcagactggtagctaatcaatcatgttcattgtgtaggcaacttctgacttggaaggaatggctgctgacccagaagccacagcctttgatgaatggggcttcttacaagaggtggttggaacatgtaactaaaaagcagtcacgtggtaataatccattttccatatactggaatgttttctgctaataccatcacctgaaatttcatagaaatatataaaactattattttttcaaagttcaatgtgtaaaaaggatcacttaaaacttttagtttgttgagctgcaaacattcattcactgtacattttttgtatatttcccacatgcctcaagttctaggatttcctaaaataatggatagggtgtctgtgtgggaatgggtttacaaatacagaattgccaatatctgtccttggtgtgaatggtgctcggtgtaagtcactataggacctcaaagaatgtattctagaatattctattagcattggttctaaatttttagcttatatttgagggtgccaaaagagtcccaaaagagagtcctaactatacacactactgaactgcttagtgtgcaccatgcaaatatgatgactactgagcatttcttgcaagagtttaaaggtggcttcctgcctagcaccagacatgcttagttctgagacggggaggaaccatcaagtccatgaatcccaatgtcccggatctacagaggaccagacccaaagcatcgaggagaaatgctttgtctttaggtaaagatccttgggggataaaaatcctttattatgttggtggtctctctccctatggcaagggaaacttctttttcttaattttacagcctgataaagacagtgggccaacctcagtagctcatgcctgatctttggggggctgaggtgggaggatcgcttgagaccaggagttcgagaccagcctggacaacacattgaaaccctgtctctacagaaaaatttaaaaattagcttggtgtggtggtgtgcacctgcaatcctagctactcaggaggctgaggcaggaggatttattgaactcaggagttcaaggtcacagtgagctatgatagcaccactgtactctagcctgggtgacagagtgagaccctgtctccaaaaaagagtgacaattttgagataataaaaagatagaaagggaatatgttacatataccactaggtatatgtctgaggaggatattgtatcattagctggccttctctttgtcctagaaaggggccagtctgtctactggaagacccggtagaaggtatgttattgtggctcttctttaactacattgctaactccccaaaagccaaagatatgggaaaagtttgtttgtgtaggcacagagggaccaatattttcagtagttttatttcatttttagagtgcagtttaagagggaatataataactttataaattaaacttcctaatgggcaacattttctatcttttaaatgttggaaagtttcatattaatttaactctcgaacattcaccatgtaaaattaaataagcagccagtaaaaagacaaaccagatttccttttgaactaaattttaaagcttatgtgaaaaaataagaatacctagaaaatattgaaaaagaataataaggaaggtgaaactaggattatgagacattaaaatatattataaagtgatattaattaaaatagtataactaggcagatagatcagtagaactgatagaaagactaaaaatagaaacaaagttaagggaatcagtatatgataacagtgaccattcaaataataaggaaagagttcagtcaaaaactgatgtgaagaaaactaggtaagataaataacaaacttggaaacatatttgtcacctttgcaaataataagggtttatttctttaatagatagtgagctcctatggatcagtaagaaaatagccctagttcaatagaaaaataggcaaaaatataaagcatttacagaagaaatacaaatggcttctaagtaaataaatctatactaaaaatatgatcatacttatttataatatggaaaatgctaattgaaactataatgagatagattttatagctatcgtattagcaaaattgaaatttggtaatacattgtgttggtaagggcatagagaaataggcatctcagacattactgataggaatgtaaattggttcaaactccacagagagaaatttggtgatatctatcacgatctcaaatgcttatatgccaaatgcccagttatcttatttcttggtatttctcctaaaaataaagtatgaaaattgtgtatttacaagaatatttattgcacattgtttacaacagcaaacaattagacacaacatcaatgtccataaataaataattaattgttgtttaaataatttatttttcatctttaaaatctaatactatgcagccatcaaaaagaatgagacatcttctgcatggagactgaaaaagaataatctaaaaaataaattaagtgtaaagaagcaagatatggagcaggatatacactatgctcatatatgttcatagatacatatgcacttacacatagatacatatgtgtgagcatagtatatatagatgcatgcatatgcactatatttacatagaaaacaatgtagaagcattatgtattaaaaacagtgtaaaaacacactgtatataaactatctttagaagcatacgcaggaattggttaacagtggttgccccagtgaaaggaactgggtgacttgcaaaaaggagtatgagggaggatctcttttctctgataatttgtgccttttgtactttgtgaattgtgttcactgagggtgtctaaactatttagcaataaaaaatttaaaagtctatcatgaacagataaaggaaatagcaatctttggtcatgtgttagaaatattaaatcacctgattggttaattgttaaaaaaggcttacaagtacaggggcacaaagtagaaatgcttatttccacaaagatcaaaaaaatttagtgctttaccaccataattcaaaaataattttaataccttaatgtatgttgcaataacatcgtatataaataaacacctccctcctcccactcccccatccatatcacaaataaaggctgactacctcattgctcctcagcatttcctctgaaaagcgatcgatgtctcctgcctggccattaaatagattttgaaaaactcttcaatccctatcagtctcatatccttatttagttcctcaaatttgccctcagctgggaattctgcaggcaactgtgattctgttgtgttcaccactcatttgaagggtcccatccatcatcatttctagtccttttctgatgcaatgtagcttgttatttgtctttcttataaactgaatggctgttaaattatccatttatcttccttcagattttctgttcagtttctcaggccctatcagggctgtcttttctaccttgtttgctgacttttcattccattgcccctgttcttggaggcatcttggttcaccatgctgcccttcaaaacaaactctctggttcagtctgctttttgcttgtttgaaagcaagcagaacttgctacttcagtagatttccttttaaaatttttttccttagaatagttttgaaaactttgaggtaatatatttcaaattttatacatagatagtaggatatattggaacaaaccttaaacaaaaagtccaaagtctagggttctaaacccagctctgccattatcaagtcaggtcacttaatagtgacctttcagggttttgctttcccctcctacagatggtctgcaggtatgcacctagttaattattctagtataaaaatagcatgtttcttctgttaaaggtgacccaataaatgatctgaggtttgtataatactaacacctgcacatacattatctcaggcagcactaggtcatactggttaggagtcacagatttgaaagcagaaagaatctatgccctgtcacttactatatattcttaggtaagttacagaagctctatagcttcagttttcacatctgaaataaaaagatcctcatagcatctaacttggtattgtgaagagaattaaatcagatcatgcttggaaagttagtcttgagcacatactaagtgctcaaaagtgttgttatggactcactacatctttgtgagacaggaagcttggctattattatccaaatttacagcagagatactgaggttgagagatgatattaatgataacaatagtgactcacatgctggagggctttaactataataggtgtactcttcccaaagcttttccacatacttcacctccctttgttcagactcttggaaaggttgatattgcctatcatcaattccatttgctccaagaagaaagtcactttgtgaggcccaaaacctttaaaaagtgcagagtgaagctgctttcagccaaacctacgagccagtggtgatcaccataaaaagaaagctgaggatggcgagtcctcagtttatgagtgtagagggcaggtttgaaagaggacagttagaaaaacactcagcccttactgcctcctcttaggccctcttcttaggtctttttttttctccctcctgctgtctctctttctgtatgtctctgtttctctatttctcttttcttctttagatttttcagctgttcagatcacctgtaacactaaaacctaaattcgatgatgatatattgaatcaaagacttggagaataatttgtccttttttgttattttatggttctgtagctcatccctctgcttgtaggagttattggttcagatgctgaaactcccctaattcactggggcgattgtgagcagcaagtataccctccctagtttctcatccgtgaaataaaggcaggaatgttaacaccgccacagggcaattcaagagtgataggttatttcagggcatcctgaaagcataagatgctgaggaaatgcaagcgcttactagtaacaatgtgataacccgatctttcccgttcctgtcactctcttgcgcttgctttgttgctgaggcagccctgtggggtctcccagtggctgataacaacacacacacactgctgctgcagcttggatgagggaagaggttggtagattcagctgtgctgggcatcctggctgagtaacagagacagtgaatgtaaacaattaagatgttctaataaaggaacccaaagagggtcccagaggctagaatatctacctcctgggggcaaacagaggtttcctaagaacatgtcatctgagcagagtcctcaagtaagactaggagttgcatggggagaggaggggaaggtaggcctgcagacggctaggtgagcacaggcacggggtgtggaacatttagcttatggcaagagcagagggtacaaaggaaggagagagaggaggtgggatgggaaggtcaattgtgccaactaagatttttttcctgtagtaagggggagggagggcctgaaggactttaaacaggtgagccatgcaatcagctgtgctttgggaggatagctctggtggtgacatggagccttgaggatgggactatacgcatgagactgggatcagagtggaggcagctggcaaggaggcagtcaggagaccctactaatatagggaatccaaatgaaggagaaaaatcatgatggcacagctagaaactaatagagaagaaaaaataccccaggcattttggccttgttttacaacatatttcttagctttttgatggcaatggaagcttttttgaagttgtcttttgtttcctgcctttactgtatgctctgaattcccttctctttcatgctttttggtttgcatctattctttcatattggaggctttgctcaaacattctgtggaccttatctgtttgcatatatttaaatgcaaggcactgaaagacaaaagacctattcaaggcagagtacaaagtggaccagggcaggtaagtgggagagctgtgattgtcaaatggtggctccattttaagggcatcctgcagggaattggttcatcgagagaatatgaagtgcaagtccatgcagatcttttctctgaggctgttctgtttccctagagaagattcccacttttctgcttctggggatatctggctgctggcactccaggtgcagagtcgtagggcatctgagagtccagcaaatcattccatgggctttagatttcagccatggattctctccatgagtgctctgagagaactctccagtctcctgacttggcagtggctacacaggctgttgacctggctgtgtgggttgtgggagattcctgagatcccatttaccaacttctaacctttctttccctcttgtttccaggctgatttctcaacctctctgtcgtgagttgactcgtgtactcccaaaagctatgttgaagttctaaccccggtacctgtgaatgtggccatgtttggaaatagggtctttgcagatgttagttatcaaggtaaggtgagatcatattggattagaatgggccctaaatccaatggtttgtgtctttataagaaggtcatgtgaaaacacagacacaaaagaacgttatgtgaaggcagaggcagaggatgtcaagaactgctagcagccatcagcaacgaggagagatgcatggaacggactctccctcagagccttcacaaggaaccacccctgctgacacctgaattctagcttctagaactgtgagcaaatacatttctgttattttaagccacccagtttgctgtactttgttacagcagccctcggaaactaacatatccacccttggctgttcctaactcctgagcctctcaggcattccttctgaaaggcagatcggctggctccctgttgctctccccttgtgcagacattctgggagattacttccttcttagcttccaatatttgaggatagcttatctccacttattttctgtttccttcagagtgtatatctttctttgaaaaaaagaaatgcaactttattatttctaatcatgcttaatactattaaataagtcaataaaatgaggcaccaaagtgctcatttcagaattatctctattaggaaaaaagtgtgggacaattaaataaattacaacaagtcaattgatcggaatactaggctgccatttcaaaggataatgtgaaagttggatgcggtggctcatgcctgtaatcccagcactttgggaggccaaggtgggcagatcactttagctcaggggttggagaccagcttgggcaatgtggtgaaaccttgtctctatgaaaatacagaaaaattagtcaggtgtggtggcgtgtgcctatagtcccagctactcaggaggctgaggtgggaggattgcttgtgcctgggaggcagaggttgcagtgggccgagattgcaccactgcacttcagcctgggtaacagtgagactctgtctcataaagaaagaaagaaaaaaggacaatgtaaaaattatgtagaaacatggaaacatattaagaactttatgttgtgaccaaagcagaatacactcatgtaccctggtaaaaatgtgtttggatgtggacagtagtatgaaggggtatcaggaataagagaatgtgaggttcttatttctcccaacagtcactcttgacaatttaggtattctctaaggtgatgtatattttctttactgttctcatttgcttttgatacctcaacagcagagtttttaacattcacatatatttctccttttttccttcctccctcctttcctcccacccttcctgcttctttcctacttcttccgaagagagacgaagaagagaggctcatgaagaaaaggcaaataagcttttaaaatatgctctctaaaaaaactataaagttacttaagggaagagaacattccaagccttgtaaggacttggggttaagacatttagcttcattattccaaagcagaaatcctttaaaaaagagttacgtatgttggtcagctggataagaagaatttaagataagaattaagatcttatcttaaatctgtcctcaaaaaccttattgtgggtatatcctatttttttccattggattccagcattttaatatggattcatggcactgtttgagctcataaaatacatatgaataggaatatattaatactaacatacaaagaatgggtatttttttcaaagttttatgaaataaaacaaattatagtccattttatttaccaaaaaatatgcatagagatggttgtttatcaggtcaaaagactttttggaggtgaaaaacatcaggtatgctggaagaactctgagatgtagcgaagggtatgagatgccttcacctgccaattatcatgcataatgttggaaggaacaggaactaatccattcttctattaatgagtcctcactgctactcagaacttcttcctgcccagcacgttcttttttacttttcctttctttcttttttttaaagagatggggtcttgctctgtcacccaggctggagtgcagtgttgcaatcatagctcacttcagcctcgaactcctgggctcaagcaatcctcccaccacagactcccaagtagctgagactacaggtacacaccaccatgcctggctaagaacagagcatattcttagttgatgtttgtactgattacttttagacactacaggatcctaaaagttttctaagtcaaagaaagattaaattttaatcatgataaatttagtgtattttattgtattataatttctcgaaatcatatgtatgcaatatacaatatacatttcttgaaatctatctgtgacatatgctagctccatctcttaacctgaatattaaaataactagaggactacattttctggcaatgctggataaaagaaaatttaatgtatttcctagctgaaaaagtcaaagctctgaattcatggctattaactggccctttacagtagaattcaactatgatgagaactaaaccactttataaaaagatatcataggccatatactccagattatgggcaggaatataacagtgcatactctgatgaaaggttttatacatagtcatgcaccttataatggcatttcagtccatgatggaccatatctacaaccatggccccataagattataatatcatatttctactgtaccttttctatatgtttagatgcacaaatatttaccattgtgatacaattgcttacagtattcagtgcagtaaaatgctgtacaggtttgtagcctgggagcaataggctatcccatatagcctaggtgtgtattaggctgtacaatataggtttgtgtaagtacactctacgatgtttgcatgacgaaattgtcaaagatgcatttctcagaatgtatccctgttgttaagcaacacatgactgtatttataggtgataactaaatgacattataagcttacttcatacattccactgcttatactgcatcccatcattcacttttctgtttcttcattcctttgttcaacaaacattggctgagcagctctaatgtgctagcactgtgctaggtgccaggaatatggtggctccaggaaacccgtctaatggggaagagacagaaagataatcacatacagagtgtgtggttataaagagatggagacagtgctgtggaatgttgtggggaagtagaggttttacagaagtcacagcttgggctggtgtcttccaggcacatatgagagcgaggaggcataggcagaggccagggaagatggaccaaagggctagtgagtcctgagcttgggcaaagggtgtctggtaaggaagtgggcagggtgaaaggagatgaggccaaggaatagatgtgagcttcagaatgaatgagggggtttccgaatgctataccgaggacttcggaaggtaccttatagatggtgatagtaacctgaggtctttaaagcagggagatgctgtgatcagatttctttttaaaaaaacatcattttgtcaaaaatttggaagatagactgtagtggaggggcctataaattacataaaaccaacacttttgaatattaatgtttctcttccattcatatttgactaataacacatagaatattttctgagataaacaggctttactatctatcagcactcagatttgggtacattattatgtaacaaggacaatattttgagaatggtaaaccagtgcattttccattctgtttgaatggtgatgcctggggctcctctcccgtcatctcagtaggcttccctccttcaggcaaatggcggttcccagctagaaacaagctgccatcattcagctttgaaaaagaatagccctacttgtagctttgcaaggtgaagtggctttctacatttcagaactctcctttctctattaagaaccaaacctggctaagttagatcttcaagttttactacaaagctctagcaggaagaacacagaggagaccatgtaaggatagttcccatcaggaaaagcaaagcaaatggaaatattaggggaagagggggagtggggagaggggcagggagagagaagagaggagaaagagagaggggagagaaagcagaaagaggcgggtgagagagagggagagtagtcctggcttcacattccttgggggtcaaacctttaaggggagggcttttatttcaaatttcagagcctaattcaggaaaataatagaatcttcctaaagcaagttggtatcgcccaggcagcatattagaaaagacttaggaagttatgtggacagcagggtgaagagaaagtagctgggagttcatgggtgccccagggggactgaggaaatgccaagagaaccaatcagctagaactggccaggaagctgctgggggtggtgaagggggcttgccaagaggctgccacaaggaccacagacttaagtagccagagctggtggccagggctggcacaaagtactcatcacacccacaccatagtcacacggggctggcacagcatcacagccagagttgcgaccagccacctctcagttaacccagaaagacccaacaggcaagatgtgtaccaggggtccttctcttgaaggtcacaaaatcatcacaaccataggtgagttccctggtacctagatgtcagctggggaggagaaagagctctgattaggagtactttaaccagaagagattgagatactttaatagtcaagtttaaataatagtccctgaatgcagccaccaccctactccccatcaccaggaaaaagtggagccagatagatcagttatagagaaaataagaagttgttttccttcctttcttccttccttgcttctgtctttccttctctcctccccttccctcctctgcctctcctcccttcccctctcctctcctcttcttttttccctccctctctctctccttccctacattcctcccttcctccctccttctttcttcctgtattttttgagttatgtatgatgccattccatatatataccccctttgtaaggacaagtaagaaactagacccaactatctcttcctttcatccacaagaatactaaaagtcatagagaaacacttataggaaactaactgatttgagtggtgtctttttttttttttttaatatctgatgaagttgtttttagggaacactggattgcttttaaagtactttcatcagtatccagagaaagtgtcctggagtagcaccttatatcctcttttctagtttgtcagtttctaactcccattctactatttcaactatattttaaagttttttctcccttttttccagagaacctattaatattgcatcatgtggaatgtatttttcaaaatgaccattaaaagtgaaggcagaggctgggcatggtggctcacacctataatcccagcactttgggaggctgaggcctgtggatcacttgaggtcaggagttcaagaccagcctggccaacatggtgaaaccccatctctacgaaaaatacaaaaaaattagccaggtgtggtggtgcatgcctgtaatctctgctactcaggaggctaaggcaggagaatcgcttgaacctgggaggtggaagttgcagtgaggcgagatcaagccattgcactccagcctgggcaacaagagcaaaattctatctcagggggaaaaaaaaaaaaaaaaaaaaagtgaaggcagagaaaaaaatcaaagtttactgtaaatcttaacattagcagccctgcctgcttcagaaacctcatgacattttaatagagaggcactacccttaccaaaattttcctactcttaatggaaagagaaaattattctggctagatgctggccaggtcacatccttttgcattatctgtgagaaaatatccactccaaaatcaaaagccagtttgggatgagctaaaaatcagattacattcataataaaaatggaatctctcagttcttaacaaacaaaagatttataatgactctgcaccactgacattctaggtacactgagatttggttaagttgagaatgaaaataaggagccagaacttagcttgctattgcagacaaaagctcaaaatgatactgtgacatgagggtttctgtttatccctaaggctggtgtggcaatttcaaagtttgattgtgtctttttttcttccttcttcttctttttttttttccccctccaaagacgttgagcagcagggctaatggatccccagcagggtgcaaagacagcagaaagtgcaggaatcagatgtcaatgtattccttcgagataccctgctaggacacagctaactaaccagggcttgagtcttctcttggggaatgtgctttgatggttccctgcccactcttggcttcctgattaaaaggctgtcacccataaatcacgacttcatcctgttacaatcattttctttctttctttctttctttctttctttctttctttctttctttctttctttctttctttctttctctctctctctctttctttctttctttctttcattccttctctctctttctttcttctctctctctctctccttctctgtctctctctctttaaggaaaagtctgaagattaaaaagagagcaagttccagagaactctatgctcacatataaacatatggatataagcctggcctacatccttattagatagctattcatcgatttgggactgttctgtgcatgtgtcctacccacctggcatgttgggagagctaaatcaataccacaatgacatgctgtctttctccacttgagatagaaccagtcagcctctctcgttgacaatatatatggtaaagagggcctgcacatcgtttttttctgttttatttaaatatttttatatattttctgtctgtcgctttctgtcaatctcaagattacttagataacttcctagtgaatagattttggaggaggaggagttcctcattgttttccctcaatgtagtaaaaaattgagtggaacttgaagctatcagagataagagtttcgattttaaatgcactgggcatccaaaatataccggtgcaggtgccaattaggcacataaataagtagcccttcaggcactgagagtagtgataatcttcccctttgcttggagaagagctaaactcagcaaacaggaacacaaacagaaagtgctttatctatttgatatttgacaagcacaacccttttaaaaccatgaagtaaaactgaactacccagtgaaagtcaatgaagtcaaaaagctgtaccaaaaccatatgcatatgtactgcccagcagcctggccacccgcccctgccaaactcgctgttctgtcccactgctgtactcaagagcctccagccgtggggtgccctgggtcaactcccaccctctgtagactccaactctccaacctcctccacctgcaggaagatcccagctctctctatgagagtgcttgccttgggctctacatgaaggttcttgccacccaaccttgccctaccttggggtcaggccttagctgttagaggggacatgctttgtctcatgtgtactcctcggtattcttttgccatatgcctagaccaacatggtaaagcaaagctgaattcttatgctgtatttcagaccaatcacatcagggattcctgccacctgcacacttcccacttgccttcgatcctctcagactccttatgattgcatttttatgttcaaaaccccaaacttgactttcactgagttatctcagtgaatggtgtcacatcagtgaccttcctggctcgtcacttcctcaaggtgttgtgtcttcctacaaatggtgattcctgcccactgactgattcaatttcatttcggaagcaccaacagttaatgtgagattatccagttaaatagtggagggaagggagaacactgcatgagatcaaataaaataaaataggaccctcagagaggatacttaaactcaccctacaaagtttcagttgagggctcttaaaatgattggtttcaaagccttgtataaaacttacaaatgaaataatgagatctttttttacttagtgatgacaaggaatcaaaaagagcaagattttcaccccctgttaaatgaaaagatacagcagcaagtatgaatatgagcttctgtaaatagctccttccatattccctttcagcatgacacatctctccccagttagttaaataataaaaaaatggtgcaagaaatttccatcagaggtgaagtagggcattagaaaggtcactacaccaaaacaaaggtcaggggtgagcaggacacaactctaatttggtgggagcatcacttaatctttctatatgttaatttcctgaagctgaaaatagcagatgtatctaaccgacagataagtagtaaagtaaaacagatgtgaaaaatcaggacgatatataatgtgaagggataatattactccctaaattctagaaactgctatttccacttaaattcaagtaacttcctttgtaacctaaagatttcaaagcatttaataggaagcataagataagccctaaaggattgtcaatcagtaataaaacaaattaacatggaaaaccatatgaggatcctttacagcctttcctataaccaacacataggaagagtgtgtagactttgagttcactccaaaatagctttgcaaactagtaccaaaacttaatcagcttcccaccccaatacatatcttcatcctcctaagctttacccaaagtaaaaggaatgtagtaattgcatgaataatttcttcatcccatttattgcctaagtgtgcacacaaaactgaataacattaaaaagtaattcaacatgtatagtcaaggtcagttttgcaaagcaagatacacctgacccaaaagttgttgagctttgcacatgggggactgcttattcggagacactgaggatgggaggagcagacaggaagaaaaaagagttgaggatccccttaaaataaagtatacatcattttctattttgtttgcccaatcttccattattaaataaaagaacattatgttccttttataactaaaataagcagttgtagattattttaaaactttacctgattttatggtatcatgtatttaatggctaatataaaacaaaaatgaatttatttttgttatagttatcaaaaattacatatccatcttcaagacagtattctaagtttgtttgttttcagagttctgtgacagggctcagcagttcctaaaagtgctgaaaacaaagtggtagatgatcttgaacttgatggttgtgaggtccttaaaaaacaatactgcgtttttaatggggttacatagggtgaggaactaaagagcttttgctttccctgcatgtttctcactttgaagttaggaaagcagctcagtctgactgagctaggttgtgggtaaagaacttgccaggtttttacaaatgaaagcaaatgcttagaagtagaattaaaagccaatgtacaataaactgttagtgttaactgatgccagccctgatccgcactcaaaaagtgcagtgtgaaccattcaaagcgacacttttctcctttcagaaggagaggcctacacaccaagtagcagagctggaaacattagcacatctcgctcagaattcactggttgggatttgtctcatgcatctcagagacaggcagattttgaagctggaaggtgcgtcacaaaaccccctgtatcagaccatggggtcagagccgaacaccatgtttcatggaatcctcattcccacattatattaataaagaaaatttgtaaaaaaaaaaaatttccatggtcaaatatgtttgagaaattgagctgatcaagtttaaacgtttcttgggcctgtgagctttttttgaacagatagctattagatgatggctggatgttcatgttctatgggacacagtttgagagatagtaaataaaatattagtatccctggtttacagatgagggagtagaggcccatggagattatatcctagaaagtggagaacgcaggtctgcagcctcctagaaccaactcttcccagccagggcacagtcagaaatccaagaaagacaaactgcagccagagctctccgcaatgtgcataccctggaaatgtctcctcaaatgagtgcttttgagaaatacacacttttccttttctgattcagtcagaacatgtaggccctcccaaatcaaagtacctgatacaaaggcatgcagatgctatcaatccactccagttgcaaccgaggcagttcatccttccggttccgatcaaaaattgcctagaatggggggcaggaagaacctcgctttattacaccaaagtattttacagggtgctttgtcaaacactttgctagaatgatccattttttttacaaactgaacccttcgcaaatcacaatcaatctttacacatactttcttttcctttatctatgatgagaaataaaatgtttttacctctttttatgagatttgtaagcaaatttacttgaactttctagcgtgcaacttcttggggcaaaaacctgtcttcaaatataagtaactgctactaaatcaagtcatcaggtcactgcgaattgggtacaggtcaaggggaaaggaatatgttttactgccacaaaaataatgcaggcttttatttctgcattatgagaggttgggatagaataggacaaatcggaaaatatccttaaaagcaattttattgtaaatagaaaccatttatactaatttttctgggtaggggttgatttggcaattgcatatgtttttcagtaaggttctgtcattaataaatttttaaatatttatttatcattgtatggatgatggtgggtggactcattatctcttcattcccagcccttaagctttatgatgatataatgtttgagataatttaggtatatttttgggaaaaataaatgacatttttctgttgggcagacttaagggaaacaatcaattggaattttagtgttaaaattaattcactgaacaaacactgccaattctgtgccagtgagactgtctctccctttgttcttaaggagtcaggcccagaccagagaagctcccttgtgcccttacttatctagaagactgggctatctagttataacttgccctcccttaatgttatatagtaagttttatctttcctttacataaaatgtggcattcacattattttggtgtccttataggccatgagggtggagccaagcaatccctttggtccagagatgtaggaaaatcctgcatcgttcagatgtatgaacaagagtgggagtgggtggggcagaaatcactagctgccaaatctgaggaaaatatctccaaattggggagaaggtcactgattccaccaggcttttctcatccttgtcttgcaatggaagatgggaaatagcaggaaagaagactggaatttggagaaaattgtgaaaatgtgctggagagagggatagttcttgtgaataatatgagtcttgatccaaaatgtttctttagagctggctgcggtggctcatgcatgtaatcctagcactttgagaggttggggcaggaggatcacttgagcccaagagttcaagaccagcctggacaacagagtgaagcccctgtccctacaaaaaaaaaaaaaaaaaaaaattagccaactgtggtggcacacacttgtcgtctcagctactcaggaggctgaggtgaaaggattgcttaagcccaagatgtcgaggctgtattgagctacaatcatgtcgttgcattccagcctaggtgacagagtgagactcagtctcaaaaaaaaaataataataataaataaataaaataaaataaaataaaaataaagaaataaatacacaaaatgtttctttaaaaaatattattctgggctgggtgtggtggcttatgtctgtaattccagcactttttgaagccaaggagggaggatcacttgagatcaggagtttgagaccagcctggccaacatggcgaaaccctgtttctactaaaaatgcaaaaaattagctgggtgtggtggtgggcacctgtaatctcagctacctgggaggctaaggcaggagaataacttgaacctgggaggcagaggttgcagtgagccaaaattgtgccactgcactccagcctcggcgacagagcaagactccatctcaaaaaaaaaaaaaaaaaaattatgttttcttttctctatagttctgtctaaaattttcatatttatttaattattccatttctagtggatattataaagttacttttttaaaaaatgcagtggtttttagtatatttacaaagttgagcaactatcactacaattatagaacattattatcatcctcaaagaaaccccatactattagcagtcattctcgctttttttccgcactcccagccttaggcaaccactaatctactttctctatctatggatttgcttatcttgcacatttcatataaatgcaatcttatgatatgtggtcttttgtgacttggcctctttcactgttttcaaggtttacccatgtagcatgcatcagcacttcattcatttttattgccaaataatatttcattgtatagatgtcttatttatttgttcatcagttgattgacatttgagttgcttccaggatattatgaataatagctgtgaacattcacatacagtttttatgtggatgtatgttttcatttctcttggggatatacctagaggtagaatttctaagtcatatggtaactctgtttaactttttgaggaattgacaaactgtttttcaaaacagctgcaccattttacattcctgctaacaatgtatgagcttccaatttttccacagcctcacccaacacttgttattgtctgtcttttttgctatagctatcttagtggctgtgaagtgatatctcattgtggtttcagtttgcatttccctgatgactaatgattttgagcatcttttcatgtgctttgtggccatttacatattttctttggagatatgtctgttcagatcctttgcctatcttttaaattgagttatctttctattgttcagttataatagttctttttatcttccagatacttggcccataaaagatatatgatttgcaaatattttcccataatatgggaaaatttactttcttgatagtgtcctttgatccatgaaagtttttaattttgataaagttcaatttatttatttatttatttatttatttattttgagagagtcttgctctgtcacctgggctggagtgcagtggcacaacctgggctcactgcaacctctgcctcctgggttcaaacggttttcctgcctcagcctcccaagtagctggggttacaggtgcttgccaccacacctaatttttgtatttttagtagagtagaagtttcaccatgttggccaggctggtctcgaactcctgacctcaagtgatcaggccgcctcagcatcccaaagcgctgggattaaaggcgtgagccaccactcctggctgttcaatttaattttaatgaagctcaattcaacatctctggaccaacatctctgggtcattttgtcttttgtctcctgtgcttttggtttcatatttaagacaccatggctaacccctatccagaagatttatacctatattttcttctaagaattttatagttttagcccttacatttaggtgtatgatccattttgagtttatttcagggtatgctgagaggtagggagccaacttcattcttttgcctgtggatatgcagttgtccttgaaccattgttgaaaagacattatcttggcacccatgctgcagattagttgaccataattttaggggatttattattgtactagtcacttcttaatcaatgcttgatgagaaaaaaaatgagtgtgaggccccacacagtcctgtgcttcacagcattttgcatctcataaaataagtattagtaatcatttatttcatgtctatatttcccaccagttgacaagatccttgagggcagggaagatggtgtcttactcattgctggaaacaaggtgccttgcttcatgcccgacacatggaggcactcaggcaggctttcctaactgactcactgcttccaatcctgaccctctggctgtgggccagattagcctttgtctccatgaagtgactcccatgactcctgggaccatgatacctgagggggctccaggacagttttcctcctaaatatcaagggataatgggcacagcagctgtcagctctgggtgcatgcatttacagatatttctggaaaagaactgagggctaaccctgccacatcagccaggcctcccctgaggagatggtcatcagtggtgctccgtagtctttgtgagaagacaggagcatttagagctatgtttctaccgcaaaattaatttcatttatgtctacagaaaatgccttacctgagcctacagataaaggctccttagtgctgcgctactgcacccaccagctcaccagtgctggcaatttactcatatttttttcatttaattaaatgacctgtggtattgctgcattgtaaacccttcagagtatgcctctgaaacagtttttaaagggggaaaagcttttatttgaaagtagatatgacagaatttgggtcatactaggttttatacattaactgtatgtatcccaagctaatatttttatttttataaccaaatttgatgacaccaccaaaaaagggatgttttgagaaactaagtcaatgttgctttgaaaactcaaataattgttgtgtgtgtttcaacctatgtagcctcctgatcttttgtacataagcaaccaattaagaatattcaaaattagcaagactgtgcgttctgacttcaagcagatgaaactattcaaactaggagctagttctcttgcttttccttgtttttaaatgtcagcaaagaaggatgtcttaaaacttgaagaccttataaatacctccaaatgttcaagctcagttaatttgggttctcataaacagacattcttgacaattgataccttccttgagtatcactaaatctactgtgctatgctaggctttaaaatgctttgcaccactctcagagtcattgggttatatgtttttagctaatcattggttagtaataaagaggctgcccctcttgaggtggtgactgacgcagttatgtcttctgcatccttatgcttaaaaacagcatcatcttgagcgtaaagtaaacattcttaagtaataactgagcagataagtccaatataaatagcgttcaaatcaccagaacctagttccccaggtgaaactttttcattttacagacaaaagaaacagagatttgaaatgatttgcttttgggattttgaaagttggaaattggaaaataaaatctagcttctcaaagctagaaagccttcctttaatttttgatgcacagtgtttctattctaaagtaggcatacatgaaatgccagcactgggctttgaattattcaaactccactttgctcatcctccctcgtgcctacttgtcccactgtgggtgcgcaggaaatgcttgttaagtagctcaccactcttaatcagaaacttgggaataagagtgtttagcatttgagtttaattaaggttttaaactttcaggagtgcttccttaaacccattttcagtctttcccatttccaacttgtaatttggagttctttttgaaaatgtcattcaaaagggtaaatacgttataattaaaggatgaactcactgaaggagtgagtttgagctctaatctctcccgatctccttgttcgaagaactcactggttacaagttctgccacctgaaacatataaatattttaatctgtgattatgtgtagtttatcacgagactcagaagttctttcttgcttatgtatttggtgatcctcatcaacacaatcatttaaaaagcttatgaggaagtaagtatattaacctttcatgtttgaaggtgttatagaacttaatgaaactgatttccttttaatcaggacaacttgtgcaatgtaattttagatgcatgccaacaggcaatctgccacagtacggcttccatatttgggatgaggcaacaggttgccagcttcaaagcaggaaaagttcttatacagaaaagtgaagcaaatattcatttaataataatgtgtaattattattatattatgtaatgatagtttagccactttttattatttctatgtagattatttattttgttgcatacttttatgttagcccagcttcaatttgccacatgaaaactcctcaactccctccctaccaatatttgtatgcactctgggagggataaccccagggcacatcctctgcttcctactgttgcaatcaatcaagaggcaggactaatgccagattcactgttcatagcagacttttacagtaggtcacggtatagtttgaagagcatgacttggtcttcaggctgtctggatctacgcactaaaagtgttaatttatggtaggctctacttggtacaaggacaatgggatgcttgttctacctgaaaccttaaatagagacttatatttttctacttttaatccattagcttggatggtcagcagctactgattattgccaagctaaacagatttttttttttcttttccacaccttcacttctcaggatagtgtgtgggaagcaaattgatatgacagattaaatgttgaatggctattttcaacgctactacagtgtgcatctaggacatttctgagatgaactagctggatttaaaaaaatattggaagagtagaataaatcccagacaacttcatggtaagagggcatggataccaaacaaatttttctctattccaagttcttatgaagataaggttcttaaatctggcaaagatgagacagtttaattttggtcaagtgcacagtatcaagataatttaactccgttgatctctcaagagatttgctcaatcacagattatagataaaactgaaacacaatgctaaactcacacacacacatctgagagtagcatgtgtgcagtcacatataaagaaatcaaatatccagtaagttcagatttctatatttctgttaagaaacatgggcccctttcaagatcaaccacaaaaaactagttggaactgactgaaaaatccccttcaccccagcctcttgtatatgtgcctgttttctaggactcaattcacttgtctcctctccagtctctcctgctaccctgcatttcagcacaccaggcttctctcttctttctctggccttcctttgaagaggaaatggtcccctaagggtatgacctcatttattcagttcccagaactctccctcagattgctctaagctaggtcttttgcattaaagaatgtaaatgtgcacatcaggcgcctcaaggtgggagtcctgcataggtctgtagcccctggaaagaaaagaaattaaaacaaaattctgtcgttgctctttctcaagtacttgttggtatctcccctgtgctcctttcacagcttaacttgcacaactgctttgttggtacttaaaaacccaatcaggaacattaagtggttactgattgaattttttattaaagaaggaaattgagatgctaatcaggccttgggggaatcactggggaaacccacatgcttagagtcttgttgcaggaagggaaagtggaatagaccccagcagaaaacattctgaaagggaattttaaaaaatcaacatccaggaagttagagaaatattttttaaagaagggcctattgttttctccaaatgtttcctaaaattttgaagtgagcattaaaaaaaaaaaaatttaacccatcaatttggagacaaacaagaatgagattgctagcttagaactgtgacaagctttccgatggaaacattaggaaaaacacggttttgtgttttatttccctgagctcttatgtttctgcacttttcaacagaaactcacatccagaaaataaaataatatttacactagtgaccgagaagaccacctacaagcagctactgggcctcccaagtcggcctaaaatatcaaggcagaaatttttttccttgcaagtactttgccctgtcactttcctgttccctggggctactgctccttgagtccttgacatgcgtttcactgtggtttctgaaggtgctggcacatcatacctcaccccattccctttctgctcttctctagttttctctcagtcctcctaacttcctcacactctccacctccttccatccctattacaggagcctcccccagtactacactttttcccaatacctggaagagcctcctacctcttccctgcagtctactcaccaactctcccagaagggaggccttcccacatgggaaaggggagggggtaagatgaacagtgggcagagatgtggaaagaagctagtcaaccacacaaattcttcacaattatcctgctttatgtgactttttgtaacttcaaatatgtcacactgaaatttaaaccaaagcacaattggtgaaatactctattggaaaactgcctgatgtacattggacagtgtgagcaagaaataaacctttatttgtgttgaacaactggaatttaagaatatacttgttactgaaccaaggcctagcctagccttgactaatacaaaaattggtacggaagtgaggtgctgctgttagaaaagaagagaaagacagaaaaagaccctaaaatatgtgtcatcagcttgggggccaggtatcaagatagtgaggaggctataaggatgagaatccatggcaaaataatttgtacaattataactaaaagctaacaatgttctgaataaacttacagtcttcggagatgagattagaaaacaaaatgttagtagcatgtgatgattgccattgactgttttgcgaggaattacaggaagtgagttagaaaaggaggaacaggcttataaccaggaatgaaaggaaatggaaatagtcgcaaattcagggacttgtagggatggaagataaaattgcttctcaattccaaactatgaaaatgaaaattgcgatacactttgacgaagtttgattaggactcagctttgtaacaagaatcaaataaaagacatctagagttagaatctgaatgaattaggtagtttgcagcatatccttctagctggacaaaaatggctcgattaaatgatttacctatatggttctctcactgaagcctgttaggcccaaggcactaggaattaagtcagaagagagaaagaaataaatatatttgccacatttctttattcctaaatgtaaagaagcaaataaatacagaaaatctaagatgtttgtatggaatgtggatgtggttatgggcaaatggaaaggacttgaatcaaaaacataaaaagctgactaaacgtacaagagagttttggtgccaaagaaacgctaagcccatgattacacaaaacaagtgttgggacttcaaccttctttaggtgagaagaaggcagtttgaccttcagataaagctaagaagggtgatgggaaaggaataatttcccagggaggattgaaaggtcaagggaaaaaggaaccagagaacatctcccagagaatcagggtcccctgcatggtagaacacctcacagtgagtacccagtgggattttggagttgccatggaccactcaccactccacattgctatgaatatcgctcatctcttccctttccgaatgggagtctttgggtgcatgttggactctgtattttgggtgtgtgtaggtctttaatctgcatccagatctgttgtagagactagcatgtatctcccagagatcctggacttaagagtttgatgccgtgactgatgggacatttgggttgtctttcttggaggaaggatgggtatattttgtctgctggagggagaatgaatcacatttttggtgatgagaagggtaaactctggtagtcatgcattcactatttctggctttctcctttctgagcaaatagaaggatggtacttcctggttgggtggggtcatgtgacaagttctggctgatgaattgttgcgggaagcatttaattgccagtgcaagaccttccagggcctctgtcagaatgatctaggtagtggctgttccttcagccccaatacagaataaggacaaagtggcgcctgccaaccctaggtgcccatgttcgtgagcaatttgttgtttaaagccactaagatcttgggtaaaatgataacatagcctattctgtggatacgcttgcatcatttaaaaatgctgactgatgcatcatgtgaaggaacccataacacactgctaagaatgaaagctttggagcctaatctgctagaatctatacctagctctgccacctacaagctgtttaaactcaggctgcttatcctttctaagcctcatttttcccatttgtgaaatggggataataaccatattagtttcctaaggctgctgtaaattaccataaagttagtggccaaaacgacaggagtgtattctgtcatagttctggaggccgggagttctacatcagttcactgggcagaaattgaggtgtcagcagggatgtgctccctctggaggctcttggacagaattcgttccttgcctcttccagttttcctttgctcacggctgcatcactgcaatctctgccttgtcttcacattgccttcttctgagtgtgtaatttccccctgctccctcttataaggacatttgttattggatttagggcacacctggataatctaggatcagtctgcagctgagatgcttaatcacatttgcaaagatactctttcctttcacggtaatgtttacaggttccagagattaggacctgatatctttgggtggccattattcagctgactacaattttaaggattaaatgagatagtatatataaagcagtcaataaatattagttatttattgatatggaaatgcatcttattttccctaaaacgtcaagtctttagatgccaagttactgttctggaccccacacagtaggtgcatcataaaacgcacataacgattaacctctaaataccatcagtaatccctggtcttcagttgggtagttacttaaattgaaaactattcttatagaactaatgctttatggcagagaaatcagataggtggtaaaggcatggtttgtttttctgcaagttaaattggatactgcatattttgaccacagaggtttctgatatctaaataatatttaaaaagaaaaatataatttcctttttgcctccttttattttcagatattaaaaaaaaagaaaacaagactttgtactgagatgtgattatcttgccaaaaatcctatctttgaaactcttgccttaatggtcaatgtattattcagatttcgcacattaaaaatatcttacagagtcagaaatactattgcttagtgaaagcacgataaaaaaaaaaaaaaagggctgtgcaataaactgtgtcgtgcctaagcctcctgctattttttacaccatgttaatactgatgcaaattgactagggtttcagtgcctggtagtcagggctctgggaatattgtgtcccccttacgccccccagtccctcctctgctgagccctgccattaatcaccacttgcctgtctggagatctcccacggtttggtcacggctccaaggtcacaggctgtcattaacattgatctgaaaaacagaaccaaacaaaacagcctgaataatcttttgttgcattcctaaacaaacccgtcctagatacataaataaataaaataaaatggaaacgaggccagctcacatcttcctttcctcaacaaggggcagcactgtttatagtccctgtgttcagcatctccatcatgtggccacgctgcttaggaagacaaagctctcacacatcctctggtggcccttttgttttgtctgcagcaaatcaaggaaagcaaagcactactttctgtacacctgagctaagcaagctctgcttaaaataatttataatggacaatgttgttgggtttttttaaactataagcaagagaatcagtatataacactatatacatggctgatgaaactacttaccaacttatcattgattgatgggaacaaaagaaaacccacaccaaagaggcaaggcacatgccacataaggggctccttcattttcatctgctctacagagctaagatttatgggcaagagctgtatcatttcactccagtttactacctggctccaacaatggtttataagcattatgaagaagaaacatactcagctccagctctcattaatttgggcacataagaaagcacaggaatggtctgaatcagagttttgaggggcagggttaaccataattcatacggaaccatggaaacactgggaacaattcaaattgtagatagctctggtgcttatatataatttaatgtggtgggaggaggaaaaataaggcacactctgtcccaaatctgctttctttgtgctgataaccagcagaatgtgatgaaaagtaacataggatttgagctggggaaccacatcttggctaactgcttttggaagaaaggggtatgcaaccaaaggtcagagggctgtcctgatgtcggtgttaacatttcataccctgccagatctaatgccttggaaacatgtctgctgcccagatggcagagcatgcttagatggcaggggggtccccccacaggaaacccctccagggaacaaggcagggtcacagataacaataggtcattcaaggcacaaccaggtggcaccggcatcagcagccctctcaactcgagcagcattgatgaaacctctaattccaaacatccctgtgttaagaactacgcaaagggagacacatcagtctattcatttttgaccttctgtatcaggcatttctacactgcttactgtgtgtctgcttctgtactaagtgctttactaaccaactgctaactaaactactaactaaatgaatcgtcatcaccaccccagaggtagttgctattatccttattttacagataagtaaacagaagcacacagagattaagtcattttcccttcccaaggtgagtaaatgattcaggattctgtgcctatcacaaagctaccagatgccctcttactacacatggatgctgacagtactggagggggacaagactggctaaagcattggatttctcagcatctctcctgcatagcaaataatctctatgaggttgcctatttgtatcataatgtggataattacttaggttctgtccagttgataatttgaaactttctcttcaaatgcatattgccattaatcagttgatcaacaagtttattgagtatctgctaggtcctcagatgataattctaatagctaccacttattgggaagtctccacagggtgactgactcagtctctatatgtggtagtgatactattattatctcttattaaagttaaaaaaataaggctcagaaacgttaggtaacttgcacaaggttgtacagttattaagtgtcaaagctgggattggaatcctttgtctgacagaagaatctctacttcaatgaatacagtggagcaagaagtccatgcagagaagggagacaggacaggctgagaggtaggacgggtagagtggctgcaacctttgtccatctggcactggggagtcaactaagcctggggactcaggagggacctggatagacctttagggaggaaactttaggtggtggatgtgaggatggtttgaagaaggagagggtggaaggaaggagactcattggagatgtaaattgataggagcctaaaacaaggaagggagagtgggaagggaggcacagggatggaagattgcaaaggaagaactgaagaaaacaaatgagcagttctatgttattttttagattaaggctcttcaagaagtgaaagatctttttgagagtaaaagaccagggagagagtttttactaactgttttagactgaggtccctataattctagttcagtttatagtgagttaacatacctctcctctatatgccaaaattatttcaataataatcttgtgacaatcattatcttcttgatttgttctgtagttgtaaaacaatttaaaatgaacaaattttaatgttaaagatatattcaaattgagtacaaagattttgtgtagactgaaatctgcacttgcctaacaaaaatatgacactttgcagtttgcacttatttcagttttaaattttaaccatgaataaaacccacgaatgatcacataaaatgacagaatgaaagtatctcaagttgtatgtcttcatctttaccatcaccgtgctatcattgtttgttctgaatatagtctttaaaagcaggaatatgagttctgcaaggttagaaacacaaacgacacccagagagtttgagaggttctaaatggttaggaacttactattgaaagtgtatagctgcatctacctatgtcaagagccagctgtatgcctgggcattcttagaattaacttacattacgtgtgcaaagaaaggataaataataaacatgtgcttatttgaagctttcatatcaattatttttatcttaacagtaacctcagcaattgtttggaatttataccaataaaagacatttcttaggaggtatatctcaccattgactatttagaattgctggcacatggtggtaataaaaagcagactgacttttagttggttttattactattttaaaattctctacagatggtgctcccttagagcaccacccttggtgcaaggtggtcagagtgtaaccatgaaatgggggagggagggcagatgaggggagaggggagaacccagagcacctccattttatgtaacatgcttccaaataagatatttcttccatatggggttccttgtcaaaacagtttgaaaatctctgtaggaaaatatctaggcagagaaactcagaaatggcatttcaggaaaagagctcagaagagaggcaagcccaagaaaagggctgggagtcatttgagaagagatagtagtgacactagaaggatgctgaggaaaaagagaagagaataaaaaatacatccttgggggacagttctgtttagtggatggtggggggaagaagggctagaaaagactaagaaggaaagagtcagaaataaaggagagaatccagaagcgtatatggctttgcagaatccaaggctgtagagggttttaagaaaagagaggccaacacaattaggggctataaagagatcaggaagctgaagagaacaaaggttgtagcttttaatacttggaaggtgactgtggttcaacagaagcagaaatcacatagtacagacttaattcctcagtaaggaatgggtaaatactctgtggtatatctgtattttggaatactgtgcaacgataaaagatgatgaggtaaaaacatgtaaagaattccaaagcatgtagttgagtggaaaaccatgttcacattggtatgtaaatatacaatttatgttaaaatagacaatcaaaatacacactaaacagtatttttcctaagggtgcatgtgtatgtaaatgctttggaaatggtctggaaaaacacaatacactaataacaaaatacagctgtgcaaccagtatgggaattgggggttgagctcaaaggagatctgggggcttattagcaatgtttgatttgttacagaaaatatatattcatataattactcatggcattaaaaattatacaaaaagaaagaaattgccttgcaagaaattaggaagtgtgggagtaaagggaaggagaaaactatgatggggtctggagaaaaggcagcctgtagggatgactttttgattggggaggcagaagtgtgtttttaggtctagaaaggtcatgattaataaaacagattttgaaaatggaagctgaaggagcatgattgatagagccaggttggggtaaggggcgaggaggtggaaggaatggaattagggcaccagtggaggggctggtcttgaagatgaaaaatgaagaaaaaggcctgtaaagataatacagaggaatattaaagcatagaggaaaaaaactagagccctctggggagagggctgcaggaaggtgacatgaggacagctacagagggtggggcaggcagtggcctgtgttcagaagatggtgccagagattttatatagcagatacggcaggactatgtcaaggtttccgcttggggtaatccagtagttgcctggttgtggagcagacccagtgtgccctaaccctggcctcacgagctctcccagcaaaacttagcaatgttagaacagggataagacagcagaaggtctggttgaggtggagagagtagaaggatggggtatgagagaaagaggaatagtgcccactctctggagtggctgcaagagaggctaaaatttgccccataaacagagtgggttgctactgtcctttctaaacaacttggaagacgtcccaggcaaaggctagaacagactccttatctccacctccaatattgttctgactggttttctatccgcaatgcctattgtctctaaagaaaagcaaaagttactccccacttcctttgtgctatgtaactctgatttctaggatgcaaaaatcccttctccacccaacttgcacccccacttccccaggaaacagaagaaatcatggcttgccaaaactgaactaatttgaacttcattttctaattttgatggcagatttttgagacaaaaataaattataagatgaaaagacattctcagtaatttctttaattattcaactgatctctgaatgttttgaatgtaagctaagatttgttactttaaaaatcacttctatgctcttagtactgtcagaaaatttatgtggactaaatgtccaaataatgaagaaacacataaacaagagctttttcttaccgaaatatatcacgatggtttttgatgttccaatcgtattctcctttactgacaagttcaaagaattcagttctcctcctgcaggaaaatcaaatgaagaaagaaagaaaaaaaaaactggaatgagatttcccagtctgtggggtgacataaacacatctatgggaaaaacataagaccacttgaaccaagtaacttaatatttgaaatcatgaggctaaagcactatcaaaataaatcactttctaaaaaatgttgaggcttcaaggaaaagccacaatcatttctgaatgtatttacaacagaggagattatagagccataaaacagaaaacaatgtggtgcggcatttaggattatgtgctgtgaagccctagtgatacttactgaaagtcagagaaaggaggcaaggacaaataaaaagtggggacaattctagaatgttcttttatcatccaacaaagaattgagctgcatgatgatccaagataagataaactccctggtagtaaattcaagataaatatatttttttccaggttagaaaataactatttcaccatttcagtgcttaaacgcataggctatgaagtctgaaagtaacggtgtttaaacactcgctcagcaactcgctttggaaagttaattaaatcctctgagtctcaatttcttaatctctaacacgggggtttcagttgctaactcacagagttactgtgaggattaaatgaatgacatgtggaaagcatgtagcatagtgtctcaacattttaagtgcttgacactataaaccaaaaataaaattctaagcccccaaccaaataaatggccttctgctcttggccaagggcattcctaaattaacctgaaatgctagtacaggccatgatgggaagtgggagttggacatgtctcattattccttcctcccttttggaattcaggtacagctgaccagcattaacattaaaacagagaccttaagactgacaaagcagacactttgtagcaataagatatcaacatgacagacagcaggccctaaaagaaatcaaagtattttatcccaaaatatatttatttgacatattttgaaatggccttgcaaagctgtctcttttggagaaaatctacattctgtagagaatccccttccctttccaggtccttttcctaatccaggggagaattaagtaagagcttggcaccttttaaagtctgataagaaacatttacaatttattctggaaggctgctacctggaggcttcatctgcataacaaaaacattggtctccacaaccccttatcttaacccagacactcccttctattgattccaggtctttagatagaccctttcaactaactgccaatcaggaaatctttgaatccacctatgacctggaagccactccccacttcaagatgttccgcctttcctgactgaaccagtacatcatacatgtattgattgatgtcttatgtctccctaaaacatataaaaccaagctgtagcccagccgccttgggcctatgttctcaggacttgctgagtctatgtcacaggcatgtccttaacctcagcaaaataaacttctaaattgattaagtcctgtcacagacactttttggtttacaactcacacatacacccatggaaatccatttggagatgcgtagatacggaaaagacaagcaaggaatattttagttagatgattttcagttttagtgagaaaaggaaaaaaagaggacatcaccattttgatttaagaatcacttcccaagttttcatcctcttggcacttgctaatgagagaatatttaagagatcctaacacaccatttcccaaaacgcatctctcaaaatgctagacttaagaggtgctccatgtgaagatgttcctgccaagtaggtttgagaaatgctgcccttaatatacctctcttggagacaccatctatattagcctttgaagtctctgagaaatatggacgtagaaaagcctgtttaaccttatttcatcacaaaattccacatagtactgatgtttcaaaaactacactttggaaaataccatcatgacatataatttatggtagaaatcagacatatttggaaaataccatcatgacatataatttatggtagaaatcagactaggatctcagaaacttagtgctgaccctctgtactgggggacaaaggacaagaggttgagaacaactggctcctctgtgtctggcctggggtgcttatcaccaactgaccaactgtgtggatttcttgccaatgggtcagactaactactaaaattacttgaaaggagacaggtcaggaagacaaatgtatagttcacttctgtattagagacacaaagacaggtcctggatctatcctttcaagatgatgcaggtcaaggccatactacatacagcatggaagaatctccaagacaaccttacggcaactggcgagatggcataacccaattacacagaagggcccaggaactccttctactttgggtgggcaggtgtatacagttcttttcttcatataactttcttatcttcttcacttgacccattcccttcttcatgaccaatggtcgtgcctttttcatattactgagatagccaagtaaaacgagctccccggagaatctccaacccgcctgcgcattgggaggatgggtgaggcctccggaagtttgcgctgtttgcagtagggaggagcctggccccttctgttcctgtgtgggaacctgggattcagtctgtgagatgggggcctgttaacaggaacctctcttgctttgctgagtctttttcctttttgcccaataaattccataacctctcacccttcaaagtgtctgcttgcctaatcttttctggtcgtgtgacaagaacccagtttattctacaacattacagtcactgactgtgaagtgaaatagaaagggaagtggtggagtggaaagagcccaggtttggacccacaccgacctggcttaatgctgactgtcacttattagctgtgtgatcttgggtgagtaatttcacattgctgagccttagtttccagctttgtagtgagaaattgagataaggtgcactaaacatttggccctgttagatactcaatacctgaagctatggttaatttgtaaacaatattaatactattactgccaacaataatacaaattggactaactggactaatggagatctaacagtttgcccagttttctcctctcactacatagaaattcatctttttttcaaattattatgaagtccaacaagtatttattgaacatctactctgtaacaagtctttattaggctttacggtcacatgataattgggtgttacttttaaatgtctctgagtttagccagggctaccaacaaataaataggtaattccctctttaaatgtaatattaatgagaataataatattgggactagagtgatgtgagagaggcactcacctggggcacaaaactgaagtgggtgccaaaaaacttagttatcaagataaatattttaatgtgatatttaacaaaataaaaataaatgtaaaacatccataatgaacacaacaacaaaattctaaataaagacaagatctgaacttgtacttgaaccactcacctcacttgcttcaccctagttccagccctgatgaggatgatattcactgggtctttactgtgttcctggcagacttaatggggtctggcactcactacttacatgactgaccttgagtaggttacttaaccttgctggacttcagttttcttattagtaaaagagttatagtaatgggatctgccttgtagggttgatgggaggatcaaaggaaatgatttatgtaaaacatttagcagattgcctggcaaaattaggttatcagtaaggattagttactgtgattaagctcagaagggtgagtacctggctcaaggtttcacagatggtgagtggcagagctgggatacaaacacagtaggttaaaataacagctgccccaagcagctaagatacatccagggtgtccttggagcacagaggaaggcactttgcttggctgggaggatcctggaggattgtgaaagactttctgaaagtttgtcagccatcctccttgtcatatgttcctgggtggccatttcaattctatgagttattccaagaaatcgctagaattaagcttcatgaggacaaaggcttggcccacttttgttcacttctgccccttaatacctacaacaatgcctgacatgtagtagaagctcaataaatatttgttgatgaatgaatgagaatgattatcttagaaagctaatcattaaacaaacaaactctttaaacactggtttcacctagatcctaatttttctaggggcttcacagttgccatttggagagagagattgaggtaagtaaacaacacaaaatctattcaggaaaagccctgtcagattcttgcagagtagattctaacatgaaccaaatgggcaacataacaagttgtagaaagtaagaacaccatttccatccaatatctgactcaccttccactaacgattgttatatctgcccatagtatgttcactatagggaacataacatctttgatgcagagtgaaagcatgttccctgtgtgactaactcattgcagaaaacaaatcctttttttctcttttttttgtttttttgagacggagtttcgctcttgttgagtaggctggagtgcaatgtcgcgatcttggctcactggttctgaggcgcaatctgcctcctgggttctcctgggttcaagcgattctctgcctcagcctcccaagtagctgggattacaggcatgcaccaccaggcctggctaattttgtatttttagtagagatggggtttctccatgttggtcaggccagtctcgaactccagacctcaggtcatccacctgcctcggcctcccatagtgctgggattacaggtgtgagccatcgtgctggcccaaattcctttctataaaaaatgcaaatctatgatatgaaaatcaaacagcatcataagaataaattccccaatgatagaaattttaacagctagagttgctggtgtgaaggtcttaaatcaacagaatcaaaatcagtcatagacttcacatcacattagcaacactaggacaaaagggaacatccagtattcctagggaacagtgagaggagccttttcattgggtatatcaaaacgtagcatgctaatttgattcttccttcacagacaaaaggatggctacttcgtgataagttctatttactctgtcgtcccaaggtttgattatgttcttaagagagattaggaatctttctggataataggaatcatgaggaactcatcaacttgtataattttgtcaagaaaaacatgagaggccaggtatagtgggtcacgcctgtaatcccagtgctttggggggccaagggaggaggattgctcaatcccagtagttggagaccagccttagcaacaaagtgggattccgtctctagaaaaaatacaaaaattagctacatgtggaggcacacgcctgtagtcccagctgctagggaggctgaggtgggaggatagattgagcctgggaagtcaaggctgcagtgagctgtgatcacaccactgcactccagcctgggcgacagagtgagacgttgtttcaaaaaagaaaaaaaaggaaaagaaaggtgtagtcactggtggaaccatgtataacacatctggtaatgtatttggtcacatataaaatagccaaagagatattttaaagtttaaaccaaagtacatgtaaattttttttttttttttttttttttttttggagatggagtttcattcttgttgcccaggctggaatgcaatggtgcgatcttggcttactgcaacctctgcctcctgggttcaagtgattctcctgcctcagcctcagcctcctgagtaattgggattacaggtgcctgccaccatgctcagctaatttttttaatttttagtagagatggtgttttgctatgttggccaggctgatcttgaactcctgacctcaggtaatccactcacctcggcctcccagagtgctgggattacaggcatgagccattgtgcctggccacatttaaatttttttaaagttcctgaaaaaaatccttcttgaaagctcaggagatagagttaatcattttcacaaggctacaaaaaggattttgaagtgatgatatggcaagatcatgtaataaatttattgtgcatatttaataaacgtaaaaggtataaaaattacacagtggacatacatagagtttccatctacctccctgcctagaagtaagtctctgccagtcctgttgaggccctgtgcacctcccaactgttgcttctgtcttcttcccactcaccatacaatgaccattttctaaattgtgtataaagcatcatcacatatatccttataattttactaggcaaattttgtataatattgctctatgtgttttaaaagtttatacaaatacggtcatcatagtgtatgtattctctggcaacttgctttttccattcaatgcttgcgagagttacccatgttgttatatataattctaggccattccttcatactgatgtatgctatttccatctattattataccactgtctatttacccatttcctggaagatgaaaatttatatttttctaatatttcttgctattacatacaatgcagctatgaaccaccttgtacatgtttccttgtgaatttgtgtgagttctctctctctgtgtatatgaatatgtacatgtatatgtaaaattgctgggtcatagaatgacttcttttctatgtttgaattttcattatagttatagactggtagggctgtatggaacttttgagaaaaatctcctattaattctctcattttataggtgaggaaactcaaggtgaaggaaggtgaagtgacttgttcaaggtcccagggcagttacagaaagatttattgttgccaataaaaattactaccgtggtatttgccagctgatgatttttccatttccacctttccatgtgtgttaattgaaatcttctataaggaagaacttttccttctgggtagattataagtccccagcctcccggttctgccctctgagataatctttgtaaactatgtgtagcataaacctttgggccagatagcttttcatgttgtaagtgtatggacagtggggccagcagccctcatgctatgtaacagcatcacaggctgctgtaccaaggcaataccaagtatcaaggcagacacagacagggttctttccatcatcaataagggggtgctccaaagaagagctgcagattgcttgtgccaggttggtggttcacagctccaggtgatgtatttctgaccttctccctagtaataatcattacaaagtaacaatgtgaaattcactgtgcttttgggaacaagtttgcctatacagctgttctgttagcatctaaatgtacatgtgtatatagattaaacagagtaaacagcatgaacatatgtgaaactgttagaaacaggggcatttttagaagcatgaggctgctaaaaagaatatttgaaaatccacaaaaatacccaatacccgctggatccagacttctttgtcatgaggaactgtatcattaacttctcacgcagatcatggggaaccttggttttcaaggacaatggcaagtacctcagctagtgaaaagcaacttactggaaaatctcatttataatcagatatgtttttattaggctttcatcctgctcgcctgacatatgtcccactcagaaaaatagcagtctttaaaaaagcatcatttgaacagaacggctaaaattaccttcaaaaataattctaaagattggttaccagtcacccatcaccacattgaaaaactttctggtttgtaatttatctgcaaggcatcttttatttgtaaagtgagaaatcaccatttctgtgaacattttaatcatgaaattttttgcaaatttatgtatctatacatgtacttaggaatatatattctttatctattcatctaactcctttgaatctactgaaagtccataaacattaggaaggttttactgctgaggtggcaaatcatcactgtaactctcctcaatttctttctttttgtttttttatttgagatggagtttcactcttgttgcccaggctggagtgcaatggcgtgatctcggctcaccgcaacctcctcctctcgggttcaagagattctcctgcctcagcctcctgagtagctgggattacaggcatgcaccaccacgcccagctaattttgtatttttagtagagacggggtttctccatgttggtcaggctagtctcgaactcctgacctcaggtgatccacctgccttgttctcccaaagtgctgggattacaggcgtgagccactgtccccggcctgtaactctcctcaattttaactccagagttgtcaggcaggggttgcagggtgcacagatgtgtggatgcggtgagtgggtgcttttggtcttcttacagcttgctcaacaggcaaatcatacatctgcaattaattgttacatgcagattctagagagatttctggactttctttgcatacaaacattgaagaggaatagaaaattaatatacagatgttaactccagttattatgactaaagaaaaaaagtgttctatttaattttgaagtgaactttctccctgcttcagactagcactgataatacaagggcctgccaagaacctgagtgaatgacttgtttgatgctgtgcttttgttgatggcacaaataaaaccggcaaaatgcaggaagtagagataagaattactctagatgttgaaaatggcagaagattagagaccacaaggccccagcagtcagttcattcaaaccacaatcaccaggcaaagaagctgtgtaagccatggctagaaggagcgcactccagctgctcctgcattcacttccacacagcccttcgctgctagatgttgctgccttctctcttccccactgggctctgagtccctgaaggtaagaaccgtgtcctatctgcttgtacattaccagcaactagcacagtgcctggcacaaagaaaccattaagaagtgctatttggctacatttctcattttttagtcagttttgatatcatatggatggggatatggaatgagtatatggaaaaattctttgaaatatgtcaagaattaccaaaatatttcctccatcaacctactacaggggctgctgacctaatgttataataatatataatttcaatgagttaagtcatcaggctctgttaaaatataataatgtttgggatagagtaatggcttaagttttgtcagtcattaacaccttattactaatcagtttactttcatcctttccagtatggggttggttgagcgcaggcaactgtggaagttgaggacactgaacatagctggcttttaataaacttttgttgaatgatgaatgaatgtttgcctagcagtagaaacatttgttgagttcccactgtaatttttttaaatgaattgtctagatattaatctaatttttaaaagaattggtcaaactatcacattgaacaatttaaaatagtttagtgcatttttctgtcatcatcagatgctttcgagaaatgctatttactgcatccctttcgagagacaaatacaaagaaaccatcagactgggcattttccataattgctgatgagtgtagatcacaaagagaggtggcaaattttcaatttgaagataagtctgattaatttaggaagccgatcttaaaagcattgagcacccaagtggatttatctgaattattggaaaattatttgcttaaatcatgctctgaggcattgtgtcatggagaactgatcacagacaacttagtgactttggacaaattactcaacctctataagcccagttttccctatttatcagatggggctaacaatatctaccttgcacattgatatgataattcagtatcaaaaagttattttgagaactcattatgtcaggcagtgtgtcaggttttgtgggttccaagagtgagctaaagagtaaggtgtctgcattcatagagcttccatttcagtgctgatacaggaagatactgtaatgcctagaatggtgctgggcatggagcaggcacctagaggatgagatatagcgttatgtaatcacaacctgttgaggatcagtgctaaactgtttattgctacccaatagcaacaacccctgtgactgtattaaagctacagaattttcaacccctggtgcaccaacttagctcaacttcacacaagaagcctctaattgcagtcttagccccaccagactgggtccgagtatcactgacttggagcctccacatccaccctgcactcccagtggtggggcctggcattagctgaattgctaacacttagcatgctaacacaaagtgtgtttggaactagctttagacatttgcatcctcaaatttctgctgtttctaatgcccaaatgtttcctggattggccccagtttccccttgagtactcttggactgctatataactgcagagtaactaagaacattttggagtccaactacttggttcaaattccagatatactatttaatattgtgagcaatttactgaatcactccaaacctcagtttcctcatgtgtactgtggggttaatgagaaaagaaaaaacagctcagagcagtctgagctccttgaaggcccagagagtaatgagtatgggacttcagtcacgctccccactcccctaacccatgcttgggggccactgttgaaagtcattttgtttctgactagctacctcacccactatcttcatgttcctagaatttgtgatacaagagacaatgtaacaaagccaatcaatagcttatgttatgttaatgtaaattcttggtaaacaatgtagaaaatacctttcctttccttttgaaaatccacttgtaactgctgctaattggactgtatatttaaggcaacttgaatccatgctccggggttgcagtcctcaatcttggctcaaataaactctctacttatattaattttgccacagtttctttcttttaggttgacattaataatagtacctattttaataggactgctttcactgttgaatggcataatgtatatataaaggtcctaagtaagcactcaaaaagtattagttgttgtttttattactaatagtggaaggtgcataggtcatctttgttgatttacatgcagataaatagtacagggcatttgtatcatccctttgaagttataacatttgtaattttagatctctctgcccactccaacaagcatcatcttttatggtgcatgttttattaagttttctggctgagtgattcctttttttataaggtactttacattgtcaaagctctttcataaaattaatctcttttcactgccacaaggatcctaggagattagaatgggtgatatgcctatacccctgttgctgacaaggaaactgaggcaaagagagatccgactctcaaagctggtgaaattactacttaattatcaaatccttattcactgcagggactcagaaacaggcacagaaatcatttcagaaagttgctcagcagtaactggaaaacgttttcagtgagttggaaaatcagagtgaatcattaacccccaggctcaggttgtgaaacttagaaattcacattaaggattttgtttgtttttgtattttaatcttgtgaattctgctttcatatgccatttgaatgacatagaatcccaaggacacacaaggtctttagaaattaaagtcataagtttttgtggatgttttgaaagcctttccacatttccatgaatctcatatatttttttccttttagagcatggcaagaaatcttgcctctaggaatgagtcagaaacctgtctccaaaaggcagggctctaccctgcccagcctggccctttcctagagtgactttctccctctaggggaggaaagcagtgagcttcctttttggtttcttcaactgtatcatgacttttaggttgagtagtcagggcagaagaaccaacaataatccagacttccagaaactaattgtacggggagcctaatatcctcttggctcacccacccctctcctgccattgctgctacacgcagtgcctcagcggtcctgcggatcacatactttctgccctggcacttcacacatgacttcatgtgtgagaacagggatgagacagctgcaggaatgcccagtcatcaggcacacacaacatggaagtacatgagagttaacatcccacagatcaacatttggttgatgaggatggtgggtggcggacaattttgaagtgcgatatatgagacttctcagatggtccctgcaggatcaagactggctgaccatagtggagaacaacaaagaaatgtgtccttcctttcactggcttccctccttccccatttcactgtcccagcccctcactcttattcttggtgtcatttccaaaactaaactacctgaatgcaagcctttatctccaactttgctttgggagaggacacaggggcctcaagctagtgtttaaactgattacagaacacctggaaagagtcaacattatcacataatatatccccaattaaaatgacaatgatttcttgattcttccattagagagggaagcatggtgattgaagaaaaagccctgaaagaggaggtgtgggttccagttttaccaataatgagttatgtgacctaagctacgctatttaaccatttggacctctgtgcctgatcagcaaaaaaggagatgaattggattgcatcatttctaagatccttccgattccacaattgcacatttattaaataaaaacatcggggcgacagtttgtagtagctgctttccctctcattataactctagggattgttctggctaaaaatatggcaatattttaatgcaactttagacaggcaagtgaatcaatcctctgaaagtctagattagagaatgggcagctattcagaacctcaaaaaacaataatgctgatgaaaagagaacaagccagcttctttgggagtcagcaaacattagcaggggctgcagcattaagataagaacagagtaatgagaaaacgagttgcaaccaacttcgttgactgcatgccagtggtcactcagtgattcgtcaaatccctaacagagcttgataaatggactctgagtgttgatatttttttttctctctttagaagttacttggaaagatggcttgggaaaattcttctactttgaggaaaataacacaagatcctgcaagtgtcagggacaggcaataaaacattaaaaggatacagactttccataaatcccaaatcaaggagcattaatccagaaaatagatgaaagatcatgatatttaagtcaaccaaagggccacaaaacatgcaaaataaataggttataaagcaaatgaggttgtagatgtcaccatttctaagacatgacataggtactgttatctccattttatacttgaaagaaaggctcagagaagtaaataatttatctgatgacacacagctaattagtggcagagctgggattttaatttttaagtatatattttaaactaattaaaattatatttatcaaagtaatacatgaacatagttaacaaatcaaatagtactaaaagagatacaatgaaatatagcagtgttttctattttgctggcttttgtccttggcctgtgtttcctaatgctttcatttgattttttttattttggctatcatgttcttaatttttgaaagtgccttctttttcatagttgctcctactactatttttaaaaagcatcctgttcttgtttcatggatgcaatatcttagctctctgagaattctaacaacagtttttagttttgttttcttcctctccctgttttctctgaatttcattttttttttctgtttgtttggcctctgtctttcctatcggatgctgaaaaaatgttctgtgattcttggttttctgcatgtaatagtaaggtattaaaaagctaaatgggagttgtgtgtggggggggaggggtataattgctagataaaataatttgtttccgttaaaaataattattttaaaaatattttattgatacataatatttatacatatttattgggtacatatgacattttgttacatgcacagaatgtgccatgatcaagtaagggtatttaggatatctgtcaccttgaatatttatcatttctatttgttaggaacatttcaagtcctctcttgtagctattctgaaatatacaaaaaataatttttagtataaatatgtcccaaatgtttcatgggacatctaactatctattctaaaaaagtatttattgtttatctgaaatttaaatgtaactggactttctgtacttctacttgctaaatctgacaaccctgggtgtatggcttatagactcctagcttctaagtgcttggctatggcctacaggttttcaatccagagactggttccacttaacttaatctcttcttctgagcactgtatctcattcccaccctgtgcctctcctcagttcagagctcttcattttatttctccagaggatacatttctggccttctaaaggtagaataaggggagtgacctggctgtgttagtagaggacttcctgggtgctaagcattctatatactgattttctagcaatctctttgagcttttcgtgtcttaagctttgaacatcccttacaattgaacctaattctaactgatgcaatgccacagtgcttttcaaagggagtcatttcaaagcgaatggcacaagacttcctagaaaaagtgacagaagagacagatcttaaaggatggtcagtcaggaagatggcgagtggaggaacaggattcgatgtgggaatggtgatacatcagggcacagggggcattacacagggtgttccaaagggtaatgcgtagactagtctggttgacgtagaccaatcatgtaggggagaagtggaaggtaagaatgaaaaaaggttgggggcagattatagagggccttgaaagtcaaaccaagtttagaacttcctttgaaagcaatgtggacactgaaggtttttgagatggaagctggaggtctacagtgtgaggaagtttggagtgaagaatttcagagtcttctacacacaggtcataacataaatataggtaacatagaaatgaggccaggggagtggtctgagtagagaaagaagaacatgtttcaagagcttatacacaggagcaaggagaaaagaaacctgccaaggatctagaaaagaagagagaaaggcagctggagattgggcaagcaaggagagtagaaattaataataactaactaaaccttcagatatctcagagaagatggaaactatcaaaaatgagtacaggccattgaatttgaggaaagaaatgtctctggtgacctctgagtgtacaattttgatagagtgcggagatggactctgctcttcacggtgtaaatgggtgttaggaaaatagaggtactaaatgtgctctgtttatttaaaaaggtagacagtaaaagaaaggtaaataaaaaagcaattaaagatctccatggggtcaaatgaaaaatttttttaagggagtgacaggctttggtctttaagataggagaaaattgtgcaaatgagtggtggaagaaatttccaggctgctaagagagatggcgcctgatagagcaggtcccactggaaatgggagggtgcaatttccagcttagagaaaggcctgaactttggtgaaaaggagagaaagcccttctaagaaagagatagaaaagaatcaaggaatgaactgttgcattgctagttaattttccatcactgaatatttttcatcttcgttatcaatgccattatacagctgaccagaagttaacagtcttaaatagcaatattagctaggatctaagataaaaatggccatcacttagtttcagagttgtgtgtcaaacaagctcataaaacagaagaaaaatagaaatcttgtgactgtagtcctgactctcttggcttatacacaccactttaatggacttcatttatatcagagagaaacaacaacaaaaaaagtttagctggtttacacattgatatcaatgctagaataacaggtaacctccagtgtagacctggagattagttacaggatggaacttccatttgtcaaacagatcaaatgccaatacctactcaaagtacagcgtgaggtctgttgccaatattgactgcttcaaaagctgcataaggtcactatattccttggaggacaggttagcaaagatattgtgaccctgtaatgagaaagtaaaaagtcacaaaagacattaaatctgtggttgttgattacatgtttttcctctatttaaaaaaaagtctgggaacattaaaaaaatcactttttaaaaagcatagtgaaattttgtataaatataaacagattctctggcaaacctagcaaagccagaatgcagtcatttttgacaaagtctaacaagggacactttgttacatgcttagtctcaaagggaaaatctgaaattgttggaacttatcttactatgaatatgttgtgcccacaattccatctgactacccatttcctatggaattacttagaggagaagtttgtgaaacatttgggaacatttctccccctaaaataaatgctattttcactaccagtgaaggtttaagctggcattttggaaacacttgctatggcaacaaatgactttaagaagaataaaaagccattagaacagtggttctcagctgggggccgttttgacaatggggaactttagcaaggtctagtgacatttttgattgtcacaaatggctaaggtgctactggcatctagcagtggaggccagggatgctgctacacatcccatgatgcacaggagacccccacaacaaagatttactggcccaacacgtcactgctgctgaagcggaggaaccgtgcctcccaccattaaggtgcactttgatgaagtgtgtggcaggctaaattcagtatggtgaatatgaataattctgaatagctaggatgcataagacatcgttcttggcacagtgggactctaaaatgacgtttacctaagtaaagttaggatgacatctttatcctcatacctttgacaggtacccttgttttcatcaaaatttgtgttagctacacttaggctaaaatatttgtctttagtaaagtgaaaaatccttctgtaaagtgaccaacaattcacttagtttgtttttaaagtcaggacttttcattttttaggttttcttagtgtgaaatatgaactcatgagcatctggcctgggaactggaccagttttaaatctcgtgttgagagccggaagatgctggagaaggaatgtggtggaatgactgcctgagaatgaaccattctccagtgagaggtaaattaattatttcagggaactaggatatcaactagcaaattacgtcttaccaggcaccagatgattatctgtttccccaagttaatttatttcattgggtgaacccgccactccttaaagactagagtatattggttctacctgggaccaggtccaatattaataataattttcaaatgagctcttcagacccttaattcagctgttaagaagaagacaaataacgaaaggaatgctgcaccataattctgcccaggtttttttgcctgtgcattacccaatgatcaatcacaggcaggtgttctggggccagagaaaaagtggtaggaagctatggaaaagcagtcacctgggtccagcgatgcacccagaatctcccaaagaaacacagcatttaagagcaagttacagtaaaagttaacattgagatatgaagaaatctggtctgaatttgaggatgtggattattttatgaggatgtgtgttttattacagtcatgcatcacataacaggagggtacattccaagaaatacattgttaggtgatctcctcattgtgtgaacatcacagaaagcacttacacaaaactagatgatacagcctactgcatacctaggctatatgggatagcctattgcttctaggctatacatccatacatcatattactgtctgtaacactgtgagcaactgtaacgcaatggttggtatttgtatatctaaacctatttaaacatagaaaaggtacagtaaaaatatggcattataatcttatgggaccaccgtcgcaccaatgtggtctcttgttgatcaaaacatgttgcatgtgactgtactttgaaggatatataatcactaatgctatttacagctaagagtgacagtgctagccagaaaaagttaatttgcaatcagtttattgtttatatgcaaattagtcttctattttcacgttatgtgccttaacgttttggtccctgaagtagatttgagtctccctgaaatactgcatctactctttgtttagggaggtggtgagtgtggtgttaatggaaagacatgcagatctggaggaagaaaggtctgggcaaacttcctcaagctatctaacttctctgcaccagagctcatttggaaagtggaacaataatagcacctgcatttctgcctttctgatgggcaggaccacaggggactggaggcagtgctgggacagtgcatggttccgtcattgatagtctctgttcttcatagggaaccccagagtgaaggacggccaatgtgttttgtttgcatgaacacaaattctgagtgagtggggtttgtttccctgaggaaacctgacatcctgtttataatacttgttattacaaaggtggtggtttgtcagaggtgtatactcatcacctttaccaacacagaaaagatagtttgaaccaaagttcttccatagttctcagctaagacactgtttttggagggcaattccacagccacagaggccaggatgctggcttctgccagttactgagagcctaactcttggtgtttaattcccaactgaaaatacatcattcccagcaggttttccctttcgcagtctgcattcaggttctggagtgccaactctcctttatggggtcgaaggcctccatgatattgcaaaagacatgctttctcaagataggctggaggtaaaaaacctccatatttaatgatgctattctagtgaagcagggccttaatgatgataataataataataattaatggcacagctagagaactgacaaataatggggaacagatgatcccttcctggcctcaaaaaaaaaaaaaaaagtctgtacgcttgcagaaaatgaaacagatcctttcctggcaatttaaaactcagatgccgcagccagactcagttagtggtttctgtttttctctgtggagagctaaaagtataaaattccaactacttctaactcctgcattgccacatgaagcaaaatcaggcatatggcattagctctgggtcttaagtttagctgcagttctcacttcctaactggtcccaccagcaattttaagttcttttaagttgtatagtttctcaattgtgctaatgaagtgtaactttctcactctgtttttgcttctaccatcttttaaaatgactgagagttttaccaaatgggaatgttgggccgctcattatttggatcaagttgttcccttagtgctctgtatcctttgaggaaggtcaggtcatgctctggtgacaagcagtctatatctgttaccctgctaagtgaatctgaaaagcctcctaaccaataatgaaatccaagtaaatcagctcaggaagactctgcaaggtcctgctcaggcatctataggaacagaaaaagctactaaggcccattaagttgacttagaaatggttttcccactgctttgtgtctacctgtggcaccacaaaggaagagagggaggaaacaaagagttgttttggtttctgttaaggggagaagcagaacatcaggcctgtacctcactttgaaggatcatcacggcgtggttgaaatggtgatgctccaaggtagcagaggttccatagagttgggccagggcagagccactcctgaaagaggacagagggtgagtgagcagggcctatcgatggttcccccacaccagctttttggatcaaactgcttttcttgcttttggcaaaggaccatgagcagacacatccttaggtaactgcttttgtagtccattcatctatgaaataaatcgttcaggaactttctatatataagaaagttcctaatacatagaactttctatgtattaggctagatgctgcaaatgatatttgatgaatttgacacagtctctgcccctaagaaatttacagactagtaagaaagatgagatgagataacaaggaaaaataatgcacataaaaacaatgcaaatactaatcactgtagaaatgtgttccaggtccaatcgaagtgctatggacgttctgaggaaaaaaagacataatttctggctccggggatcagggaagcttcatgaactaaaccttctgtgacttctgagtgttcagaacaactgtcttatacaaaacgtatttgaccttccataggagaagaccttgtgaatattctgcagagtgcattttatctactctacatgaaaggctgacagccttctactacagctttccagtccatagtcacactgtgatatctcagtgtggaactctgaaaagttctctggatttggagggaaatctcagctcttcctccaagtagtagctttggacggttacttggcctttttaagactcagtttctttgtctctaagattatattatctacctaacctgttatttatgagaacaataaaatatttgaaaatgcctattacagttcccagcatgtagtagattgtagtctgtattaattattaatcaataattgaaacacatatgactatttccattttaaattagttaaatactcattgatacttaaagggattactttgagttatctgtaaatttcatttatgtagaacaacccattccttaacaatgtcagttctgcaaagcgttcattacttgggagtctgaggcaggagaatcactcgaaactgggaagcagaggttgcagtgagctgagaccatgccattgcaccccagcctgggcgacagagtgagactccgtctcaaaaaaaaaaaaaaagttcaaaaaggttcgtgtccaactctgtttaagaaatgggagttagagcatcttaagaatcaagagacatcccagagaagcccacagtgtaaacggcagccatgggactcaggataaggatccatctagatcattttgttctttcttgcttattgcagggggcttcgatattgaaagggcaatttggccttaacttggaaatgctggagattgattgcatacaatctgtcctgctagtgagagaagcaaggactgcatctaagtgcaacatgaagacttttggtcccaagctttcctccaacttcagtgggaggcagcccaaaaccaccgtcggttcaagaatacaagtgacctgcaattcttggaaagactcccccaattcttctcccaatatgtggtcagcttttccagcaggattaggttcggtaggaattattgaatataatataatataatgtaaaatatcggaattatttttcttaggtgcttagtaaggagggtattagattttaatcatatatgtgttatttctttaaatcttgccttaatttatattatttaataagtgaagatttgctaggcgaatcttagtgataaattaatacttaatgttagttactatttgtcttacatagagttcatttctatgaagacacgtgtttcaaaacgtatactatatgcctttgtcttggctgttgaaattctgtgatgctttatatgcatatcacatcctagagcctggcatagagtaagtgctttaaaaaatattggttgcttgtctaataagcttacagtagttactatgtcgagagattacagttcaagttgggaggttgataataagtgtgttagcatattttataatactaatattattattaataaagctaccattagtatctaccatgcggtagtctatatattaacaacttaatacattatagcatttagtcctgacaatgaccatgatataagtattattttctcatttacacatgaggaaaacagggctcagagaagttaagtaacttttccaaggtcacacagctagcttgtaccagttccagatttgaatccaagtttttaagcttcttgttacataatgaaaatgataattataacatacatttctgacatttgattctccatttttactaagctgattgttatcaatgaaagaagatttcaaaatctaattcagaattctattagtatcattgctaaccacaggctgattcctgtgatcattcctatgaatcagccatgctcacatgcacctcacttactagtgtgaatcttttgtatctagtcaagatacaaaatgttatctcttcccttattcatgttgggttaacagactccacaaaagctgcatcagctagatgatcagaagtcactctgtatcttctttgttttggtgaataaggaatgttttctcctttaagggagtggggatggggacgataacaacagcttttaacaaatacaccatggcttctgaggcactgctccttcctgtgcgtaggatggaggcctctctcccatatccatatgtctccgatctggtgtgttctatctcccagtatttgtgcaaaggcagccactgtctatggtttgaccatcttcctcgtcagattccctctttgttctcttttgtaattccatcttactttctgcccagcctcacacaatactgattcaatcacagaaaataggtagattttgccactgaaccagactaatgccatgaaagtgtggggagactttgttattcattcattcatctatcattcattcaaccaataagcattgataactattatgtcaggccccaggcatgtggaatacaaagagaaataagacatgttctgaccttcaggaagctcacaatcccctataattgtgtcaggaatttttctctgatcaaccttgcactaaaaatgctcacttttctgcaaacaaggtgccatcttagccctcagagaatggagcatggtactaactcaactttgaggggtttttttaaagtaaaaccatctaagcaagaatacttccatttccaaatggatcccttatttacactattagatttggcccctggcagattttctagactgccaaagccctcagtgccttttgtctcaggccaaggcccattaggaatgctgcctgtatctgctgttacacactgggaacttcctgggaccaccaagagccaagtctacagtcttgatataagtggcaaaaaaaataaataaataaaacatatctgtgaagataagctttatcaaaaagtattctacagaatactagttcttctgaatgttaaatggcattaagagaagaagtaaaaagggttccgtggccaaataagtttggaaaatgctggctttaaaaagtgaatctgtttatttatggtaaggattttccagaggcggcaatatgtgaaaatgcattgtgattttgtgggaggggaacataacaagcagcattatctacttttaattgattgtgaaacctctttttttttgagacggaatctcgcctgtcacccaggctggagtgcaatggcgcgatgttggcttactgcaacctccacctcctgggttcaagcgactctcttgcctcagcctcccaagtagctgggattacagacatgcaccaccacgcttagctaattttttgtatctttagtaaaggcaaagtttcaccatgttggccaggctggtctcgaactcctgaccttgtgatctgcccgcctcggcctcccaaagtgatgggattataggcatgagccactgtgcctggctgattgtaaaaccatttttaaagaggtcatgtctctcacataatacacttccacttataaaggtatgcttctactttctcacataaaatatgaaaaaaaaaccctgagatcaatcacatatggaaaaaattgactttaacagcacacctcattttaattgtttgtgctaagtatatccatcatataagtgtctttggggcacacatcctttagttgtgaaaatatgattatatatacatagggtgtatggagagaggaagagaagagaatccaaattccataagtacaaatacctttatacatgtaagtattcatgatgtgcattattgatggtaggtcatcttaacatactaaagcttttcattttggataggcagctcaatgaggagaaacttattaaaaagaaaagtcaaggtggaaatttccctataggcatttggcactttgcacaggcaccaaaaatgtgtgcaaatgtaaatgtaccttcataacttccctagatatgcatattctttgaaaaagagactgaatggcagtgtgcagctgtgacttaaaggaaactttaaaaaggaaaactatgaaaggtaattaggaaattgagagttgttgggagatggtgaggaatgggattaggctgtcatggcagattaatgtgccccagtatttcacttctgggacctggccgaaagcgacaagatgggttttcattcccaagaaatgagtataagagattatgctagaaatgaatagaagaagtctcctaggagaatatactacaaagctgcttggtactgatatttaatcatcaggggcagctgtaatagagagaaggatgagtggggaacgctgtccctagagaaaacaggggagaggtgtgaacagagcaatttcaaagcactgtggtattgctgccctctctacctattgatcattcattgtatgcactccaatacttaaaaattaagaacaaaatatgaaaatgcgaaggatcacttgtcagaaaggctaagagaataaatcaaattgtgctctaacgaaagccacactttttattgtagaggcattttgcattttatatagtaatttgtcccttgctaaatgtctcctgtttttttatagccttatatatgaaaaaaaggtagcatatactttgctgcataataattggtgcatttaaatcccattttcaaatcacttcaaagactagaattcgactgggagcactttaagagaagggatgtttgctatatctctttatttctcccacaattcctagcacagcatcttgaatatagaaaatactcacttactgggaaataaaaaacaagaaaagaagataggtttcttgcaagggattttctcaacaatggcacactcactgaataaatctcattctaatcaataaaaaggtagttccttgaccatgatgctaaaaagcctctttcagcattcatcgtcaagggaaatcttaacggaggttgggtaatggtggcattaagtgtcctaagtgcaaaaatgactccataaggtaggtgcagtgcccctgacatcccatgagctgataaactgcgtacaaagttaattgtcttgagaaaaacgcatcacactaccttggaataggcagatttgatcatgtgatgtgaggatgcaaaaaaactctctgaaatctagtactagtgactcaatacctacctcatatgtgtgaatgttgttcagtcttatacaagcaacctgagatttggggacctcggtttttgtttttttttgtaaaattgaggaagtgtaaaacatagctagtaaggtttactttggttttataatttttatggcttcatgtctttgaactgttggatgtcaaaatatattttagttcaagagctcacatatctggaaaggcagccaataaactggaagctcaacaactcaaaatagatgtcacaaagtcatggaccagagtgtgatacagtggttaaagaatggcttctgaaaacagacagccctggtccaggctccagtctaccacatgaatggatttgggcaagtttacttaccttcctgaggctcagttcctcctgtaaaatggagacaagaatatcaactctaaagagttgatgttggtaagggcttaagacacagtaaacaataaataaactgtagttcttctcattgtctcaggaagtgttagttgcaaagaacagaagtggagtacaaccagcttcactaaaaggaaggctgattgaatgataccaggaactctgaagtagcccaattttcacaagcatggctgggtctcctagaaataggaacaaggatggagagagccaggcatcaagcctgtcttttttctgtctttctctcaggttacacagtctctccgttctgcttctctttgaatatcagctccatccttctctcctctttgtagactggttttcttgtttttttcatccgcttggtatgtggtcatcatagcttttcccaaatggcagcctcagctcccaaatctgcatgagcctgcagcttggatccctgcagctaactgtcttaatatcacggtaatccaactccaaattcctgtgagataaaatccgatcggtccagctttgattaggtgtgcactgttggtcccaacagctgagggatcaactagcaagaagagcagcctctgtcagcgccatacaccagctctctctctggggaggggccattggtatctgagtataagtattgggcacttcactcttgaaagtactgaaaaggctctgactcttgttttacagacacaattctaacacagttatcccatctttctgcataagtggtagagtggtagggggctggagagagcatgctagagggagatacagtgatgatgataccattggcctgggggagagaggaatcctaaaaaagtaatgcagtgcagacacaagaactccaaacaaggagcaatcggaccctacaatgaaagcatacacaacgtacacaatgggctccagctgtttagtgcagcatcaagacaatgtataaaacaatgtttcattgcagctctattcacaatagcaaagacatggaatcctaaatgcccatcaatgacatttgattgaattttaaaaaatgtggtatatatacaccctggaacactatggaacactatgcacccataaaaaagaatgaggtcatgtcttttgcaggaacatggacagaactgaaggctattatccttagcaaactaatgcaggaacagaaaaccaaacgctacatgttctcaattacaagtgggagctaaatgatgagaacttatgaacacaaagaagaaaacaatagatactggggtctgtttgaggcaggagggagaagagcagaaaaggtaactatcaggtactgggcttaatacctgggtaatgaaataatatatatttaacaaacccccgttacacatggttacctatgtaacaaaccttcacatgtacccccaaacctaaaataaaagttaaaaacaaacaagcaatgttttataataatttataagaggttgcatctgttaaagaaatcaggaaactttgttaaagtgctgtagttaaagatatctcatccactcatgcagttatcctttgttcattcaccaaacatttattgtttattatgctcccccaagtactgtccatgcactgttgtacatgccaaataagaagggaagacacatctgcaagtcagcaattaaaatggcatgaagtgcacactttggaaaaggcacaaccagggcataggaaattgaccatgggggtacattagggtggatagaaacacgaaggtgatgctttcagaggagttttggggaaagaaggagagaagggcatgccaggcaggggaaacagcatattgggcagcagagagatgtgactgagcaggaccccaccagtgcttcttggagtccctgtgtctggaacatagatgcatgagtagggtgagctgcggcgagtgggcactgggccagggaaatgggcaggagtccgaatgaaaagggcccgaaggggctaagctaaggaactggaacactattctaaaagccacaggagatgtggatggcttttaagcaggggagtgacctggtcagctttgtgaattagaaagattattctggagtgccaagcagcctcgggaggagagtcgtgctgttcgttgtagcaaaccaggagtcatgccaagaagcagtccttgctgtaagcatgcagaggaggcactggctttgaggggagctgcagggtaggctgggtgactggcgcatttttggtggggccattccttggggtagagaatacaagaaagaggcatggagggaaagactgaggttgaggggactgtaggactttgaagaggaggtcttcctcaagcaatggaataagtgcctggagataagctgggaattatggttcaaagaaatgtattcagggctcatcagcagatggctggtggccctgcctgaaggatcgtgaagagtgagagaggaagagggagggcatcatcagtgaaggctggggcagagggacagaggcctgaaaccaacggagattcaaggttgtacaggtggatgaaaaccctttgtctgtgagataaaggaagagagagtttcaggaaggagggagcgacaaagtatatctcatggcaagaggtattatgaaagaaggacaacgaaaaggtccgacagctttgagaaaagggggccacgggtgtcattcctgaggtggtttctccaatgattggaaccggaagccatgtgggaggacaggggttgggagaagggaaggaagtgaacccagacagctttccatgaagcttgactgggaaggaaagaaggaaatagaactgaagctggagagtgaagtggggattagggtaggcttttttcaagatgcgggggagctgtttctattaataggatgcagacagccagcagaaagggacagcagatacaggagggagaggaagattgatggcacaaagtcccagaggagaagcaaggaagggtccaaggcagaggtggagggattagcctcggacgagggaaggacagccctcttaccgagataggagggaaggagggaaggatggggatggacagataagtttgtaggtggcaggggaggaaattgagagaattctcgattgatggcctcaattttctccgtgaagtaggaggcaaggtgatctgctgagtggtgcgggggaggcgggggagcaggaggtggttttggaagacacaagtttggtatatgaaactgctaagagcaatggggaatggggctggctagggacacagaaagactggcagcgagttctagcgtccagccaagtgggaggaatatatatttggtatgtctctaactctcacaactgtgacattttctcctaaagcttttataagtctaggcagagtagcaagagactgaattgttagactgaaccaggactgagtttctgcagagtggatgtcacagagacttggtcaggaaatgataggatattgagaagagagcactgaagtgatgggctataggatacagattggacagagggcacaaaattgaaattcatctgctagatcaggagtaaatacaagagtccaagactcctgaagtcttagtgggtagatgtttggaggaaaaaagagaatgatgagctgaaaagaacctgttgacaaagagcagactgtgaaagtttcagataatagaggctgacttgttctagaggctgtgaaatcagtcatctgaagttaatcttacctcttcgttgaggccttctctactttccctaccccaaaacttttctctccagcctctgaaagcctctgtcttttgtttgcaggcagacagtgaaagaaacattaacggcagactctcaatatacaagtcaggagacctgggttttggtcttatttctagcacccataagttctgtggccttggccacagtatgagccacaaagcaacagctatcttgaccaggaaaacctgcttagggacagattattctatctatacacatcatgtgtgtggcaaatagttgcccagacatccctgtatttctgtaattcctttgtttcttccacctttctatgggagtagggaatgggaggagcaaaaactatattccttgaacgtggctttattttactatagtttatataatacccaacatcaaaagaatcctggaagagactctgttggagaaggaaaactatattttgcttcatcaaatttcctaagactgcttttattttaacagtctcacaccagagtttgagagtagcaagtccaagaagcttataacgccataaaggcaaatattctgggaggaaaaaagtagaccctttaaaatccaagctttgttatctgagtaaggtcaacagagaccgaccaaatcaacaagcatgacatgaagggcaaatctgcaattaaaagaagaatagggaattataaagatggatgggccccatgacatgcacgcccaagcctgcatggccttggcctcggatgccagaaattaatgctttactctttagcattcgtcacctttggctctgaacagaaaggcaaatgcattaaaataacaacagtttagaacacttacttagcttggaaggcattgttggttcccctgtggtcgaggtcatgacacaggcatcccacaatcaccgctaaaatttccacctcggtcagaatgtcttgaaacccagcagtctgggaagaaggggaaaatggcaacagtcactactggggtacggaggatggataaggttaggtgctgagcaacagtcaactctgttttcatacccacatcatttaaggagatgattaactgccactccctcagacaacagtaagttgggtggtcagttgcacagcctaaggtccccacagtgatgaattagcttgctgtcacagcagcccacgctgccacactgggacatagttcagactattttgttccctttttagagagaaggttggactatccagagacagtgacagtttagcaaaggcccagggcaaaatgtgttttgttattatacattttaatgatgagcatagggtttggaggttggaggttggggaataggaaggggcagtgaattgcaaagtgaacactacacctgccagatcccacccaaatgagagcaggcagaaggagaacacaacccttctttttttttttttttttaacattaaaaggagacactttaacatactcaaattgttatacaatgacatcctagaggttatcttgtaaataccctaattcatattaggttggtagacagatgaaattcatacagataataaggcagtgcatgtcatggacaccagaatttgtcagaggattgtcaacccagactgaggattgagtggggtatccattactgggaattcttttttcttatcttgtggtagcttgctggtgaaatgcacagctgtgatgtgatttcttttagaagcaggttgacataattatgtaatcaacagcagcaatgcttcttgggttgctgctggccctttcattagtttagaagaggaagtggacctctgggaatgcaggtctatgcattttcttgatcgaaggcctttatatctccccctcttttactttgtaagtctcccatttcattacttattaaaatctttatcagagagtgggaggagggggaggattagggtacaaattgcttcacttttcatgtgtttttttccaccaaatctaggatcactggcccacacctgtaagacacttctcttagtaaaatgaaaattttgtttttaaattggttatgtttgtgttgcagaaataactgaataacaggtttctgtgttgacaattttattttttttttaggagacagtcttgttctatcacccaggctggagtgcaatggcaccatctcggcttactgcaacctctgcctcctgggttcaagtgattctcctgcctcagcttccccagtagctgggattacaggcacccaccaccacgcccagctaatttttgcatttttagtagagatggggtttcaccatattagtgaggctgggctcgaactcctgacatcaggtgatccacccatctcggcctctcaaaatgctgggattataggtgtgagcctccacgcctggctgacaattttattttaataaatagacttgggtccactgctacatttagaaatacatataacttcatttgtatagcaaatgggaatgttaataaattgggagtatgaaatagtccatgtcaaagcttgcatatgccggccaggcacggtggctcaaaattgtaatcccagcactttgggaggccgaggtgggtagatcaactgaggtcaggaattcgagaccagcctgatgaacatggcaaaaccccatctttactgaaaatacaaaaattagcctcgcttggtggcacgcgcctgtaatcccagctattcgtgaggctgaggcaggagaatcgcttgaaccgggagacagaggttgcagtgagcctgtatggcaccactgcactccagtctgagcgacagagcaagactccatctcaaacaaacaaacaaacaaacaaaaaagcttgtatatgcccttcattttaaaatctgcagttggctgttagtttttctaagttaattttattttacttaaattattacctgcagtaactaaaaaaattcaaattatactgagacttagaactaaaaatcagtagtccctcattattctcctttcttgattcctgaaggcaactactttctattttctttttcacctaaattcgtagttttcccaccatatttcttttcttttttcttttttttttttttttttttttttgagacggagtctctctctgtcgcccaggctggagtgcagtggcgcgatcttggctaactgcaagctccgcttcccaggttcatgccattctcctgcctcagcctcctgagtagctgggactacaggtgcccgccaccacgcccagctaattttttgtatttttagtagagatggggtttcactgtgttagccaggatggtctcgatctactgaccttgtgatccacctgcctcagcctcccaaagtgctgggattacaggcgtgagccactacgcccagccccccactatatttctatatagcatgcacatattattagcacttggttattcaccaagtactcatattgtcctttctatgtaccatacattgttctaagagctttacagccatttaacttatggagttctcataacagtcctgttaggtagaaactattactgtccccagttatagatgagaaaactgagtcacagagaggctaagtcatatgcccagggtctcccagctagtgcatagcagaagggagcaagctcctagcatcctttcaccagaatctgcccttgaacactggcgacgtctagcagcgggtgagtttatggtcaccctcccctcacactcccaatgtgatccacagagctttcctatattaccatcctataaatatcattcaccgctgagccaaccagtatacaatgattgtttccttaataatgtacattttcttgtttcctggagttaggatttctgtgaaacatctaagtcttctcacaccctacacaattctgcaaaatgcttctcaaagcaattttgaagtgggtcagaacggtcacagcttgtttctagatccttcctgtcctggggactccttcctgcagcctgaccctggggtctggtctggattctctcctctgctgccagcagccctcggagcttcctccaccgtcattcagggggttcctccttcccctcctgtgtctggttccccacctcctgcagcccatgcctttctttttcctcatttactccctcattttacaggagcacatctgcaggggcttcatgagaaaaggtcttactgtttttaaacactggaggagttggttgttttcgaggatttgcatgactgaaaaaacatctttattctattctcgtactcagtgtgcctcacaattctaggctgaaacattttcactcagaattttgaaggcctgctctattgtgttctagcttccaaagttgctttcgagaagaacataccattctcaatcctaatactttgaatgttatttgattttctttcttttagaatttcctctttatttctggtgttcagcaatttcacagagatatgctttgggttggaacttttttccccgttcaatttgtgtgttaagcctaatctggagaatcaatttcttcagcacaatgaagaaatttactaatctttttttcttttcttttttttttaaaataattttctcttcaggagtttttttctgccctatttgaatgaaactccaattagttggatactggacttctggtactgattttcttatctcctcttttctgtttcctatataggtctttcctcttactttccaggcataataatatgtttagtttataaaaattttcttgtttgctgctccttgtcttataatagcatgctattcttctcccatggatgcatgatcttttcttgtctttctgaagatattgattataattcttctgaaaatttcttctgttccccgtattgccttttttctctgaactccttcttttctctgtgtttggtggtttctctcaagtgtctgtctggtaacctttggtggtcttttcattcttaagagtaaagcatcacaaaactcactgtgcaccagtgtatgtgggtggtgcctggagattgctgtgtcttatcacggggtgactgtgtggccagctggtcttttgctggagatgcccaaatgtcaacatctaaactcattttctctggactttccaatctgttgcctgggaatggtgtaaacacgtgtgttggcatcctgagaaaagagaactgtagctgtccacctgtgaggatgtaggctttcacttaatcctcttattttgagtgtgcacctcatcctaactttgctttaggttgtgtacccaactctgggattcagtttttctggcaaatactctggttatggcagaggcagggggaaaagtagccctccagctacagagaggggatggagacttaggcactcattgtttccatcactccctcattccacatcacctaattttcatggtatctgaggcctccagttcctgagtctcgttaggtgctgggggtagcattatttcttatgggtaccccttcctccacaccctcacctctgaagacacttgggtttctcttctctgctaagttatgaactatcctcccttcactttctgccttcatgtgttatgagtccatgcaaggcaggatttgtgtacatttctttctctccgtattatttgaggatgatttttgagaaggggaggggggataaatgtattttgttgtcatctctatcatcttaaaactcaaaatgttgagtttggtcttgctaatactaggtaaaacttgaaaagtctatcaagtatgaaataattacctatgatactccagaaataagtgttgtgcaatgatattgtgctaaaatttagagagactttgcccatggaaaagctattgactagaattagctgatgaatcagagcagtaagttagagataatgttaaaataaggtaatttgactagaaatttaatcagtagttaaaatcaaatgccatctaatagatttgagatcaaaatccccagccatttttaagccatcagttatcacccattttataataagatggaacatattttgctaaaatgttccacacagtccctgtcccctgctctgcccagaaatctagcatcttggtcttaaactactggtatcatggatacttttaagaacataacagagccctagactctcttcctagaacattttctataattttataatatcaaagactatggagcctatctctagatcctcggagtagagaatccctgaagtacagcacccacacacagtcacacaaaacatatttacctctcccgacggtgatacctgagttactgaagcagcacctatctcttgactgtgatttaaagctgcctggtaaatggtttctgggagtcatcaggcctgaaaaatgcccacctgccactaagtgtccttttgcccctcccccgccctcatccatcttcctcccagggctatccattcaggcctgcacgtactgatattgagtagaaaaagtcaactgcctgctgaagacaatatactttcaaaagaaaacagagaggcggcaggaagtatattttaatgcatttaccccattcttgactctggtttattcttttattttcaaataaaattatatttttctgctcctgacccaatcattatgggttttattgagctttaatgttaatatatcttctcacctgtattccctcacagttcgtatcagaaataataagcagtaaatacaatatatctaagtaaagagtcagccagggcatataaacctatttcccatgtcaccccctccagcaaagcctttcacctgtcctctgagcaggcctccaatgatattccttcattgggctgaaatgtatactgggataagcctacccccagccactacggcatataataactagaactccaaaagacccaagccagtaagattgattctcagggtctcctggactacccagtaatttctatcattagccaatgtaaaatttaaatcagccaggatgtactctcattttaatgttgatcctgtatgataccagtgaatgggggaatatcatagccagagaaaaatgactgttactttgtgactctgttgaatccaaacaggtgtaaaaacacccataatatcaacactagatggtgctatagacaatttactaatttaagaagtgtcattaagtgcctattatatattgagcactgggtagatttgagaagaggcctgggataatgtcaacaacagttaacttttatagtgcttagtatatgccgggcattttcctaaatacttcacattcattagctcatttaatccttacaagaactctctgagacaggtaactgttcttatcttcccattttgtagatgaaaacattgaggcaccaggttacaagactacaaagtaagagaggtgggataaaagcccaggtagcctggctccccagtctgtgttcttacttactgtgctacacagcccctaagttgaggtgtgggttcagttgcacagcttttaaatcctattgtgatgatacagtgttagataatagggctgtaaagaatcccttggtgtgtgctttatttcacgaaggacgttattcttgagtaggaagagattgatactgcagagccattggatatttttagtttaaatatggctctgtcacatcaatatgtgcttgataatatacagtgctttataagtgaggtttggagagaaaagaaagatacaatagtttgtaatatctcaactttataaaatgtttaaatatatgtataggaaaaagactgttaagatgtatatcaagatattatcagtagtggaattacagttggcttaaattttttcctttgtgtctaaaatttccataaagaacatttgtttataagaacatctatatttatacacgtgtatgtatatttgtacattcttttttgtttcaagaattagcccacacttcatcaaactgtcccagcttgaaatgaaatagtgatattctaaaaagtgtccattcattcattgaacaaatatttattatttactgatttcctggcactaggaacagggcagtgaagaagacagccgccccttgctgcacatagaatctggttacccttcgagccagcagagcagtgccacagagcactgttttctaaagagaagctgtcataacattggttgtgctttgtggaagacagaactggtaggaatgtccagctcctcctgcttggtttctggaggaggtgcaccatggactgcacacccttgccatgtgtgcagtcctggctcagcaatctgagaaaatgatgccagaaattctgctctcacctttctttttgaacccaactatcggaagtattgaatgataagggatttcctgatgagttcatcctgttgattctgagatgtagcagatggcaaactaagacagagggaatctaatgatgtactagaaattcctaatggttgcagacaccctaaagctgaagacagtaggctccatatgctccaccatggattctgatgtccaggcactgcagcagagccctaggtggattggctaaggttgagggacaatatgatagattttggagagtctttcttcctcttcttcatctttctcactcttttggaaaagaagaggaaaaagtacggctcagacaattccaaggggttggagagacatggtttctcaaggaggtgcctcctctagaagagtctgcacaccatattcctaatctgtgtcatcgtgcctttgctgatctatagatggcttgaatttgaaggccttatgagcttggaacagaaaggcagtatttacagaagaagcatttaatttctggtattttaaaatttctggtacgtagagtgttgcagggtcactctctggggtctttgtttggtacattattaaaatcacatttatttcagccaaaaaagtgctctttgaaggtttcattgtaaatgccacaaacaagatgctcatatcatcttaacaacaaaaaaaaaggcccaatttgcaatgctgatggctggtccagctctgctgggtcatacttaacatgaagagtctgcttgtgaaacttacatctcctaatggaagctgatggttctataagaagggtgccttcaatcacccccaagttcagcacatatcccactcatgggtggatcacggtggtcagagaattgttagggcaatgttagggctccatgtgcatggacagcaaccccagtatgcttctttttgagaccctattttatttgctttgtgatggaatggcaaccactcaacatatagatcctaggggcagcctaatgggtatcaaactgttttatatgctccaaggcaataatattgagcagaggactatctcaagctttggagtggaagcagatttcaattgcttactaggagtgcttatgagtatttatactactggatgtcgcagcataccttctttttaaaaaaggatcttacctttgtcaatcagagacagtgtgtgatgaaagcataaggggaagaacaggtatgcaaccacaaacttcaatggaggggaaaaaatccctactgagcaaactatagcatctagatttagtggtcatactccctcggcatttacagtaaagtttgtctaccaataaatgggtctgctgaagagaaaagggggcaccttagccccattttgaggtccagagaccagaacctttccagctgatagggaatcaccatctaggaccaacaaactcacatgtctcctttaccagagtatgcaatgtaacaagccaattgcaggttgtctaattattcatgggaacgggatagttttgattgaatttgcttatctttcttttcaagatgaatgcaaccaaatattgatttggcattaattaactattgatttaggcctaactggtcctttccttaccaagctcagagttggaaaaaccttacagtctatatataaatgactttctttcccaaccagaagcttctgaaggcacttactatcaaatcataaaaccttagtcatgttttgggaatatgttgaccctttagcctcaactacggttgcaagtgcttgtgtatgtaagtctcagaaaggcaacacagtccagtacaattacatatgttgcgtagatgtttgatgcatacatttaaaaattggattaattttatatataactttattattatattctattacatttataaccacttctaaggcttaatttttaacctgtttattagcataaatttcaaattctttattttggagagttaaaaacatacaaaaaatagaataccattaatataatgaacccagtgcagtcattgcctaacttcagcaggaatccaggttttgcggcttgtttcatctgtctcttcacatgcagtgtgtgtttgttttgttttgtttgctagcgtatttcaaagcaaacctctggtatctgtcaacactatttcattctcaagaagtcctaatgtggtcaaataaaatttgctcaatatatttctgctgtcttattttgataaaatgtacaaaaagatatacaaataatataaggaaattttcaactaaataataagacttgagaaagtggaggtttctacatcaaaagataataaataaacatagctgtatgtatatagcacatataatgcattttaaaaggaaccaaaagaaaaatatcagattcttaaggacttagctttcaaccctaacaatatttgtgctttatgattttttttgaggacaaggacggtatgttttgtccatgtttagaaatataatttatattttatttctgataaattaccagtgaactgcatataatataacatatggtttatgaccacagaaaatgaagcagatcacttgctgcacattaattgtgtagaaagacagatctctcaaagtgccacagagcccaggttggtgaatttcaagaatttgaggcttcttcaaagctcaaatttttattagccataattcagccgaaactaaacttgagacccatgaaaatttaaaactttttatagctcccaacttaacacccttaggtgccaggtttcagtcccaagaaagtgccactaggaaatcatacaccgtggaaaatggaggctgtgataaatgaccatggctctgctgctgggtctccctgacctggaggatttggctggcgtcataaaacacaaagcgacagattaagcagtttaccaacatcataaaaatctcaagaataaattcactttaatcaaaaatcctatattgtaactaggcagccccagcctcgaaaccacatacatttacgtataagcctatgtccgtgagcaagaggttatactttccctgtaacgtcggacatgattatgttcatacacttttacaatttacatgtcctaagaaaaatacccagctctggctgatggtgcgggagaatttattttcactagaaagggaatgacccataactcatgaatggcagcgcttaaagtgagttatggaggttactctcctgtgagaggaaatggattggattatccttctgcccaattgtatgtttggttattagcacaccaggttcttaattatgtgcagctttgccttttttcttttataaaataaatgtggataaaggcaatgtcagctggaagcatggagtgcctaattggggctctgagatgcagtcagagagaagaaaaatagaaaccttttttaaatgattaaaagacaggagtcttaaatgtaatttaaacacagtattcaaattgattagccccatagttaatttattgtgtctggtgctgatgttctgcaaaaacatttaaaaattactccttttctaaattaaaaatttgccatcttgtaggttacatttgcatgaagattaaagagttggttattctatcatgtagattttattatagtattacaataatgctgccatttattttaaagtaaatataacaagttactacttttttgataaggaaatacaatgtaaaaatgatgtttgatgattacaaatatgattactgtttattaatttatttcagtcagttacagaacaaaacatctagatctctctgtaacttccagtgttacagtctacaaaggaatttgatttctgttgagattaggattctgattattgagtaaaaatattttatttaaaatttcaattggttctgtatttcttggacagggagggaggagtttcagctgtgcttctaagatcttccagaatgaattttctacctcaaaaatcaaggacttttctggaaactgcagtcagaggacagaacatcagcctcaagctggtaaataggatggattttctccctaaacatcccttctgctttctagtttgaattatcaataaaatggtttggcttatctctgaaaataaccttgttgacaacacaaatatggatttaaacacgctacctccacattaagatttaagaagcccccagtaaatgtcagggggtgtcaatgtgtttgctgtgatacttggttattattagtgtttaactgcaattccccaccagcgccacgctgcctgcaccaccataaattttaatgtgatcatgtgctcttctcttttcatatccagtgaattctgcaagatcataatattctatatgaaccctagctgaaccttagtgtgatatgaagaaagaacaagatttcaagcaataatagttgttcaccattttatagctttttttaactggacactgagcaacatggttccttgaataatattaccctaaactaaattcactcattcaattaatctttattgataccctacaggatgcagggcatggctcaaagtgctaatgagtacatttatgggatagtaaagaatactgactcttaaagaaatctttttttttccccttggaaaatctgtcagagctcatacatcatttataaaaccgaaaaaaatgtctctgcaaccttggcaccactacatgccttttattttacagaatacaaacaaaagcagagtcatttccgatatctagtctacatcgtgaatataagaaatatgtccctcatcttttatcatgtatttatagttataatttatttattatgtatgtgcatgatggaatatttgttctataaacttctattagtaaagaaaatttatatgatgatcattcatctgcaggttttcttcctcattttaaccacaaataataactgtcactacctactgtatttgtcagaggaattcaaagtatttgggaaattttaactatctaaatatctttttaaaaacaaagaataacattgaagctttcaaatttataaatgtgaaatttcagaccagaggcatggaacaaattaataagtcattaacagggttcccagtgaataaaatgttcatcattttatatcaatttgcctgtcctacacagtagttctttttttttttaatttctaaaggaacaaaaccgctttgttacctacacatgaacctgaatacttttgcaaaacacaatgctgagtcaataagtttattttccacccgtgaagtgattttagggttaaaggttaggaagctggggcatatatttataatttgcttgtcctgttgtacgtggtgccaaaatttgttcagcagtgacacacaactatgcatttccccattcccagagacaataggcttggaaaaatacacaatcacagatttaaggtcacacggagaacactattattcactttaacagcacggtatgcaaggtggcagtcataaaacaggcccatcctgatgggagatgctcttttccgacagactggttttgttgctatctcttttaggaaaaacatttattttgtggtggggtgtgtacctcagtattccctgtgctagaagaaaagaagcactttcaaggaaggtgggtaaggttttttcccccttttctggaaaccagctgagaaactttgccttggagcgccatctagaggaagcctcagcacacacacgctgtgctttcttagccttatgacatgacccaggttgaatccaatggttggtacatggtgagtttcttttcttttctttcttttttccccccagattaatagagaattttggttctaacacaacccacagacaggaaatatgagatcactggaatggaattttaatcactgataagatcaaaacattgaaaggcttttagaatcttcaggagtgccaaaagcatgagtgcccattggtggtaagaaatagggcatcattttaccataggccgagtcacattccagagatgagaattgatgagcgagttaaatttatttttagctacactgattgagtcgtctttgttacttctgtaattattttcttaattaaaaaattctgattaaccagattgaccagagtcaagcttggagaagatacttacgttagagagaaacaaatgttgacacttttaactgactgtaacccttagttaagttcaacaaaatttaatgagcagaaaatactatcttttccagatgtggctactcaatacaatgtgaaggagaacaaaataacgttgtattctttctgaagtcatgtttttgttttgtgatctcctccacccaccctccttagagaaatttgacaatgaagtctcctctttctgtgttagcatgaatgcaaaaaaacaaaacctaagccttctccaacaatgctgctcttcaagattgctgagcatacttgcaaaaacaactgtaccctggaaatattctgacgatatgagcatccccattgtggtgacatagtttaagaattctattctcttcaatttcttggaaaggatcaaaattgcccatataatggaaatacccactgcagaaaactggatatatatttccttttgctcctaagtgtccactgtgaccctgctgctcttgccagtttcccctattccaactattttaaggtttgttataaaaatctgtctctgtccttgacatttctaactcaaaaatgtcacagccatttctttttccttcattgaacagggttcctacttacttattttggcaattcgcataaatccataggttttcccaaataatgggttaaaaagttttttattgaatgtcctctgtgggccagacatatgaaatctgtacacaaaacattataccttgtttactgaggtaggatatggaaaaacaaaatgaagattttttttttccaagcaatggttgttacttgagctattaagcctcatggttcaaagcaccttcctttctcacttgatggctcactcctctaacggtggatgcaacagaagaatggaatcagtccagttttcccaggccagtctgcctgtttattaagcagttgaggacccaaagcacaagtccctagtataaaagacattctggccccatcttatgctagatgcacatttcagctcatgtcaattcaacatacattttttgaaaacccaccaagtacatgacagagtgcagggtgctggtgtgaccctcaataaatggtggttgagcaaataagtagatgctgttgaaaaaacaagaaatgatctcttccctcagcagcttactctataggaggatgacagatttgtaacttaaaatacacagtagcaagaaagatgtgttgtactagatacagtacagggaaagaagtaattattgatgatttgggagaaaggggaagactttgtagaaaaactggcactagatgaatgccttaaaggatgagtaaaattttaataggcagaaaatgaggcagagttttttttttttttttgagaaagaagcagaattgtctttgttcatttggaccaaaggaaaatgcatttcatttggcgttctgattttgtgtttaaattttagtctgggtgcaaaaatataaggtatttattttatgttggaagagtccaagactcacattctttttttttgtatggcaatatgtttacacacacccacagatatgtacgtacacatgtgtgtatatataactatgaagccaaagaaaccaacatatttaagccagaaaacattgtacttgatgatagtgtaacaatgtagtagaaattatgccaaaaaaagccttatttcttgccagaagaagtaaatagaggatttgtttcaatatttgccacaaacatttgctttgagattaaattccaaggcttatatctgcccagctgcactagatatctccgtgaaacagactggccaccatcactgggttaaaaccccacgggacgagattttaaggcaagtaagccctaaacctggagagtgcgcactcttacccctcttttctccttggcctccctgggcattgtctcaaataagcatcctctcaggatttccatattcctgcgggtgatgttcacacctccctactggctttccaccagccaagagagtcatatccagtgatctctttgttctgttactcaactacatttcctctgcaaaaagattactttaaaaatctgagcatttcttttgtaaaagaacaagtttaccaagaaaaaatactgaacagaagctcaagtaatcattccaaggctacactggcttcaaggggtcaacaatgttacagctttcaagctcagaaattgctggcacatatatactttcataaccagggtaggtaagttccaacataaaatgatcacatggtaatttttcagagaaatggaaatgtaaaggagaaggcctgccagttcctacgaatgagaaatgatcttccaccatcactaagcacacttacggttaacatcgcgaacatcagctgacacacgttgaaggcatgtctccagttgtggtatagaaccatccgatagtttttcctcactgtcaaaagccacctacacagtgtctgaaatgggagggagagggtgcgtcaggcagttgtaagtgattctagtggacccttatctcaatggtgccttatatctgagtaaccctcagtgatcaaaggccttccacaaacatctcttctggttctcacagtaatcccatgaggtgtgcagggcagggattatcatccccattttgtatttgggaaaccagtggttcagagtggctaacacgttgtcccaggtgaactgcttggatcacccaagacagacatcttacctcatagtcaattttaaatttctgtaccatccccagctccatgaacatccggagagcagctgtgatcatggcatcaacgtcgagagaaaagtcatcaaaatgaatgtcatcgatggcaagttctgacaccagagggatgttggctgcctagaaaagcaaaagacataagtcaagccaagttcaccagctttcccaaacccccatcctgctctcctcccctgcttatcagaagtgccacataaatcaggcctgacctgcacttacaccctgatacagctaaactctgagctgtaaatgtcttttgtttctgaactgcaaatgccccaagcaaatgaaggtgggggcagggttgggggcggggggagggaaactaatctgaagataaaatacacgcactggatctagcctgcagaatttataatacagaactgtcaagtttatggaaactgtggtcatacaatatattctgatgcatattacagagcactaaatgcaagaaacatctgggcagccagcagctgtgaattttaattgatgctattcaggagaaggagaagggaatacaccactttgccttgtttcttatatccttatatcctgtagcttgcacgtgttctttgttacacacgtgttctgtatattcagaatgatcgaaaggatcagacagcacatctctggtgggaaatatgttgccttaataaaatagagatatctgaaggtttagcataagcctatgtttcactgaggagatcaattttgctttcttgtttagcttcattctatataaacatcacaacataattacaatactggtcatacatattcaaggttttcaaaacacccatgttaggcaactgtcaatcagctgcccacaaacgagcctaaagaggagaaaaaaaatctttggaaatcatttgtatggtgatttcattgggtttaccatattctttggatcactcttggtaagggagtcacttttatattttcaggttatcagagaccattctgtattcatattcctatctattcactgggtttaaattaccctgacagtaatttatgccctggagctacttactttggctaagagattcaatccaactctggctgctctaagcattccagaaaccacataattaatccttgcttcccaactctatgctcctccataggtggagcttagtttttccatgtacttgcaattaattcaacccctaaactctctatcagttgtctaagtctcttctcaaaatgttcatatgctttgggcattccgtcagtttcacgaataaatcactcctggaacttcccgcatttctccagtctagaccaactatcttataagtctgatgtgtagttttcatcctaggatattccttcaccataattgtggggatgcctttctctctttcttttgtttctctagcccacatctttctctttcttgctttctcctctcattttggtgagacacatcctctaacagattcccaagaaaaggtgtggggtagatttgtgaggctgtgcagtctgaaatgtttttgtattactgtcacatttcattaatagtttgcctaggtaagatttctaggttggaaatcattccattagaatgttaaaggcattgctctttgagctttcgatgttacttttgagaagtcagaagctattctgtgctattatactttgaaaataactcccccctccaactgagtttttgtagaatctttttgcttcaagagttctgaaatgtcatacaaatgtgccttggtgtgagtttattttcattcattatcctaggcactttgtaagcccttttcttttttccccctttttttttccagtgtatctattacaggtttttgctttgtagttaccatgaggcttagctttagctgtagtaaattattttaaaggcttatcattagctataataaattattaagatgacatcttaattttgattgcaaaaaaagaaacagagggaaaaaagatacttaattccatccccctctgcattttgattttttgttgtcactttaaatcttttttaaaaatttatttattatactttaagttctagggtacatgtgcacaacgtgcaggtttgttacacatgtatacatgtgccacgttggtgtgttgcacccattaactcgtcatttacattaggtatatctcctaatgctatccttcctccctccccacaccccacgacagatcccggtgtgtgatgttccccgccctgtgttcaactgttctcattgttcagttcccacctatgagtgagaacatgcggtgtttggttgtaagcccttttcttaattggaaaattatgtcttttaattctagaaaaacattttaaaataagctctttgaagatctcttcctctctttgtttttctgaaattcccttaacttgacctttggactggtttgtctttcttttctttttctttctttcatttctcttttcctttagtttttattttctttttcttacatgtttttcatttctcatattttttcttttcctttttgctctgctttctaggaaatttcttcttactgttgagattttaataccacggttttcattctaagagctcttcttttgtcgtctggatattcctttttatgtatttttaatagtaccctaattttatttcacggatacaatattttctcttacctgcctgaggatgtgaatgacaattctatttgtcattttcttctcttcttataattggcttcactctctgtactttgttttagtctctccttttttattgtggtaaaaatactgtactgtgtacagtacagtagtgttaactatatgcacattgtcatacaacagatctctagaactttttcatcttgcatggctgaaactccatacttattaaacaattccccatttcctcctcctcccagctactgacaaccaccattctactttctgtttctatgagtttgattactctacctcctacaagtagaatcatgcaatattcgtcttttttgtcattggcttatttgactcagcataatgtcctcaaagtttatccatgttaaagcatatgacaggttttcttttttttaagctgaataatattccattgtatgcatataccacatttttgttccattcatcaatcgtttcatctctgtcttcatcagccaactttcaagaaattattttaatacattagaggctttagaaatattagaggttttccttagcggcctgataatctttagttttccactcctgtgtaaaagtggggctctaaaagtttctattggagcttctgggggcttctctgtagggggaatgtgtctgacctgtttccttggggaagccaccaaatatcagtgtctttgtgtctttactctttagctactcagaatccccagagaagagtcttctggctggagcctagcggggaagcaggttggaggaggagtctcagcattggtttcctgttcattcagtcctcctgctttcaccctgcacgcccaccctcaccctctgcactgacgattccctaacccaaagacccaagattatactctctccagaggacaagcctctagtctttatggagtgggggagtagaacaaaggatatggggctctaactgcttcttagactctctgttttcctgtttataagcccatcttcatttgcacttccaaaggtacttaattagtcaattcctgagctatctgtggggaggagtctatggtataaatctgcttgcctctcagcttttcccattgctaggttattttggctgtcttgagtttgctaaattactttctattcatccatctgttttctagcatccaaaattttgtcaccattaagtcccttcccaatttctttggctttgagaatttatgcactaaaaaaaacctttatttttgttttaatagggcatggggagagaacaaaagaaaatgagtgtagttaatctatcatctttatccaaaaataaatgaagttatctttattaaatgatacctagaatggtcagcttggagaactcagagggaagccagcctttggtctgtaggccctttgtttctatgtgcacacctggctgcaaccatgtagatctcgttctcttattctgcgcccctgtgggttcacttgtgccagtgaactcacttattaggctgtaacaatcttagaggcagatgccatgtttatttttcttagggaagatccaaacaattctttactcctatcatgtgtttgagggtttgtaaatagagaataccaaggtctcagaaagatctgtgcttgtggtaatttgttccaattcaaaatcaaatgttagtgggaaaaacacttttcaagagatagaggccctgtcccaaaagacacaaatctttctggtctcaggagagaagtttagttctgaattggcaaaggaggctgaaccttgttacagtttgttaccaaagaagcagaaatggtgatagaggcagcactactccactccaggtggcccctgtcttgtagattattaatagtgtattccctgataccattataaatcctctaccttccaaaggcactaaatccacttaattatcttaaaaattaaagaatataggaattttttcattatgaagtgttaatggaaaggaaataagaacattacgttgaaaatgtaaaatgacctctggttcaccaagacccatccttattgaccttgtctttttttcccctaataggttgattgatccatggttaaatcataccggtgtgtagatcacactaagccctgccataaacccttgctggcacttgtagatgaaagaaagttccaagcctttcaagaatgaccattttcagctattttgagaagtctgggtagttttcatccccacattgctgggttcaagggcaggttctggagaaaactatgaagagtaacaggcagtatgtatcctgagcagacaagcataaaagatttgggaatagccttccattgacaaattccttgttatagagacacagtgctccccattgcttccagtaaacagaaaatgagattgcatcttccaaacctataattactctagccataggatattaacaaaacaaatcaaagtcaatttctccaaatgtcagtcttcaacttttcaatatttataaggtgtcatatccctaaatcaaagaggagtgccacaatccaaaataactactgaattaatagccagaaaataacatttggataaaagaaccatttactttactgcagcaataaatgaaaacacagaattatgagtcctggagctaatttgaataatgttcaagaagtgagactctagctggctggaagcacctgatatcctttgaccattcctcttctttgtttgggtcttaacagttaagtggttatcaaagggagtcataaaactgcctcctctaaaattgaaaaggtagctttacaaagaggccataaaatgttaaaatacaatcctggatcccttgacacatgaatattacattttgtgatgctcagaaaatgggaagaaacaacaaagtgggtggtagtccagccttggcaattcaaaggaaaattgacttgttgctaattccagcccactcactctcttaatcctctggacaaaaagcagtagtcaggagccttacgattctgggattaatggagacaggaggttgagctgtggtgatgtggaagggacagcaaagttctttcttttgccaatataattatagcccttattatgtgccagatactgttttagtgttatgctttgcatatactcactcatttgatgttcacgagaaccctaaaagcttgggaatagttttaattccatgttatgatgaggcaactgaaataaataatgaataagttggtcaaatttgcagtgtgattgtcagaggcagatttgaacctggggagctttgtgctagagactggctcctaaccatcacactgcctctcaaaatgggcctatgccaagcgagggtccccctttctgtattatgcaaactaacttgggtgcaccatgactggagtttgggatttatatccagatgactagcttttcaatccgttttttattataagcaacctggacctatgtgagggacaatgtttttgtctttacctatataaaactccttgggaaagtctccaaattcagagctgactttggaatgaacccaaattgttactttgtgttgattgtagctaacccagaatcaactcgaatactcccaagaccatgctgaaaaaataacttgtcttctcggggagcaaacaatgaggaggtgacaaacgaggagataaatagtattagcagaacagcgatgttatgaaaaagtaagtttttgcttgatcacaggagtttgaggctgcaatacactatgatcgcgcctgtgaataggcactgcatacactccagcctgggtaacacagcgaaaccccatctcttaaaaaaaagtaggatttaaattctcctggcaattgttttctcttgatgccattcattaaatttgccttgtagttgcctagaacactcttcatgacagatatgggctctcatcctacctttaacacttacttggctgagtggcagtgggcaagaaactaaagtaagcctcagattgagcattctttgtataaacaatcacaaaattgtgttgcatggctgttgtgaggagtgaatgaaataatgcacacaagagcctagcacagtgcttggaaataggaaatagtaagtaacggtgcctggcatgatggcgcttgatgttggtgtgttgttgttatgctcattatgatttttatactgatagcagccccatagaaggatagggtgagtggagaagattttggtaactagactctgaagagtcaagctctgtcctctgccccaggagaccgcccagtttaatccattttaattcagtacatatgtattgtgcatctaactgtacgccaggcactggcatatgctgtagttatgtttgtaaaattagtgtggtccctgtgctcgcagcctgtcagaggatacagagaagcaaacgggcaattacagaacagtatgggttaagagctgcgatgggggaaacacggggcaccacaggaacccccgggagagtttagtgaaatacattcggcttcacgttcctgccttaattccaaactgtcattaaacctcagctttataaagtatatttagtaatttaaacagttaaaaatagttactatgataaaaaaatgtttaaaggtcatagagaatgtatcaaaacctaagaaaagccgtggactccattcctgagatgctcatggcctacccaagaagaaagaaaaaacaatgattcgtggaaaaaaaaaaccccaaaaaaccagaagcataaagttcagaggcaacaacaggaatgagcgtatgagatgcaaagaagcacaatggaggaggatcatctaatgtgggcattggagggtgaatacaagttcaccaggagaataaggaaacatggcggagaacagcactacagagtagagttccaatctcccctgaagatggtgcaataccaggaggcacagacagggccccattgttaacaaaaaaacagtgcttgttcacagagatccaagacttcctctaataggcttggaccccttggctgcctaaacaactgtaaaacttgagttcatccaagtaaagggcatccgctttgccaagctccagtggccttggaccacagtgcaggcgcctggtttgcctgtgactccaggactgacttctgttcgctgtccatgccaggttggctcccttgacccctggtagtgaccagtctccattctctatggccaaacctcccagaacttcccctttgaagctctggtcccaattttagttgtggcaggtggcaaatgtttgggccgttttcgtatgggaaagcaattgtcagtgtttccttttccctttctttgctgcactcaacagcgaaccctttctttcctctcctgggaatatttgaagaccaagcaaccctttgtgtcctccagggaaaaggaatttgttttcggttgagtggggttctgggtctaatgggtctatctattttgaaagaaccagggaaaaagagagagtactctagaaccagaaggaaggaaggacgtgctcccgggggagataagtaacagaggaagggccaggcgtagtggctcatgcctgtaatcccagcactttgggaggccgaggcaggtggatcaacagaggtcaggagttcgagaccagcctggacaacatggtgaaactccgtctctattaaaaatacaaaaattaatacaaaaattagctgggtgtggtggtgggcacctgtaatcccagctacttaggaggctgaggcaggagaattgcttaaacccaggaggtggaggttgcagcgagcactgcactccagcaggggtgacagagtgagactccatctaaaagaaaaaaaaaagaaaaaaaaagaaagggaggaggaagaagaatttccccctttcacagagatacaggaatgaggaaagagagggaaggagacagcccctgggagcatggctgctgatccttgtgcatttacctagaaagtggatgcacctagcaaaggacccccatggaggcaaaggactcccatgttggagctcccataagctaagtgacagttgaatcagaatccatggactgtcccatgtttaagttgaaacctctcattatttgcactcaagagttcaccagctcttcctcccatggaagagcggtaaggactttagctcattagcatccagcacctcaaccactgaccacccaatggaaatgacacctgtttgggtaatgcacccttgcttagtcaccaaacacacaatacctaaagacactaataaagccaagaaagaggctgggtgcggtggctcacacctgtaatcccagcactttgggaggccgaggtgggtggatcacttgaggtcgggagttcgagaccagcctgacaaaatggagaaaccctgtctctactaaaaatacaaaaattagctgggcatgatggcacatgcctgtaatcccaggtactctggagactgaggcaggagaatcgctttaacccggaaggcagaggttgcggtgagccaagatcacgccattgcactccagcccaggcaacaagagtgaaactctgcctcaaaataaaataaaaataaataaataaataaaataaaataaaataaatcacattattggctgggtgcggtggctcacacctgtaatctcagcactttgggaggctgaagtggacagatcacgaggtcaggagatcgagaccatcctggctaacacagtgaaaccccgtctctactaaaaatacacacacacatacacacacacacacacaaattagccaggcgtggtggtgggtgcctgtagtcccagctacttgggaggctcaggcaggagaatggcattagcctgggaggcggagcttgcagtgagctgagatcacgccactgcactccagcctgggcgactctgtctcaaaaaaaaaaagccaagagagaggggcagggttctggatacctacaacctacaggaatgctgggagggtgggagtggaaggtggagaaggcttctacacctgaactaggttgggaagctgaaatgaagcagcttaaaacttcctgagagccaaggcagtggttaacgatgtccatcattaatatgttgtgtaattattgttgaaagtctgatggacaaggataggaattacgtctgtcttgtttactgttgtgtcctaaatgctcattgcagtcttcaccactgtaggcagtaactggcacatgggagaaactcattaaatatttatcagatgaatgagtgaaggcttgataatcctgctggaagtcatcttactagtttttcccaaaccatgccacaatatcccctggtgaatttgagttgtgtgaactttttgccaaccaccctggtgattacctcacacttagatacacgtgcacatggaaatccaagatcaggtaatataggtgagtcaagttgccttctaagtttgtgtgaatccggtgctccattttttatacatcagtggggcagtttttagtagaagacacatagaggagtccctaaccctgtgaccccaatcttcaagttccaatctgagctcaccagctgggtgactctgaggttagcctgcttcatccctccaagaagaaggtaggtccttgcagggtggatgtgtgagtgcagcatggtggctctgtgagtttgtcatgaatttcctgtagtgtccttctttctatgtcttagtagcaggaaagtgatggaaggaaggaagtgctcttgggggagacaagaggcagttaagcttgtgttgactacattacacattaaggtttagagacgtaagatacgaattccccaaagatgatgctgccagtccagcatgatctttctggctcagagattgctgccttttgtcttggttctgctcagacctactatgctctctgtatactgcttcttaactcacatgctcggttgaatcttaatggcttcctgcctacatcaacctcaacctgctgcattgtgggtctttcttgagtcctcactgaccctccctgctgcagcctcaccagagagagggagggcacaaccactattccttcttccatattccatggtgcttgatagcacacaggcatgagacaacaattcaatgactgtttcagtgactaggcagaaaaagaaggaagataatgagagaacttgttcaccagcaggaaatgaagctgtctggaaacatcggcctctagagatggaccagggttcgtaaactaataatagagaccacatgagttggtttagcactttagtgtcaaacagctaagcctaatgaacatcatattcccttgtttctgcagtttaaaatgtcaagtttatcaaagcattgccagtaacaataagtcaaaggaacaagccaacactaacatggaaccaagctcttaacgcacaaaagacagcaaggggcatcaagcctcaaggcctgtgaaatggtagagaacaatgttagagggcaaagggaactggaggctcaacttcctgtttttatcgttttgttcaaaattaacctgatcttgccctgcttgtcctggggtgatgagtgccaatggtcctgttacaacgtgctgcactccaccgtgcagcaaagccagtgaagggtgaaactggaaccttgggattagacttagtagctaatggcaatagtaggctaccttgaggatgaagaggatggtgcaaagccactgccagaagaggggttttatttgggttttctattcatgttactaactggatcccatgctcttcctcaatcttgtcctgtaccccaagctcccatattttggcctgctatttggagataggagtgtactctgtcaccagtgacacatgaggctagttacccaatcatcaccttccagtgagctggtcagaagaaatgtttcaaaatttatgcattcaatataaacaatttcccatcctgtgcatcaaaaagtatcgtagagtctctttgtcacttctgaaatgaagcatctctctgctgttgtctcaacattcagttgagtgtcttcttaaagaaaaacagactctagtttccacatatttttcacggtccctctatgcagcaagataaataagaatttatatacttttacttgtaaatccagtaaatatttatattggtttttgccataaaagcacatgaagcattatgaaagaggtttctactcttagggctgaataaagccatcactcgcagtgaggaagtaatctatcaaatgaggcaaagaggggtgtgtgtcctgattcctgagccacaattccctgtcttgaattgtacctggatttactcttggctggatggtggtgttcctgaatacacacacaagtacatacatgcacacatctcatgtacacacttcgtttttaatctgctctttgacttctctcagatattttattagtccattctgtcttcagttctgttagactgttattccacacagacaaacatttgaattttgcctggactgtgttgttggtgaaatatgttagtatctgacttaagctgaatatggtggacagagcaaaactaccttggaaatgaaattatatttgaataacccacatacaaaggtcagtgaagatattcataaatttaacaacactaagagctttaatttaaaaaattaagaactcaaccatgtttagacaggttggctagttttgttagtgctgggtggaacacgcattagaaactttttttcatcatggtgcatttattaagacatattgtgtatcaagcattgtgctaagtgctttatagtattccatttaatcctgcaacaaccccatgggtaagattctattactagtcccagtttagcctccatagcacagatgaagtaactgaggttaagaagataagcgactttctcaaggtcacataactagaaaactgctgggactagaaatcaatcccaatgaatctagccctgccctctgtgtttgtaaccactaccctatattgcccacacaatcatttgaatgcctcttagcttagatccactgcagcacagcatggaattattgcttccagagattttcttccatgcagctttaaaaaacttatttatttttgtggtcttgtgaatctgtctctcatcattcataagttccataaggaaaggattcagattctcatatgtcagcaattatcatagcctagtacttttctcatggcaagtaattaataaatgtgggttggtgggatgccaagtgcataacctcctgagccaaacagatgtgcatttgaatctgagtttgctgcgtgctaaagctgtggccttgagcatcagtgtcctattctgagaagggaacacaatgataactatcttacagtcattgaaaagcttcagtgagacaaaatacttagcacagtgccaggttcataggaggccctcagaaaaagacagtgtgttagtctgcaaaataccacaaattgggtggcttagacaacagaaatttattttcccacagttctggaggctggaagtgcaaaagcaaggtattggcaggtttggtttctcttgaggtctctctccttggcttgtggatggctgccttctcgctacgtgctcacacggccttctctctgtacatgtgcacctctggtgtcttttcctcttcttgtaggacactagtcattggattacagctcaaccatatgacttcatttagccttaatgacctctttaaaacccctatctccaaatacagtcacgttctaaggtactagggattagggcctcaacatatgaatttgggagtggggaagaaacaatttggtccataacagacagttatcattattgcaaatgaattgagcactaaatatctagaaattcaaaataaatgttccatgtcagacccaaaaatggtggtccctttaaagtgtcctgattacaattttagttctttctctccttggtgccttagagaacgcaacctagaaaggctttttctctttagggaactgcaccatattcactcttggaaagaaatatattcaatatggggttatccaagatacactggaggaaaacatgatacatcaagtccaagttaaagataagaactgggtgtgatggctcatgcctgtaatcccaacactttggaaggccaaggaaggagattcacttgaagccaggagttggagatgagcctaggcaagatcctatctgtacagaaaaaaaattagccgggcacagtggtgcacgcctgcagtcccagctacttgggaggctgaggtgggaggattgcttgagcccaggagttcagggctgcagtgagctaggatcacaacactgcactgcagcagccttggtaacagagtgagacactgtctcttaagaaaaaaaaaaaaaaagataaggatcagaggactgtaaccttgtcaaatgcaattatcaggctgcacagtctgccagggaaggagaccctcttgtgaagagctggcagtggagtgcttctccagtccaataatcttgttgagtgcaccctcccttactatgcctaggttcctatcattatactccctgtatttagagaaaactatacatgactatcctgtttagaaaaggtccaggaaagattttcccttctcggggagccctagtatgacaatcccagtttgtctcaccccatctagctctacggaacccctggcctgcagctctaatcctctctattgcccctgatgaagtctttcttggtgcctccaagcacaggcaatgtctgtcacttcgatcttcccttacattttgtccttttctctcctacagcatttaccatagactgctctccatcgaagttgctgtgcagtcaaccactcactcagttcatttgacaaatacttagtgagggcttgctatgtgtcaggtacattgccaggtgctatgcaggtatctatgcatcccacaagacagggactctctgaagggccggacagaacagaaactgtgtttgcctcatttttgtaccagctagagagtccaccccttggcaggctgtccctaaatgttagctaaattcaatggacagatgtgaaaggggactttctctgagaacactttcctcaggaggaagacaaggctaggaaagtaaaaggaggcaatgtcttgaggtctgaagaaaagctccatttccaaaggtcagtagaggtaatggaggttctgacttttaatccccatcctgaaaagggaggccccagctaagaggagaggtggcagagccagcaagaggaaagtgttagggaccagtcccagagcacaagcgaaatgatcaagcagctaaataaatatcagctgcttttcctactctgatgcttctggaattcgtgggtaatgtgtttctgaattcgcctcctgcttctgcataaacaacaacatgatttaatgatgtggataataaagctgttgaaaatgatttttctttagctctcttttgggacaaggaaagggaaagaatcaaagcttaatacagatgctgattacagaaaccaggggtgaaactcaagttttaaataattgtacttattttctgttaaactctcatggtttttgttagttataggatcactaattgttagcaccacacaaaggttaaatgtgcaaatactgctctcttggtttcagctgtgaaagaaaagagataagaacaaggacatataaagagggcatgaaacttgtaagatgaaggacaggaaagtgaagggtgagagaaagaaattgggtcatcaagtgctcactgagcaccaacagtatgccttgaactgtgcaagcattggatgacagggcacagggtagaaatgcctgcacaactctcagataaaagggtacagggtagagatgtcaggaaaatcaacctcacttggtctaggatggccaagaagttatagttcactcagatcccttgaagagaaattaaaaggaagtgaattagcattttttaagtggctaccacctgcagttagtttcttgttgaattcacacccttataaggcttagagagttaactaacttgctggtaagaatctgcaataagttattactatattataaccctaaagggaaaaggtagggagtggggtagagtaagaacttggacagttttacaactctaacacccagaaatcaggaaggggtgattgaatggggctatggatgaaattcaagttggaaatgagagaatgtgtgagcagaaggccctaaaatctctgccagccttgactgggtgagataacttttgctttttaggtatctgtatcactcagaaagaaagataagcttgctaccacctggggtccacctgggggctttcctcccctcctctcctcctctgcccctgcccagcagtgaagccaagcaagaaagggaatagtagggctggagacttaaaagtcaagaccaaatggggactccagttcaggaaacagaggggaggagaaaaccttgaagctataaaacagaaaaagttggaggtattgggggaagggaataaagggatgtgtgcaagaggaagagttattaagttgggggtaggaggataagagacatgctctagtgaccttgcagggtgcccctgaagtctgtctgtgataatctgcctgggggagagtgtgccaaccagttggacctctctgattgtttcatgcttttttttttttactatatgactttagagagatcaacatgaatctaaagtatgttcagacttctttcggattccttttgcttgtttgctctgtggagggcaggaagagaaaggacatctcgcacctgcctgaatcactgagtgctgagataccaccagccatgaggtgtaggaggtcaagggtccagttcaccttattcaatcactatctatcaggtggttttctctactgagtctcttaatgaggataatttctgaaagggatgctttcaagctcaatggctgtgatgaatggtattatttccagtatccactttcctacatgtgagaggattctacataagcatgcattgccatgtgacccagggcctccctagcaatgatgatgtttacctgtccagtgacttcaagcttggccgtgacttgctttggccaatagaatgtgagtgggttgatatatgctctctcacacgcacatgcacggagcagaaaccataggtttatcatacggttttgctagctctcttgttttattccttctgccataagaatggcatgtttcagatggggcttctacttcagcctgaatcctggatgaaggagcaacagagccacagccaacccatcgctcaaatatagtgagagctagaaacaaacctttgcagtgcttctttccgcaacataacctagtgaaagttgctatcataacaattttctctgtatgccctcctcattttatattgccccagcatttttaggtccagtgtttgtaataaaggatattcattccttttcacaaatacctttccttcttatcccaagctatagaagaccatgtcacaaaaaatcatggcatgaaagagagagaaactggtatattgaaaaagaaggagaaactgagtatatctcaggtctttgggagagttagcattttgggtataaaacacagtggccagaactcttaccagggcatatttgttccaaacacatctaaaatggcctcctattcccctagacagaagcatcagcttccaccctaaatcagtggctctgctactcagccctgttttagattcacctagagaaagcatcaactcagatttccaggccccacgttgagagtctgattcagtaagtctaggacgggacctagaatccttatttcttaaacattccccaggtgatgccagtgagatgccagggtgggaagccagggctagtcccactccactggcaggcttgctgggccttgagagtgccagcaaagcccaggtcctgaagggttctgaggctggtgtgagatgctggcctctctgggccacatcagagcccaggccttatgctggagagcactaggaattctaggaacaccctgtccccagtggtccttcttggcaggaggacagcaacagcatatgtgagtgtatttgttttcccagccctcttgtatatcttgcccactacagcttgtcaggcgggctgagtcctcctccactcctgagaggtggggatggtatcagccatggctgccagctgaggagactagggagcccaagaggtcctctgctgaagtctccatagaggttgataaccacctgcctgtgaactgtgaaccccactgcttacctgtggggcctcaatgcctttcaatagtccttggactgctgcccttgaagtctcccaggagtcagacctgagcctcaatgaacaaaggaaaataacaaggcataggaagaacccagccaccagacagaaatagagctgctggggtagacagaagacaatttgcatatcatcataatcatcatcacatctaagggttaaagcaggaaaaatgggtctaaaaatgagactttctaaaaaaaattcgtaggtaaattgaacaagatggttcttgttgagatctgaagtagtgagttggaagattaagtggaagaaatatactgaagcatagaaagatacaaaaatttggaaatctggagggaaaacacaaaatacttggcggatagatctgggaggaaacggaacaaacaccagaaattccagaagaaaaaaaaggaacctattgaggaaatgaaataactaaacaaaccaaaataagccatttccctaaaccaaggaaagaccagagtctgtagaaacaatgaaaatgacccatactcaggcatattctgatatcacatctaaggtggaaggaacaagaattctacaagctgccaaacggaaacaatgcataacttaaaaaggaaaaagaatcagtctggtattttatctctcaaggcaaacttggaagctaaaagataacatctatggacatatgagacaaaagaattgcaatcctagattcctatgcccagcaaagacaggcttcacttgtcagtgtgagagaaagatttgtggctgggtaaggcagagcttctaaccatacaagtaagcctgaacagagactctgagggtgagaggggaagaggggaggaaaaagatggtgagaatgaaacttgcagtatagagagctaaacctaaatgtgaagtaataaaagattgactgggattatctaacattagcatcaaatgaggattactgaaataagatagataccagaggaaactaagaactatctgaaagtattaaacaatgacagaaaaactgaggatagaggcagggtatgaagtgggcaggcacaggagaggagaaaagaaggaaaagcaagcattctgtaatgtcagctggatagaggccagaagtaggagtgttctgaagctttattgtggtggtgcaagagtcctggggaaacactgacctgttgtctccatataacagtactctgagggtaggattctcactagtagagaagaaagtaaagaacaacttgaaaagcatcaatgattttgtcagggacctgcttcattgctcctgaaatacagccagcgttccctcgactgtgccttgttttgacaatttggctcctgtttctaaattcaccccacctgtgggaaagaccctgttctgaccttggtgctctactttggacacatttgcttttggctctgaactcccagaagcctggtctccagcctccgtgcacctcaagtcacacacttcacctctacatagaatgggtggcacagggagtttgctgtggagcatctgggccaagtccaaaatggttctgggtctcctactcttgaaggaaggtaaagaagtcaattctggcggtgttccaaactggtctcttgggctagtttaaaagcttagagatgttggaattatccttttcacctttctcctttcctcttccacttccatccccacccaggatccaatgctgaagtttccattttgaattttgggttctcaggcaacatatggcctgccttttatcgtattgcctgtagcattcggggatttcaggaaagcctttgagagaccttggtctcatcctcagctcagctcactaggaacaaacaagagattggctgtgggcctctgaatatcactcagaacacctgaaaatgatagtaggccgatccctgcttgtctaatgccagagaggtcgaataacttgcccaaggtgagagcacctgttggtggcagagccaggattagaatctaccatttccagtccagaccctcccgatcctctagtccttgccaagtcccctttcaatctgaggcagaatttgccaacattcaggatgccctgctcaatctttcttagattggactctaattggtagcactgtgtagcttgtgtctggaatacgaggcatttcagataataagggtcatacttctacttttatgccaagaaagctccagcacatggaaacacgtttaataaatccaataaatgatatgataaataatttatttaagacagaatactttcaaagtcagaattaccactgagaggaaacattttgcctccatgaggatgatttgactaaacagaaattctagatggagtccattttttggactcatacaggagtcctgcatgctaacccatcagagaaagagtagacagattgtaaatttatcttctgaaaatgaatcaagtcgtatttctcttcattctggttactcttataaagacacagcaggtgaataaagccctttttctatcttatctatttgcgtattattaaacactgagatcgtgcaatgcctctgcctcctagcaacagtgtactggtaattcttggaagagtcatgaactatgtagggtgaatgaaaaaagcttcttgctcttatctagtgttgtgggatatatactataggcatgagacagcagttttttttttttattcttttaaaggtcacaaaggataaatgattacaataacatttcacccactgactctaggtttttactagtaaatcctgatgttgatttcaaaagctgcaaatctataattcaaatatttctgatcggaccataaatcctgaaaatcaaatctttttctgaatgaaggatctatgaaaatagatgatggatttcatgggctgtcaaagcaaaaatgttacatttcatagtttgtcattgaatatgatataaaacacctgcaggtaggttatttatattgataaaattattgttcttcaacattggaaactgttttctggggaataaaaataaaatataaaaatagcttttaccacaactagaaattttgtgctttagaattagacagtggaaaataatgtggataaatgccaaaagccattttctttaagccaaatacagtgtgtgctattgcaaggatggataggccaggctggactgcttttcccatcagacactatatagagtatcacccatctaccattatttttgctggaaatacaggagttttgtttgtttgtttgtttgtttgttttgtgagagagggtctctcacactctgttgcccaggctggagagtacagtggcacaatcatagttcattgtaacctcagactgttgggatcaagcaaccctcctgccttggcctcataaagtgctgggattacaggcatgagccactgtaggagctaatattctaactcttttttgttgtttttatactttctttatatattgtccttttttatactttcttcccagaggttaacaaacattagatttatatttcagtcaggttaagtatgtccaaagttattctttcctttctgggtagtgattgtgagattaagaagctagtttgctttgctattttctatggctactgtcggtgggccatactccagccaactttctcaggcaaatctaacaccacagctccccagacaactaagagttgtttaatgattaaattaagataacacatgtaatctggcatatagtaagtgctcaactaatgatagtaataatggtaatacaaattattattattattttcattatacctaacttgaataatttctaaggcccttggcatggagtatggtcactagtttagtttaacatgatttagaaattgctcatggttatatattaccaactacaaatggaaaaatgacattgttggaaagggagtaagtcagatattcagggaatatgtaggctcatattaggaagggaagatgcaggctcaaagagctcccttctcagatcctgaaaactagagtttgggtttcatttacaacagtacataatctcagctgcacataagaaaccttgccacttctgctcagtaaaatacaaatcactgactacccgtttttattttaggcagttagatagttagtacatcgttaatttctgcacatactcaagctcaatatcattgtcagttcggttttatttccacctcctttcagagatccctggctggaggtaaagacttgctctctgagtgtctctgggtatactaaggcaatatgaatctttaggagctccccttctttgggggcaatttataactcaaaacagcaacaaattttcttttcagggtggaaatactgacaataaaaaatgaagcagctttgaaatatacattactgtaattaaagtgacttgctctttggaaattcctgagataagtctttattgcaactattatttaatgatgagcataataattaaaggctcattcttgaaatagtatcagtgccaggatctggatggtcctgcagcatttcagattacagaacatggccactggtggatgcctcagctcaagattctctctgcctttcttttgacaatgtgaggccaaggccaagtccaaggcaagcatgtgcttagactggtgttccctagtacactgttatagaagccaccagctgatgggctttgtaaaaggtgtggtcaaaactggctgggtgaagttagtactctaccatttgaggcacaatgcccacaagggtataaagtatcagaaattgtacagtaaaggcacctgtttaactttatttaatatagcatttaaaaaaattatttgagtaccaaaacactttttgtggccatgtggtacatctattaatattctgtggagcagtgttctatgagataccagtttgggaaatattagctagacctgtgcttttcattcctagctctattacagaatcgcctgggggcttaaaaagtatatcaattctggcccactgcccaacattttttaaattggtctggggtgacatccaggtattggtattattttcaaaggctcccttccctagccaagtctaatgtccagccagagctgagagccactgacagaagcctctcacttatgcatcccaattatcccctttctaatgcatagagtcatagtgagtaagaaaaaaaaaaaaaagctctccaaagctctgatgtgtctgagaaagaagcttttcctggggtcagatctggatctactcactgatcttggagttttagctgatatgtggatttgcctgttcatggacttacttcctatcacacttccttctccttggtggttgtcattttcagcaggaagggacaggctgcctgctccacccagaacctttcctgaaaacctacacctgccactataccaactttatgtaaatgactaatagcgcttcctcacaaaaaatgatgagaacctctgttgtaggtaaacattccaagactttatctacaatttatgaaagcctttctcccattgagctggcaggtcctggaagccccagaaatgtccatatcattagtgcagtttccctgggaagtgggagctggggaagaagcctgggaggtggagcctcagaaagctgtgtctaatgcagatttctagctttaaatttgttccttgtgtctgagattttctagagttttactggaagagaaaacccatttctcctcccctttaaataagaaacaaaaatttactgattaagcaagaccaaagagaaaaatgagatgactttatagactcattttataatattctaaacaaatgagattcatcttatttaagagtacaggagaaacaggcatttaatatttattgagcatctacaatgtgctaggatacatacaggttttttcatatttccatcttatttaatcctgacacaaccccttgaggtgattcttctgttctcatttttgtgactgtggaaagggaagcccaaaggggttaaggtgttgcctacagtgggacgtgagacagagctgggacttgaacccacgtctagtgatggtgatggccaaaccagagccagatgagccagttccccacctctgcagcgctcaccacgagaaaaagaatgtgaaaaactccagcctgagatcagtgacctgttgagagctcaggtttttcatccggcctgcatcgtgactctcagtgtatttcatatcatctccaaaatagtatctgaattttatacgcatattctcttcaatgttctactctgggctttgaaacagaagaagggttaatgctgtggtgaaatgtggcctgtcctgctccctgggttcttctttcattactcaaaaaatacgtaggtttcagggtagactcttataatggtaacaacatgagctttggattagacctggatttaaatcttatactgtgattactaattctgtgaccttccgtgacttattttacctccttaggcttcagtcttttcatccataaaatgaggtaataataacatttgtctcatagagttgtgaataaacaagattataactcaggtctcctgaatttactttccattagacgcatatacccaaacatgtaaaagatcgaaatgtttcacagctttccaaggcttatcatctgtgaagctcaggtagatttgcaagttcgggtttatttatcaattcattaattcagtcatcaatgtattgctttagtcattcaacaaatgttttattgagtgcctactatgtgtcaggcattttgttagtcaccggagataatagcaattttcaagtagcttagagtctaactaaggcaaatctgactgtatcattatttatacccattagaggttcacaggaatgatattcactcactaatttgttaatgcgagtctgcagaattaacatgcatgtaatagtattcaatctaagttaatatgtttgcccattgttgattatcataactgttagttatagttaatttccaatctgtctagctctctggaaaagcaaaaagcaccttccctccattttgctgctctgaactgggaaagagcagatgcccaggtgaatggcagtgaagaacgtatattcagtgagctcttacaaatcaaactgtttgccctgaattaggctcaagtccacaactaatgacaactaatgtatggattcctggcattgaagcatttggagtttaactgtttgttgtcattgaaagtgaatgcctttccaacatgtagcctgaagtgctgagagggcagatcctcagctaggaccgaatgtcagtaatttaatcatttattttttcttgtctgttttatgacatgttcttttcagagcattccctagttgctttgattcacatatacattccatcaatattaattttctgtgttatagtaacaacaaaagagtaaaaccagaaagaggaaaaccttatttttccctatgaatagcccaggtccacatgaaggagaaattagagtagacaggtggcactgcagcctgttattcaaggcccaggcaaccctgactagttccttcgttctctcctttgcttttttctgaggaagaaaaatcagcctgaagagtcaagcagaatgacgaactttttaagggcaagataattcacaggatcagttagtgatagagtaactttggggacttgctttgcatttagaatacccaccctatatggcatgttagtcctagcagagagaggcttgcttccacaccaaaagccctaattcactttccacggaggccctccccatccctcagcagcacttccctttatcaggcagataagattgggggggccaacatctatcttgtatgcatcctatgacactgcagatgaaaactacctgccctggtgtggtgtcacattttttacatttgatttttatggatgaaagcattgcttcatctgatacttataaaataccacatttgccactgagaggcttctgtgtccaaatatctgccccgccccccatgtctaatcttgatcttcacagctgaggcccatctggatcatcctcctttccagctgacagtgagagagccaatgaaatgccttttcctgttgctgggtgactgcgaatattttgaaaacaagttccttaaaggcagcagcttcaaagcctgccattggctggctaggcatactgtgcaatgctgacgcatgaaggctggcagaggagtgacagttgggaagagctacgcaaatatattactggcctgatggtccactggagggaaagactatttcaaggctgagtgacaactataacataccctgtcagaagaaaaataaatctccctgagtctacattcaggcatctgaagaacattgcagaaaatactgcagacaaaaaaaatgcaaaaacaaaaaacaaaaaacaaaaaaactcaaggttgtcctaccctcagatctcctgctttttatggtctgatgagcagttcttcctgttcaagaaatatatgggtatttccacatactttggtagaatttgtgttcatacattttaaagcccaagcttgtttatttggaaaataattttcaacaaagtcatggaagattttctttgcttccttgtctccagcgtcccttccttcaccttcctcccctgaccttcaagtccaaaaatccagcaggcacagtatgcggtcagtgtcaggggcagcattggctgcattttatctcactctgtccacttaaaatatttgcatcctggtgggaggataagcacagtcctgtctaaacagccttggggttcagctttgcagctggagagagctgtttggatacaagtaactgcttttgctaacaccgggttaactgttcacacacaaatctgccaacgagcctctaggaaggaatgtccttctactaattgaattctaatgaggccaggaagtagattaggaattgagctattttactatgagtttcaaatatcagatctagggatgtttggcctgtctgatctccttaattctccagcaggtcccaataaattcatgaagaaatgactagaagaaatctgtgggttattggttgatccagttgcagggggcttttctatatatcagagactacagtgttcaaacacaagagaaagaggctgatctgagatgacctgatgggctagtcattagtgaggagttcctggaccaatttaattggcatgtccctggaagttatatttatttgccttataatatttgggtaagtttgagagccaaatcagggtgagcatcagtggggtcacccctgattctacttagttgtggaaatagaaatgctttaaggacatagtagaacattcttttcaataatgctatatagccaacatcacttgtggaaccacttcagcagacagagcgatcacttgtgggtgtcacccagtttctagacattacgaagaggctcttgtgagcatcttgcctgtatcccaggaaatgcctgcctgccataaaagagggcatggggtcatgcaaaagttacctgcatgtactgtgaaggacagctatgataccatccaccaggtacctctttcctttctagaactggccctccttctgctgcgaccccatgtttccacctggatttgatttttccaactgacacactttcctaagcacacactcctcatcacagttgactggtccagggatggacaggggaaccaagtgggccaagcggaccaatcagaaaatgtccctgatattttccaaactggaacttgggactccatagttcccttctagaaggggttgctgaaagatgagaaacccaggctctgccagaggccacttttacccctttgtagagcaagccagtctgcagtgagtacccaagggctccatgtgcaatgtgaggcttttcatatttggcccaaggggccacctgggtgcttagtggagagtcacagcagccagccccaggaatcaccaagtggctctgagggtagcagatggttttgcaggagcccattctgtggggcagggtttccttttggtgtgcactacgctctcatttgtaacacttcctgggaagactttgggcttttacatactatatagaggaaggagattttacatctgggaccttggggccatttcaaccctgccttcccactaatgaatttaccacacaataagagaaagagttcctgttgggagagaagcttgtttgcaccccaggtcagacagggccactgctaacactagaatagtgggcccctggtctttcaggggttatcaaaataaccagcttttgccctcacacacaactcctcagagaaccggagtaaagctgttttcaagaagaccactgatggtttaaaagatatttcaggcagaagcataaatttcttcatggttttaaagggaaagaaattccctttaaattcatattggagaaatgtcatcacagaaagcctctcactctcttctcgttcatttctgaattctaaatcttttctgttggtggtgaggggaagagtaaaaagtggttttcctcaaaagccagcttcagtggtttacggagttgtttgacaaacttaagcccaagtgttgaggacggccacctgttcccacagaaatcacaaagcttggttttcacagaactcgtctccatctccaggaaggccagaggtgaattatagtatgtgttaggaaaatgaacctagtagcaagaggaatgggatcactcagcacaggaattgtttgaaatttgccctttggagaaaataagtgctgttagcgcccacaaacatgtcccttgaagttgatattctagaatgttgaaggctaaggaatcatacctgctcaagcaatggggctggattacttttcaaactatgtaaccttaaaacaaacaaacgaacacataaacaaaccaaaacattcttagcaaggtctgttgaaacctgaacccatctatcgagaaagtaaaccaagattattcaagggctcacaatcagacgataaggagggtcaagccaagacgagaagaatctcaaacaaaacgcattccatgacatttcaaaaaggatcttacaaattcagcatgcccacccatatctcaatttcttaatgtgtgcaatgtagttacctgggcgtttctctttgtacctcagttttatcatctgtaaaataagaaaaataatagtagggtttttgtgaagactaaataaattaatacaggtaaggcaccaaaaactggcctggcagctggtaaaatgttcagtaaatgtttattttccagatgactgtcacatggagtagactgagcatatactggggcccaagaaaagggcctcagcagcatgaaccaaggtctccaaactggcagtgtaacatctctcttagctgcctgatccttaaatgggatagagccgctgatgcctccttcagaggcttgctgttaacattcaatgaaataagagctatgaaagcacttagaatcagcaaaaatgctgtggttatcatagcatttgtcttagtgaacagcaatatttgaaaatgtataatgattggtatcatgttatcctacagaaagcccaggaaatgtattttaaagtccgtccacttgtagatgcttaacaacagaacagtatttaagcctcttatccctggataggttgaacagagcctcgctgtaagttcttaccagcccttctcagactctcacctttcgtgggtgtggatttgattatagtgagtgtaaagaagtacctgtggatgctgctctgggaaggctttcagagccagtatgaggccagatgctggggcccccagcctggggggatgaggtgaaatctgttttgaacttagatcccttctaccatgtggtcttatagaaacgattctagagttttctgttacagtgggactgtaacagacttgcagtttttattaaaattctgacttgttcacagcctaattccttttagtctcaatgaaatgctttaggccctggatggaaacatcatcctgaattacatgacagtcttagaatattctctgtggaggcaaggcacggtggctcactcctgtaatcctgtaatcccagcactttcggaggccgaagtgggtggatcacaaggtcaggagatcgagaccatcctggctaacacggtgaaaccccatctctactaaaaaaaaaaaaaaattagccaggcatggtggcaggcgcctgtagtcccagctactcgggaggctgaggcaggagaatagcatgaacccgggatgcggagcttgcagtgagccgagatggcgccattgcactccagcctgggtgagagtgcaagactccgtctcaaaaaaaaaaaaaaaaaaaaaaagaatattcaaagaacattctctgtggctatcaaatccaaagacagaaaaatcctgcacagatgttgtgtattgactatagatgttctgatatctggctaaggtggtgtctttgtgaacgttatgaattgcttctagggaagcgaaaagcacctcaacagagctaccatttcaccaacatgcagtattctggggaaaaggaagagaaggagtgcctgatggctctatcagctctggcaaggaaatgaatgcattgaaggaatagagtgcaggcacacagacagcgaggctcaaatctcctggctgcatgcatgctgcaattacacaccacaataaaaagaattaatgtagcatctgacctgctgacctccagatgcctactgcaccacctcatcaacaatccccagacctccacggtgcctccttggccacccgccggctgcctcactgggatacagcaagcacaagggccttacacaggctttgttcttaaggctaaaccaaaggggagagtcccccagtccctccacctcgtgcctgggcaaatgaataagctgtccatgtcactaacatattccaggtcatgcgtacacacaaacattattatatctcgatattacttttaaattactgtctctggggttttagccattttcctagaaatgtggctcagcaaatccttacgtggagcaaggatggcacccagtggccaaagtgcttcatctcagaccctgttttctcagggattttccatttgcttctctctttggagacaatgaattgccatgagatccttttgtaaagccagagttgaaactccaaatcatatgactatcccgttaagttggagcacgtgcacacacacacacacacacacacacacacgcacacacaaatggaaacagtatcaggagctaattcagaatagctaaaatttctgaaaaatctttaaaatttaccttgagagttttatgttaaaatcatcatatttcagatgtgcagattaccatccatgatgttcccaatatcaagtatcactataggaaatattataaaaaatgcaagcccagtctcacattcttcacttcatattcccccaaatagtctctagttcataagtgctcatgccttaaacataagactttatcacctgacaagtgctttatcatgaaactgatgtttgcaatctcatatccttgttatctttcgtacaaggtacttggcaggcctggagagcacaggataatagagtgggactactctttttcctttgagctttccagatgtcaagagattttgatacagctagatagccaatcagactgtaaggaagacaggcgagatgtcagaataatgaaccatatactctcttgctaagaatgatgcaatgtctccataatgtttctgtttccaatttccttaggttcccaagtaatctaaaaccccagggcaaaaagtcacatggatagtacaaccacaatacaaaaagaagtttctaataaaacaacattacgtattaattgcccaaagagtaccataaacagtcttactaaaagtcaatatgttgagttcagccaacaattctgtctttctcagacgtcattaccattcatgcttatttgacccccaaaatgtcaaaatgccaccaagatttcaagaataatagctgaatcaaaagaaatgacttaaaaatgaaactccatgacattgcttccattttcctactccgccacttgaagaacagcattgtcttcaggaacagacaaaacattgcagaagaaaaaccaaagcagaggggttccatttttcttgctggttctttgatccttagttgccttctacataaaatggagatatgctaaccctgccctcaccaagactttgtgagcctcaagtgagataatggacatgtacctgtttttatacactgcaatttcttagtacttaagacatttttcttatttaaacatttataggtagcattagtgtatagtttttatactgatgagattgagactcttgttttacccacgtaatcacacatcttcctcatgagtattattatattatattacctttcaaatataatatagtcatgggggctttggaaattacttatatgtaattaaatcaagctgagctatcttgaacagagcttgaattaaaaaatttgagtatgcgaaaatcataaaaacccctaaatgttttgtcaacatttatgttgttttatgttttattttcccctttcttcctagagataaattttataggttcataaaattatagcattttttagctagagatggctttgttttgcagatgaggaaacctggagcctagaaattgaaattaaccaaaaggtctggtggttactttgtctttttatacacttgcttgctcttgtcttactgtgtccatggtcttacaaagactgttaaaagggcagatctggctacagagactgcagaaaacccttcagccagacattgtctcctaacttcctatttcatagggtgtcttgagaccaagagaattatgattcacaaacacttaaaagattttggatgaatccatttccaaatgaggaaaaataggaagaacagccaaaccagagcatgatttcaaaaacaggaaagacagactatagaactatataaaatagtaaatacaaatacaaataacaaagcattaggtgttttgaaggtcaaaaaaataggtttaaaaaaatttagtcagcagggtggtggtaggaggatacatgaatgaagaaacgtatttagtagtaaagagattgctgaatcaactaagagttaaagggcaaggggcttttgcctccagcggggaagagagacactatcattacagcacactccaaagaggataggagtacctatcctaaacaaagaaaacgaatccctttattttcatatagtttagggtgcacaggacaacaaccaggaacataaaaacaaggggtttcaaacagcataaagcaaggattggggtgaaattgtcagaaatttccatcgtcataggtccctgcttcaaaattccacccaagcattataagttcttttgccataaaaatggcgaacatttcaaggaatttggtcacaaggtagaaatttctccagcacccaggtgcaaggcatggctttaggtgatataagggttaccaaatgagtaagtcaaggattctctcctaaaaatgcaactgctttaatcatttgagtagacaggtgcaccaagatttatattgcaaggtagaaagtgatgaatatggtaggaagaaaggcaaatgagaaggtcacttttgactgaaggacagcaggaatgacttcatggagaaaggggcagttgagaagggtcaggtagattgttagcgatttatatatacagatagggagaaggatgggtgcaaacatataaaaggacagggaatgggcagaaaacaccaagtagaactatttggttaaggatagctcagtgggagcatgggaaacaggctggaaaagtgagctgaaagttagagtttggaatacttttaatgtccaattaaataattcgaattgaaagaatctagaggcttctagaagatactaaactttgtgagctggaacctacaccaacagaagagttcatctgttcatctgttagctgtgcacaggatggatctcggatagggtcaacagcaggaggcgggaacccagctaggaaagcagtgtacaataatggcctgcctgaaggagaatgaggatctgaactagtgagggctgtgaggatggacaggagcaggagatgtttggaaggcagaatggacgggactgcatgtgggggcgggcagtgatgaggaccccatgatgactgtacaatgatagccaaagtgtgcaactggagattgagggctacagaagcccaacagccaggaggtcgtagctctgtgcacactgaacgaacagtagagggaaggccacccattgtgatggctaacccaagcccctctcactgaagtgagggactacgtgttcttcatttcctggcgtcacagctagagttatcaatggatctaattagaggaaaactaaaaagaagataaagtgatacagtcccagatgcgctagtgttctggaaggttctgatgactttaacctctccagttcccttcacagttcaggagtcagggatctcactgggccacactgttgctctccactggaccttcaggacttgtcgccgctttgttcctagcgctctgaaacaaaaatgagccctcctttgtttcactgcctcaagttcagacttcctgcgccttcccgtgtgacacttagggaatgcagtgaattctgctgtgctaacatgggggagggagaaggtgggagaaaatcctccaggcccgctcttcctcccagggaaaggagatgctcacagtgatcttctggggagagtgtcctcgctttgttttcaaatagaaagaagtgacaaatagtggctgctgaagttgatgtgaggggaggtcagggtcaccacaggatgtattttggtcaggcgggtccttgaagggccctcaatacctagccgcttagctcagcaggagggaagacgagcctgggcttgcagatctggttcccctcatgctcagcacccactcccccgccctccgccactatcttcaatactcaagagtgacaaagtacaaccatcctttttctgatgtggcatttgattaagacacaattcatacagacagccggacatttgaacgcgaagcactccgcatatttatggatgcgtcctgagcagtgcaagccgcccggctcggctgctgcttgtgagcaggagatgccctttagggtgctgatgcagctgtttcctctgcagtcaatttcctggtgaaggttcaataactttctctgacgataaaaaaaaaactcggatattaaacttgacataaatactatttaaagtcaaaacaacttcctaaattccaaaggcgggcacagaagaggagacagcataggctaggtaacgaattccttctatatagcttcgaggtaatcttttaaacaaccttagaaatgacccgagatgcactggaaagccactgttgggatttcagaaggtagcatttcaggaaggccatgagaactgagactgtagataaacaagacaaagctcctgccctctttctggtacccagaagtcctgctttatccccggctgtggaggagcctctatgggtcatctgccctgagggggaggagctggaggtgcccctaccgatggggtgggtagtaagctcccggcctctgccaccccgctgctgtccatgggactcaggtctacccctcttcctcttcggcgttctctgtgtcgcctgagtttgggtaaatgccatggtgttaccctctgtctgcatagtgcactccgcctctgcaaggggctgctgcaagaattgggctcttccagggcttcggaaattgattgcacagggcggtggctagcgcgtgtagtgcctttgtggcaattggagaaaggagcgccacctggtggatcaactactaaaaggcactccatgcacttggccagccaagagaaggggggcagccctgcacccgcctgctgtgcaaggggccctagtgcagggcataaggcagacacatctcctggcatagctgtaaaggcagtcttgagggctgaagcttcttattatacactatttcatggattaaagtgtcttatcaaatctaattttttttaagcctagtaaatcacatcctattgctcagtctgcaaaggaggtcataagatcctatttttgatgcagtcattcttatttcagtatataaatgccacaaggagtacctattcttggtactttattttattttattttatttactaggatattaatttgtggcctagtcattaacattgaaaacttgaaatatgtatgaggtagtccaaacccaaaccccaacctgagttactggtgcttaattactgaggcagttacagtgctgtaaatgagttcatctctgattgcagccgtaacccatgcagtgctcaattgaaggaagggatgatacaaggtggcaatataacaccacaacatccatgagttgattttaattggtaaactggcaatatatagtgagaattgtttggtctgtccaccgcattgcaatttaaggaaagtccataaaattacaggagcatataattggggtactaaactcattttcttatgttatcacagctggcatctttaggttattgaaagcctttaaaccagccatcttcaaggagatgtaattgtcaatgtggtctttatacattattcctgttagcacagagctgcagagataaaaacagtcactaaaatatgcacaaattttctgtatataactttcttatttcaagttcatggaagatcagtaaatgttaatgaggattaaaaaccattttttagatcctggtttcctcattagatgcacagggcaatcaacccataaaggataatttattgatactacaacctgaatcagacttttgaaatagttaattcattagttccaggaagttctgtgatctttttgtgtataggtgaagctgcaagaaagactgtttcttgaagtataaatgatatatcagaatcaggaaaaataaacccaaattctgacattcttggatgagtaattatatgttgttttatctatttattctggctgcacagtccaaggacacttctagaaaggttttcacactctaatcccattctcccacccatcactactacatgctcctcaaggaaatttttcccaacagaagtaatagggttatcagaacaaaacagaacaacaacactctccctaacaaggcattctagaatagggggagaaaatcccaaaacataaaggagtatgaaacagaaagaccagatatgaggaagggtaagatggcatcagcctagcattaatgattattaaaagattcactacaggtttatcttatgtgaaatcaatcttcctttaggccccacaatctctgagtacaaatggtacaaactaagagtaattaatggtgtatatatcacattctccaatagtacagagtctccatctctcctacttatttttgggagtcctcagggtgtaccttacctgccttaaaatgtgaccactgagcctgcattgattccatcgatgccatcagcttctgctggtcacacaggtaggaaggggccctgccacgggtccgtagtgatgcttccttcattaggctgctgccttctgttagcacactgacccattctatcgggagcatttgatgcactgaaaccataccaaagctcatgccttctgtgtttactcacgttctgagctgagaacatggatccatgggaggctgaggtgagggataaatccaaggtacaaactacatgctgaacttggaatcatctagacactgaggtccatggccttaactttcatgaggaagagttcttgactcagaaggcctgttagtctctcatgtaaataactacaactagcttgtctcccagacatttctgcatcccagatgtggtgcaacttgggttccaactgaagtctgtcatatttacgtatgtaaaatttgacctccagatttttgtcagcattggatgaatcagtttcttcccaaactctggcttaagctctgaatcactgatcactagtctggtcgggtataatccaatacactgggactcagccatcctttaactcagtggtctccatgctttttggcgccagggaccagtttcatggaagacaatttttccatggacctgggaggggtgggggtgtgggaatggttttggaataaaattgttctacctcatatcatcaggcattggattctcataaggagcacgcaacctagatccctcacatgtgcagttcacaatagggtttgcactcctatgagaatctaatgccactgctgatctgacaggaggcggagctcaggtggtaatatttgcacgcctgctgctcacctcctgctgtgtggcctggtaccagtccatgggctgggttaaggaccccttctttaactcatgaaatctcacggataactgattccagacttcaaatcattgcacacttaaaaaaacttttttacaatcatgtttgttaaaaaagtactgcaggtaggaagaatgacaatacacttgaacgtaaacatggtttgtcatatatattggtcaaaacaaagcatgtatttactattatttagctacaatgttagaaaactgccattgcacatactccagcctggaatttcagtaaacgcttttcactgtctatgtgcaggattatgttaagcccactacattttaatgttattgctgcagttataacagacatcaactaccaattagaataatgttttatttactgtctatatcaagaaaaatcccattttaaaatggttaaaatgatctactatatctcagttacattgtaataggatactagctaatatctgtcatgataaaatctggagtaaatcagttaaattattaatcttgataattttaagataaaataaccctttgttctcaaatttaaaaacttcatattttaatatatttgtgagctaacaatagaaatgcataccaaattccaggacaatgttttctttaagcaaaaaattaagcctgaatgttggtgcctttagaaagtaaacagctaggccaggcatggtggctcatgcctgtaatcccagaatttcgggaggctgaggcaggcagaccacaaggtcaggagttcgggaccaacctgaccaacatggtgaaaccccgtctctactaaaaatacaaaaattagcagggcatggtgatgcgcgcctgtaatccctgctacttgggaggctgaagcaggagaatcacttgaacccgggaggtggaggttgcagtaagctgagactgtgccactgcattccagcctgggtgacaaagagcaagactctgtctcaaaaaaaaaaagtaaacaactatggattttggcctgctatatctctgggcagctcttgcagtcatatctagtcatatgagtcaaagctcatattatcatctttgctgtctttcttcttgcctaccccaccctcttttagcaatgatgataattataacaacagcaaaaatataatataaacattacattagcattttagcaggaactggatattttcataaataggattcctaaataattgaactttattggctaacattaaaaagcttaaatatttttgatggaaaatgtataaaatttacatacattaagtaaaatttatatgaaatatataaaataattatatattatcaccgttttaaaattttcttaatgaccaactgcttcgagttctagaaccattggtgctcttcagatgtatttattcattcacttttccattcattcattcatccattcaacaagtatctattgagtgttactatgtcccaaggaccaaaaaaggcaggagagatacagcagtgaataaaacacaattagtgctgtcctgatggagcttgagttcaagctggtatgcaggatgttttcctctgcaacaaatgggccctgactgctgtggttttagttgttctgtctcctccctctgctgtcagctgtcacctcttggtggcaccctatctctccctttttatctgggttacaattgcaggtctttccccaaagcatctctctatgtcaataatagaccctatccttggatggagcctgagcagttcctatgcttgcagtgtatgtgctgcttccggcccttgcgaggagttcttttatccctactctcagtgtttggaacaaacatcttcctttgctccctttcatcattcatgcgcttgtgtttggaacaaacatcttcctttgctccctttcatcattcatgcgcttgtgtttggaacaaacatcttcctttgctcccttttgtcattcaagtgctcagttctaatgatctgattcaattcttaggcccaatggtctctgcaccatatatatgcaaatgggactcttagaaaagtgtccatcaccaagtgatattacattctaatattgcagtataaaacatgatctttctcatcactgtggtagcttttcctgataattttctgaactgccacctaaatataaaaaggcaggcaccaaaactttcaaaaggaaaggaaatcaatttccctttactcccgtgttttgctcattgctaaaactgcctggtaggagtgcagggacacaagcaggaattctgaattgcacttaaggaaatggtagtaactaaggtgataaggaatatctaacactcattcatagactcatcagatgttggagttgaaaggggatcactctgtgcggtagtgaagcatggtggttaagaactccagttctgggaccagattgtcatacgtcttacaattgtttgaccttggcctggcatctccatgcttcaatttattcatctgtaaaatagtatgtttttcacaggattgtgaggattaaatgaattaatgcaggtaaaacgcttggtagtgtgtctggcacacagcaagcacttagtgttagctattattatcccaatctcgtcacatatttttacagatggaaatacagccctaagcttttaactgaacagcaagttagaggtaaaactgatgccaaaaccgggtgtcctgattctcaccatattatagacttttttttccctgatatcgtgctttcttaataaatgggaagaaatactgaatcatgtacatgattataaaatgactactcagttatacaaaagtccttcttcccctctaaaacagaaatataaaaatacacctttgcccagtgctagtcctccagctcccaatgggcaggattaattctctagaggcatgtgacagagctcaggaggccaggagaagtttaactgtatgcactaataaggaaaccattttcttccttaccttaaacttgtcaacttcagcttttgaacatgttgcatggtatgatagcacctgattcagaagaaaaaaaaataattttaataactagacatgactgtattttctgaaattctcctggcttaaaaataagctttgcttatgtatatcaccttgatttaaaggtggactttaatgtatgacaagaaacaacatgtctaataacattctctgacataattcacatattaaagaatattttataccgggatttttctatgggtagttatgtcatcaaaaggacaatggccaggtgcagtgcttcgcgcctgtaatcccagcatttgggagggcaagatgggcagatcacttgagcccaggaatttgagaccagcctgggcaacatggcgaaaccttgtctctacaaaaaattcaaaaactagctgggcatggtggtgtgtgtctgtagtcccagctattcagggaggctgagatgggaggatcacctgagcccaggaggtcgaggctgcagtgagctgagatcatgccactgcactccagcctgggcgacagagtaagaccctatcaaaaaaaaaaaaaaaaaaaaaaaggcatgctgtggctcaaaactgtagttcccaaaggatgtgaatacttgtcctgtgaaatgctctacaagcaaatgaaaagctagagcatgtgtgtgcgatctgtagcaaacactgtaggttgatgactcaacttccatttcctcacctattctcatttgcctgcttttattatattaggaaagattatattgatatatatctgtgaccccttttgtaagaggattgtgcttccctgccctattgacatcagcattggcatatgacttcttttggtcaatgggaaaagtaacaaatgcccttttgagtgtgtcttcaacagcaatcacatagttctgccacctcctttttccctccaccaagggaagggcatggcctgagaggggccgatccttcagtctgagcccccaaataaagaagatatattgagtagaactgcagccaacctgcagctgatggcatgtcatttgagtgagaatcaacttttgcaatttatctacatcataactcactgacacagaggcttaaaagttaaaaaccccaattcgcaggctccctgcagctggggtggtcctatagggtggcctttatgacacggccttggtcaatgaattataagtgggagtgtcggcgctgcttctttctttttcttccttcatggaatacagctgtaaagcctggaggtgcagcaaaatctggtgtgtatgaggtgacaagcatggcagtgaatgccagcttgctgtgaacagaacagaaagggaaagagaaaggaccctgggctcccctgccccagaattcttgttgtgtgagacaaataaatgcacattggtggcattttataaggcatatttacagacatatacacactcacacataaatagcatatgtatgttatatgttttatgctgccagacacatgtttgttgtggttttgtttttgagacaggtctcactctattgcacaggctagagtgcagtagtgtgatcatagctcactgaagccttgacctcctgagctcaagcgattctctcacctcagcatcccaagtagctgcgaccacaggcatacaccactatgctcaactaatttttgtattgttttgtagagacaggtgtctcatcatgttttccaggctggtctgaaactcctgggttcaagcgatcctcccgcctcagcctcccaaagtgctgggattataggcatgagccttcgcacccagcctacattcttaatctacacaaatctcaaacaaataagtctgggaaatgctaactccttcttcacctacaaaccttagagaatcacagtgcatatttggctgcaaaaagtaaagtaacatgctttatttcattaaacttagtatttcccaaatttaattagccacagaactcccttttaggtaacattaaactggtaacattcaacctaataacctattgaccaagaactttgagaagcactgacctatggcacataccatttgtgtgatacaagcaaagccacaatggaagcagtgtctcagggtggttagaacacagccttcagagtcaggctgccacgcctccacttccgagccctgggagcttgggcaagtggtttaatctctttgggtctcatttataaggtggtataacataatactacacaggcatctcctgcttaacgtagaggctcctcctgaaaacactaacaaggagtctacttttaattatttttaattggaaaaaaattacagtgtattataagatctgcagcaacttcttaaaactcaactaaagcacagtaaaattcataggtatatttaaaacaaaaaatacagttatgttatagttacttaaaatgttactttctgtgggaggctgaggcgggcagatcacctgaggtgaggagttcaataccagcctggccaacatgatgaaaccccacctctacaaaaatagaaaaattagctgggcatgatgatgggtgcctgtaatcccagctacttgggaggctgaggcgggagaatcgcttgaacccgggaggcggaggttgcagtgagccgagatcgtgccattgcactacagtctgggtgacagagtgagactctgtctcaataaataaataaataaataaataaataaaaataatgctactttctgatcataactaatatagttattaacaaaaagtttctttgtgttaagtaatactttctcttccattgtagacttttttttactgagtttacttgtttttccatagttttctcaatccttttttatctttgggaggggactcagaaaaatgttgtattgagagataaatatgttctatgaggtttggttattaaaaataaagatatattctactgggaaattttaaccaaggaaatattctatggagtgggcctgtactttacagagttcttaggaagattaaatgcaatactacatgtaaaataatgtggcacacaaatagccaacttataggtattgtattaatattcaattaaaattctaccaaataaatatttggctggatattatgttatgtcattatcttatcttaaaatatcaataggtatttcagtgcacagatgaattgattttgctcttttgtttcagttttactgtggtaaaatttaatttggctgtcattttattagaatttcttactgttttcaagtctatttctgcagattcactcttcaaactttacctttaaaaaataacccacaaaaactcaagctgcaattcaaaatctatgccaccaggtggtgcttagttaggtttgtttaaatcaactcttcccacttcctttatttaaaaaaaaaaaaaagctatttactccactaaattgaaacaatttgaaacagtgaagcagacaattattacagattaagacttttgctcatttaaaattacaatagtttgttttgtttgttattgagttgtaggagttctttgtatattttggattcaagtcctctgtcagacatatgtttcataaatattacctccagtctatggcttgtctattaattttcttttaatgtgtcttttaataaacagaagttttaaattttgataaagtgtaatttgtcaattatttaaattgctatcgtttcacatattatttctttctttttttttgaagagtctcactctatcactcaggctggagtacagtggcatgatttcagctcactgcagccttgacctccctggctcaagtgatcctcccacctcagcctcccaagtagctgggattacaggaacacaccaccacgcccaggtaatttttttatagaaacagggtttcactatgtggcccaggctggtcttgaactcctggattcaaacaattctccctcccaaagtgttgtgattacaggcatgagccactgtgctcaatctcacatatcctttctaaaatttttttactgcccccgagttgtgaatatatacctcatgctgtcttctacaaactttatagttttatcttttatgtttaggtctatgatacatctgaaattaaatgtatgtacagttaaagaataagaccttaacgaaataaatacatgctttggttactttttcatgattcttaaatttcatgggccacatcttagacctaaagcttttttggattgtatcctgagattttaagcctctactggctaatctattaagtacataggaatttatttattctacctaattagacaaagttaatgataaggaagcttctggtttaccttctggatcttcttgtttctgagagttcctgtttgtaggactccaagaaccagtagaggggggagagaaatggtctagctaaagaatctttcaactaccttttcccagaagagtacaatccatgttggtgagcagggaggaatcatcggctaataggagtacattgttctgaaggactgggccctattgctaaaccacagtccaggaagatggtagcattgttccctctaagaatccgtagaaaaaccaacaagccagaggagtggattccttaagataagagacccttaaatcttgcttaagaactctgattttcttctttaagcagttccttctgtttggtcccataggattttctgggatgcattcagaaagatggtggtgcttcagtttaccctcagtgtttgcaggttttacacacagggcacagcgagaacccagtaatatctgtacctctttcatgtattgtatcaatttagccatcatgcgattctgactggatgtaaatacacaaccaagctaagtttctgcttagctcccagcttcttgttgaaaagcctgtgaccaaatgtatttgccttgctaattttaacaagcatctacacatgctattgtggtcacataggacttttccccatcacctatggtcactggccatatcccatttactcctcaatatgcctcagttttggttctgcccccacctctccactggaacagctcgtgtcaaggctttcaatttcttgccaacaaatccattgatgaatctccaattgccttttgcagcagtattaaacttgggagagcactcactcctattttgaaaagtctcctttctgggcttccatgacaccacattattttggttttcatcctatttctttggctgctctttatgttttcttttttggcccctcatcctctaccttaactgtaaatgtggaagcttctaggctcagtctcttcttcagtgatgccatacactctcatggctttatacaccatcgttgtgttgataactttcaaatctctttgagttttgcactcacatattcgtctgcctacattactaacttccaacttggtcaattcactggcttttcaaatttaacacgtctaaataaacatgaagattttcccatatgtgatagacagaataatgctcccccacaagatgtccatgtcctaatcactggaatctgtgtatatgatatgtcacaaggaggaactgaggttgcagatggaattaagattgctaatcttgtcaccttgagatggattatcttggattatctggctttgcttcatgtaatcacaggggtccttataagtgaaagaaggagacaggagaatgagagtgatgcaatgtaagaaagacttgactagccattgctaactttgaaatggaaggggccacgagcacagaatgcaggtaggttttctgtggaaaaggcaaggaaatggattgtcccctagagtctccagaagaatgtagccttacatacatcttgaattttgcccagtaagacccatttcagacatctgacctgaggattgtaagataataagtatgtgttgttttaatccactaagatcgtggtaattcgttacagcagccacaggaaactaatataccacacaaacccatttctctctcagtcttccccagctctgtaagtgccactccatccaatcaattagtatcaattggatactaatccagtctccttggtacacatcagccagagtgatctttaaaaagtagaaatcaaatcatgccatctcccagctgaaaagtcaccagtggcttcccactgcacttttgctgtatttccttcaatggcatccacagattggtcacaaatctcaggttcatgaggttaggtccaaagcctggatcgtgactggacaggtcctgcaccatctgactgttggcacgttctcaaactaaacttcgtgctgcctgtgctctgtcttctacacacttggccacactcatttttgttcatttttgttcatttatacaccaagcgcttttctacctcagagcttccctgtcctcatcacctcattggtatcatcttctgaaactaagttaaatgtcaccccttcagtgacttattccctgaccaccatgagaaatcagcctctgttaactccattattctctgagttaagtggctgtttccttcatgccacttgcacaattggagttgcctgttatcttattcatcacctgcctcccctactagactgtaagcactttgaaggcaaggattggtctagttttggtcatgaaggtatatcctatccctgggagtatggttgatacttagttggcacttagtaaatatttaatgaatcaaggaataaaaaataaaaacattttaaaacagtatctccattacccatatgtctcactgtttgtattattaatggcctgaattagtgtatttttttcaatgaaatcatgatatgccttatatatgagcataaagtaagcaatgtaggtaggatcaccagttttagcaaataaaaatagaggacacccacagttaaacttgaatttcagatcagcaataaatattttcactatttgtgtcatatgcatacttaaaattgatttatggtttatctgaaattcaaatgtacttaagtgtcctgtattttatctggcaaccctccttctacatgctccaaattaagaaggctagaaacaaatccggaaaacgctaagctacatgccaaaatactgtttctcctttcacccccacctcacaacatctcccaatgacatttcttccaaaatattttatctgctaagcttaccaaatgcctcaagtctgaaatattttcagcaatgctactattatgaggggaattgtgccccccaatccccaccaattcatttattgaatttctaattcccaggacatcagaatatgactgtatttggagacagggcctttgaagaggtacttaaggtaaaatgaggtcatgtgggatgtgggtgtgtcctaatccaatatgactggggtccttacaagaagaggagttcggaatatgaataacagaaatagaagaccaggtgaggacacagagagaaggtggccatctgcaagccagaaagatagccgtcaccagaacctgaacatgttggcatcctgacatggtttggctgtgtccccaaccaaatctcatcttggattgtagttcccataatgtctatatgtcatggtaggaacctggtgggaggtaactgaagcatgggggggcagttaccctcatgctgttctcatgatagtgagtcctcatgagatctgatggttttataagtggcttttcccccttttgctcggcacttctccttcctgtaccatgtgaaggacatgtttgcttcccttctgctgattgtaagtttcctgaggcctccccagccatgctgaactgtgagtcaattaaacctctttcctttataaattacccagtcttgggtatgcctttattagcagagtaagaaggaactgatacacaccctgattgtgaacttctagcctccagaactgtaagaaaataaatatttgttgtttaagtgacccagtctgtggtattttgttgttatggcagcccaagcaagtttatacagtcacataacctcattaacctaagacctgtcacaaatctatggaggccattgaaggaaatataaaaaaagtaattcttaattacttttagcatagtcaatcttcaagagaatcgttactgttttatatacataaataatattatatggctcagataatgactaaaaatcaggcaaatttctatagttgagaataaatcttaacaaattgcagaatcatattatttaaaagtactattgccctaccttcctggataagttagtttcctccacaattccaaactatatatttcatagcaagtatctaggttcatcatacatttttgaataataatacctttgatcaagtaaaaatgctttaattgaatgcattataatagttttgaagaaagaggcatttgtaagacatggttttataaatatactatcatactctatgagaaacaggttatgagagtattactataacgtacatatcagttaattttttcgacagctaaataaaatttgtgtaaagcatacatacaaaagcaaacagttaatccacagaacacttgatgagcattaaactttcacaagaaaatttctgatagatggatttatcttttgtgttggtattaattgagcaaatatttttgactcagttttgttggtgagctctgacttaagaaatttttatagtttctaaaataaatcactatttgcaaaaccataccaactttaattaacttttggattgaacttgcttccagcaaaacaacaacaaaaaagcagataaggcaattatcggacccatgaaagagagaggaaagaagtcacgtttttgtgttgcatttacacagcaagaaaagacaattaactatatttcaaaagaaaaacaatgggcagagctatgagataggaccactggatcaagccttgccattctctacatgcagttcaggaccagaaccaaatgcttgtcttgcagcccccagaactgtccctgagtagctggaagacagacctcttgcaccaattgtcttgaatgttaatttgttgtggatttgggcagccatttgctcctgaaatgagatatggaccattataccagcagagagaaacacaaatgtaaagaagcacttaagagcgaggaggaacaaagaccccactgaggatccagactgagtgtctcaggcacaaaagggctgcatgaatacgtttattgctctgctggcaaagtggcacttggtaaaggctggatggccgacttaagctaagctgatctgaagtaaaatcccaaataatttatattgatgagctccaaagaaataaagaagctttgctctcagcagtagtccttaaactaagaaagatgacaaaccacaaggaatgaaaagccaatttacttggaataacccgacagaagtgtcatctaactatatgaagaaccatactccaggatttcttaacaagatgatgacagtattcaaagacatggcaactgaacagacgcgttgaaactgagaaatcatcagtttttattgtcaagtatttaagacactgctgtataatagaatgaaatgttcaaaaggtacttcagataactgtgtctgctgtgtgatctgttatcatgaccttcagaatcgatcataaaaaatatttttaaaaaatctaagaaagattcatttttttaaaattgaaagtagaataaaagatacctgccaaacatggggtaataataaaatacaggcatacctcagagatattgagagtttggttccagacgacctcaataaagtgaatgtagcattaaagtgagttacatacgttttttggtttcccagtgcatataaaagttatgtttatactatgctgtagcctattaagtgtgtaatagcatatctaaaaaacaatgcacataccttaatttaaaaatacattattgctagaaatgctaatgatcatctgagccttcagcaagtcgtaatatttttgctggtggagggtcttgcttgaatgttgagggctgctgatagatcagtgcggtggttgctgaagctatggcaatttcataaaataagacaatgaggtttgcacatgaattaactcttcctttcatgaaatatttctctgtagcatacaatgctgcttgatagcattttacccacggtagaacttctttcagaattggagtcagtcctctcaattcctgccactgttttgtcaactaaatttgtgtaatattctaaatattttgttttcatttcaataatgttcacagcatcttcaccaagtgtatattccatctcaggaaaccactttctttgttcatttatgagaagcaactcctcatctgttcaagttttaccatgagactgcaacaattaagtcacatattcaggctccacttgtaattctagttctcttgctatttccaccacatctgcagttacttcctccactgaagtcttaaacccttcaaattcagacatgagggttagagtcaacttcttccaaactccggttaatgttgatattttgacctcctccagggaatcataaatgttcttaatggcatttagaatggtgaatcctttctagaaggttttcaatttattttagccagatccattgttggaatcactatgtatggcagctacagccttacaaaatgtatttcttaaataataagacttgaaagtagaaattactcttgatctatgggctgcagaatgaatgctgtattagcaggcatgaaaacaacattaatatccttgtacagctccaccggagtgtttgggtgactaggtgcattgtcaattagcagtaatattttgaaaggaatctttttgtctgagcagtaagtctcaatgggaggcctaaaacatttagcaaaccatgctgtttactgatgtgttgtcatcaagactttgctgttccatttatagtgtacaagcagagtagatttagcataattcttttattttttattttttagacagggaatctcactctgtcacccaaactggtcttgaaatcctgacctcaagtgatcctcccgcctcagcctcccaagtagctgggactacaggtgtacaccaccacttctggcttgatttagcataattcttaagggcccgaggattttcaaaatggtaaataagcactggcttcaatttaaaatcaccagcaacttaccatagcccctaacaagagagtcagcctgtgctttgaagacattgacttctcctctctagttatgaaattcctagatggcatcttcttccagtagaaagctgttttgtctgcattgaaaatctgttgtctactgtaacaacctttatcaatgatcttagctagatgttctggataacttgctacagcttctacatcagcacttgctgcttcatctcacacttttatgttttggagatggcttcttcccttaaagttcatgaatctctgctagcttcaaacttttcttctgcaacttcctcacctctctcagtcttcatagatttgaagagaattagggccttgatctggattaggctttggcttaagagaatgttgtggctcatttgatcttttcttcagaccactaaaactttctccatatcagcaaaaaggctgtttcactttcttattattcatatgttcactggaacagcatttttaatttccttcaaaaacttttcctttgcatttacaacttggttgtttggcataagaggcctagctttcagcctatctcaccttttgacatgcctttctcactaagcttaatcatgcctagcttatgattaaaagtgatagatgtgcaactcttcctttcactggaacacttagaggtcattgtagggttattacttggcctaatttccatattgatgtgtcttggaaaacagagaggcccaaggaaagggagagagatggggaagagctggtcagcagagcagtcagaacacaaaacatttatcaattaagtttaccgccttatatgggcacagttcatagtgccccaaaggattacaatagtaacattaaaaatcactgatcacagataattgtaacagatataataagacgtataaaatgttgtaagaattaccaaaatgtgacacaaaaacacaaagtaaacacacactgctgcaaaaatggtgccaatagagtttgcggtcaatttgagaccttgcccatcttggctgaattctcaatttctttttcttttcttttttttttttttgagactctgtctgtcactctgttccccaggctggagtgtagtggcttgatctcagttcactgcagcctccatctgctgggttcaagagattctcctgactcagcctccaagtagctgggactacaggtgcgtgccaccacacccagctgatttttgtagttttagtagagaaggggtttcgccatgttggccaggctggtcttgaacttctgacctcaggtgatctgcccgcctctgcctcccaaagtgctgggattacaagtgtgagccaccatgtccagctgaattctcttttaattaaacttcttgaccaaagagatatgccgtttttgcttttgttttatccaaaggtatgaagccaactctccagtggtttgagtgggccctcaacttgggatgagaaattcattcaccattttttcacccaaatcaaaggtttaatgtaatcattctatgtcattacccagattaaaatgttaattttagtaaccacactttaaatctcaatctaatttttaaatgcaagccattaagatgcattcataaggctaaatactattcattagctagtacataatgacaacactgacattcatttggcagtttcccaaactatctttccctctaaatattggtacctgtgcccttgccagaggataacatatcttgtattatataaatcttgaaatttaacaggtactttgcaactacatccaaattattatctggtgaattaagatgaccacacattctttgacactatttctatgagaggtggggtctatgtcccttccctttgactctatgtggggtttgtgtttaaaccattaagttgccaaaaagtggttaaaaagcaataaataaacaaaacattatcaacattcaactgggacttgccaccctatgccatccaaagatttctgtaatcaggtgtcaactgaagcttccttgtctttcaaaatctaggtaagatcaacgtgaacccctaaactcatgaaatactatggaaattcaaagcctttttcaaaatgtctacatattcttggcaggtttatattctcatcttggcctttgagttcttatgtattcttgtgctgtatctgttatataatcatcacactaaatgtgaaattcagctccctcctcaatttccacaccaaaaaaatccactcacatcaagaattcataaatttagtataatgtgaagaaggttctttcttttttgcttccttccttccctcttcccttcttccctacttccttcctttctctttctccctcctttttcttctctttctctccctttcttttctttctttccttcctccatccttcccttccttctttctctatctctcccctctccacttgctttctgaaaagacaaattatgaagttgcatcaaaacaaacaaacaaacaaacaaacaaacaagcaccctctcatgaagtatcagctccaccattctcaaaatagattttgcccctgccaccaatggggcatttcactgaccattaatctcgtacagtctcagcctttactcatatttctggcttctctccaatgtaactttctctttttctcttttccccctccctatattcaaatgtataataacacaattctcttcatttctcatacagaatcatttcccacatcctctgattactagaggcagtcaatattcattccctcataatctgtacaatatcaagagggcttgtcaaggattttcccatacaactccttccttagtcttagtgaggaatgctggggcctatggttagataacatttcattcaccttgttatacttcagaagttctcatatgtgtcttaagttatttattagctcagtggttagattctagtcttgtccatgtttttgaggtggtttttttccccctggaatttggactgatttctaaattctttctgagcaacaagtacccaaactaacattttcatatttgtcttccattttttctattaagctcattaaaattactactaccttttttcctgaggccctgcaagctaaagcttattccttgcaatataggcaagaaaaatgagtcagattgccactgcattactcttctgtaactaaagatgctttaagtctaacatctggatagattttgcccaaaattaacctttgtttttattctgtttccacaaaaacgcctcttattgaaaatctgtttggctttgtatttcagacaaaagggtactggttttccagcctattcacttagatttcaaatggcattgatctcttcctataagcattgttaaactggggttaagcattttattaattatcactaggtgctatttcatttaaaaaattatttgttatattcaacaggtattcagatgggtaaagtttatatcttccaggctaccaaagttccagacaaacatgataattgactcaagggttccagcctgtgccactgcaggaaggactgagtccctataaatcattagataaggtagtgagagatttctatgcctccagatcagatagagatgacagctcctgttcaggatgaagcagttacagaagatgaaacctctgtccctctacaaccttttaggattaaggaagagtgcacagtctctgaggagagatgaaaaaggaattcagcaggacttgtttcacaagatacagaccacaaagactgctgataaaacaggatgtggtaaagaagtctgccaaaacctgccaaaaccaagatggctatgaaaacaacctctggtcattctcagtgctcattatacactaattataatatattagcataccaatggaaactccaccaacatcataacagtttacaattacaattacagttacaaatgccgtggcattgtcctgaaactaccctatatgatctaaacgggagaggatccctcaattctgggaactctcagctgctttcccagaaaactcatgaataatctactccttgtttagcacataatcaaaaaataaccataagtatagtcagtcaagcagcccatgctgctatctgcctatggggtagccacccttttattcctttagttaataaagttgctttcactttactctgtcactttactgctggctttcactttactctatcactttatactttattgctggctcttgaattctttcctgcacaagccaagaacccatgtgacctcccaagctgagttccaattttgaggtttgccctgtgacatctttggcttatgaaagcaatctgattaagatccagcttaaaattataatcatgtaagtcaactctactacatagttttgagcacagaaatcagaattcatgctatgaattgccctaggcttgtagtctgaacttgttctctccctatttgcaggggtcagtggtaggatttaatctgtttatacggattaactgctgtatagattacctacagcaattcttaagacaggctgtttcctttcatttagtaaaactttgttttcttaatttgtcaatgcttagtgtgccaacaatggggggccagtatagtttggtctttgagcataggggctttgtgtcagactgctgagctcacaatcctggctcactagacctgtaaccttggcctaattatataacctatgtctcagtttcctcatcagtaaaaggtgagaaatatatgcacttttcaatcatatttcactggccagagcaagttacagcactccacctgatttcaaggaagtgaggcagtgtaatatgatcatgggcccagataggagagaaccagaaaaaaaactgatgatgagcactgatggtaaccacaatggtttgggcaatcaaatagcaagttatgttagaatagcgtttaaagacaattctgggagggcagccaagatggccgaataggaacagctccagtctacagctcccagcatgagcgacgcagaagacgggtgatttctgcatttccatctgaggtaccgggttcatctcactagggagtgccagacagtgggtgcaggacagtaggtgcagtgcaccatgcatgagccgaagtagggcgaggcattgcctcactcgggaagcacaaggggtcagggagttccctttcctagtcaaagaaaggggtgacagacggcacctggaaaatcgggtcactcccaccctaatactgcgcttttccgacgggcttaaaaaacggcgcaccaggagattatatcccacacatggctcggagggtcctatgcccatggagtctcgctgattgctagcacagcagtctgagatcaaactgcaaggcggcagcgaggctgggggaggggcgcccaccattgcccagacttgcttaggtaaacaaagcagccagaaagcttgaactgggtggagcccaccacagctcaaggaggcctgcctgcctctgtaggctccacttctgggggcagggcacagacaaacaaaaagatagcagtaacctctgcagacttaaatgtccctgtctgacagctttgaagagagcagtggttctcccagcacgcagctggagatctgagaacgggcagactgcctcgtcaagtgggtccctgacccctgacccctgagcagcctaactgggaggcatcccccagtaggggcagactgacacctcacacggccgggtactcctctgagacaaaacttccagaggaatgatcagacagcagcattcgcggttcatgaaaatccgctgttctgcagccaccactgctgataccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacggaacaaagctggacggagaatgactttgacgagttgagagaagaaggcttcagacgatcaaattactctgagctacaggaggaaattcaaaccaaaggcaaagaagttaaaaactttgaaaaaaatttagactaatgtataactagaataaccaatacagagaagtgcttaaaggagctgatggagctgaaagccaaagctcaagaactacgtgaagaatgcagaagcctcaggagccgatgcgatcaactggaagaaagggtatcagtgatggaagatgaaatgaataaaatgaagcgagaagggaagtttagagaaaaaagaataaaaagaaacgaacaaagcctccaagaaatatgggactatgtgaaaagaccaaatctacgtctgatcggtgtacctgaaagtgacggggagaatggaaccaagttggaaaacactctgcaggacattatccaggagaacttccccaatctagcaaggcaggccaacattcagattcaggaaatacagagaacgccacaaagatactcttcgagaagagcaactccaagacaaataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaacactttacagacaagcaaatgctgagagattttgtcaccaccaggcctgccctaaaagagctcctgaaggaagcactaaacatggaaaggaacaactggtaccagccgctgcaaaatcatgccaaaatgtaaagaccatcgagactaggaagaaactgcatcaactaacgagcaaattaaccagctaacatcataatgacaggatcaaattcacaaataacaatattaactttaaatgtaaatggactaaatgctccaattaaaagacgcagactggcaaattggataaagagtcaagacccatcagtgtgctgtattcaggaaacccatctcacgtgcagagacacacataggctcaaaataaaaggatggaggaagatctaccaagcaaatggaaaacaaaataggcaggggttgcaatcctagtccctgataaaacagactttaaaccaacaaagatcaaaagcgacaaagaaggccatcacataatggtaaagggatcaattcaacaagaaaagctaactatcctaaatatatatgcacccaatacaggagcacccagattcataaagcaagtcctgaatgacctacaaagagacttagacttccacacaataataatgggagactttaacaccccactgtcaacattagacagatcaatgagacagaaagttaacaaggatacccaggaattgaactcagctctgcaccaagcggacctaatagacatccacagaactcttcaccccaaatcaacagaatatacattcttttcagcaccacaccacacctattccaaaattgaccacatagttggaagtaaaggtctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacgtaatgaaatgaaggcagaaataaagatgttctttgaaaccaacgagaacaaagacaccacataccagaatctctgggacgcattcaaagcagtgtgtagagggaaatttatagcactaaatgcctacaagagaaagggggaaagatccaaaattaacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttcaaaggatcaacaaaattgatagactgctagcaagactaataaagaaaaaaagagagaagaatcaaatagatgcaataaaaaatgataaaggggatatcaccaccaatcccacagaaattcaaactaccatcagagaatactacaaacaactctactcaaataaactagaaaatctaggagaaatggataaattcctcgacacatacactctcccaagactaaaccaggaagaagttgaatctctgaatagaccaataacaggatctgaaattgtggcaataatcaatagcttaccaaacaaaaagagtccaggaccagatggattcacagccgaattctaccagaggtacaaggaggaactggtaccattccctctgaaactattccaatcaacagaaaaagagggaattctccctaactcattttatgaggccagcatcattctgataccaaagccgggcagagacacaaccaaaaagagaattttagaccaatatgcttgatgaacattgatgcaaaaatcctcaataaagtactggcaaaccgaatccagcagcacatcaaaaagcttatgcaccatgatcaagtgggcttcatccctgggatgcaaggctggctcaatatacacaaatcaataaatgtaatccagcatataaacagaaccaaagacaaaaaccacatgattatctcaatagatgcagaaaaggcctttgacaaaattcaacaatgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctgtcaccactcctattcaacatagtgttggaagttctggccaggacaattaggcagaagaaggaaataaagggtattcaattaggaaaagaggaagtcaaattgtccctgtttgcagatgacatgattgtatatctagaaaaccccattgtctcagcccaaaatcttcttaaggtgataagcaacttaagcaaagtctcaggatacaaaatcaatgtacaaaaatcacaagcatttttatacaccaataacagacaaacagagagccaaatcatgagtgaactcccattcacagctgcttcaaagagaataaaatacctaggaacccaacttacaagggatgtgaaagacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcgccatcaagctaccaatgactttcttcacagaattggaaaaaactactttaaagttcatatggaaccaaaaagagcccgcatcaccaagtcagtcctaagccaaaagaacaaagttggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagacatatgtagaaagctgaaactggatcccttccttacaccttatacaaaaattaattcaagatggattaaagacttaaatgttagacctaaaaccataaaaaccctagaagaaaacctaggcattaccattcaggacataggcaagggcaaggacttcatgtccaaaacaccaaaagcaatggcaacaaaagccaaaattgacaaatgggatctaattaaactaaagggcttctgcacagcaaaagaaactactatcagaatgaacaggcaacctacaaaatgggagaaaatttttgcaacctactcatctgacaaagggctaatatccagaatctacaataaactcaaacaaatttacaagaaaaaaacaaacaaccccatcaaaaagtgggcgaaggatatgaacagacacttctcaaaagacatttatgcagccaaaagacgcatgaaaaaatgctcatcatcactggccatcagagaaatgcaaatcaaaaccacaatgagataccatctcacatcagttagaatggcaatcattaaaaagtcaggaaacaacaggtgctggagaggatgtggagaaataggaacacttttacactgttggagagactgtaaactagttcaaccattgtggaagtcagtgtggagattcctcagggatctagaactagaaataacatttgacccagccatcccattactgggtatataccccaaggactataaatcatggtgctataaagacacatgcacatgtatgtttattgaggcactattcacaatagcaaagacttggaaccaacccaaatgtccaacaatgatagactggattaagaaaatgtggcacatatacaccatgaaatactatgcagccataaaaaatgatgagttcatgtcctttgtagggacatggatgaaattggaaatcatcattctcagtaaactatcacaagaacaaaaagccaaacactgcatgttctcactcataggtgggaattgaacaatgagaacacgtggacacaggaaggggaacatcacactctggggactgttgtcgggtggggggaggggggagggatagcattaggagatatacctaatgttaaatgacgagttaatgggtgcagcacaccagcatggcacatgtatacatatgtaactaacctgcagattgtgcacatgtaccctaaaacttaaagtataaaaaaaaaaaaaaagaatagtgtttaaagtcagagcaaatgagtccaatgtatgaactctagtatatacatttgtggtttatttgacttttgcttacttcctgattctctcctgtgtttcagggttgtgtttgatagatatgatctccaaataagtaagattatagtatatgtttcttaaatattgtttatatttaacatacatagtacatagagtatatgaccattaagtactattgcttttactatattttgttacctataggagaaaataattatgttaaggaaaatgattggcttatttttgttctataacttttgtgaaatgcttagttattaatttcaatcatttcaatgtccttaaggtgaaagaaattgcctatttctttggaaaacgttgcatgtgataatgagtcttctgatttttctaagtttttagtattctcctataaaggatctcaggcattaacacttaaaaaggttttaatgattaattcttagtgagattaaatatggctctatacatatgcatattggactataatttataactatttcaaaattagtgttccattcccacaattgcattactcctctcattctgttttaaagtgaggctgtttttcttaatcatataggttattaaatgtattaatgtttcacaaattcttttctaatgaactacttgcttatttgcttttctcattaataagaacagagaagaacatagcattcttcgggtataattgagcaacttggattggttattgctgtttctgaaaccactataatatgtgccaaattgttttcaaatctataacttatataactagaacttttagtagtctgatttcacttaagaccatacttctgagtagcatgttattaaatatttatatatactgattttccattcctctccccccatggtttttgcataatcaaaggattaccattatgctttgagagagagatacattgcttatttgcactggttatgcaggaacaccatggagcattttatgtttgaaacagcgtggctctgctgggagctcctgaagtaaaaggaataaggagagatcaggcctagtttgggccactgtcaaactcactagggccacagaagtgactcgtcaccatggatgaaataaaaatgcaaagggcaatttccaatctgtctggaccaaggttgctggccatggagatcagattagatttgagtaaaccagggaatcacatcaatgcagtctgggatgtaccgatgaatgaaccattcattcaatcaagacatatccattgaagacttaatttgtgcccagaactgcgcagtcactaaacaggcaaacatacaagttgaaataattgctacaaagtcaagtagcaaaatgcgaaagaaaccatgggaggaggtgggaagaatggcagggagtggcagggaagttggttagggatgacctctttgagacatgatacttaagctgagacctggaaaatgataaagaaccagccagccaacgggtaggggaagagctctgggcagagggagcagtcacctttgtgtggtgttagggcatgtaagtgggcagaggagacaggagagctgggcacaggcctagtcatgcagggcctttcaggcggataaagacttcattagagtccatgggaagccatccagggtttcaggcaagaggctgacattgtctcattagttttccagtcattatgaccttggaaggccctaatgtgcccctcctcagtgataccccaccccagaagtgaccaccactctgacttttgtggcattcattcccttggggtagtatatagttttgcctgttcttgaacttacataaatggattcatattacatgtagaacatggccctggttgtgtagagggtggactggaggtgggcaagagtggatgtgggagggaaaacagtggctggatgaggatggtggatgcgagacctcgatctgtggagacaatacacagggatctgcaaaaaaaaaaaaaaaaaaaaaaagagctccactcagggaggaaaggaccagagccacagaagcactcagtcccgggtcccggtccctgaaggaaggagccatacaccagagaccatcaaaaaggaggaggaaagggcatgtgaggccacatacaagcaaactggaacccaaaacaaggaaggctgcttccctctgcttgtgagtacctggctccatcgctcacactgcggcagtacagggatcaggcacactgacttgctccggtgtctagtcagtagaaggatggggagggactggaccactttggttcacagccatctgaagctgcagatagtgaatttcattatgaatttgaggcaggaatgggcaccagtattgggaaacacaatgcctttaaacatttctcagtcaacaaatatttattcagtatcagctatgttttaggaactattgtaggtgctagggatacatcagtcaaaaaaagagacaaaaatctctgccagtatggggcttatgatctagagtggagagagtggagtgaaataaggaaaaggtagtgtatcaagtgatgatgagtgctatggagaaaaacaaagcagggaagggagattagcatgttgggggcaggaaagggggcacggcagatttaaataagactgtctgggaaggtggcactgaatagtacaaataaaacctgaaattgcagagagagcaagccgtgtggatatcaggatgagagggtgtagggtgcaagtgcaaaggtcctatggcacaaatgtgcccagcttgtttaaggaaaagcaaagaggccagtgggacagagtgaggaaagtgagaataacaggaggtcatagagggaccagggattagatcacagaagttttggaaaccatcgtaacttggccttttgttaaaacaagtaagtgtaggcacttgctggggataaaaacaaatttcccagaggcaggctcatcgaattgggcccagtatacttgctaaattaaggagccattttcctccttttcaaagagataaaggcagctttcccctcatttctgttaagctcaggggctgctgtcagccccacagacccacatgagccagatctttttctttggatgaatctaattccttggcaatctgggtatgattcccacccctacccctacaccgaccccccaacacacccgacaaacgaatgtctgctgtttgttaattggtgtctggtttttgtttgtttgtttgtttgtttgtttgtttgtttttgagacagagtctcgcactgttgcccaggctggagtgcagtgtcacgatcttggctcactgcaacctctgcctcccggattcaagctattctcctgcctcaatctcccaagtagctgggattacaggtgcccaccaccatgcccagctgattttttgtgtttttagtagagatgaggtttcactatgttgaccaggctggtcttgaactcctgacctcatgatccacctgcctcggcctcccaaagtgctgggattacaggcatgagccactgcacccagccggtgtctggtttttaaaatggcattctaacctttattcttatttcattctacgggatgaatttaatcacggaagttgaatgtgaggttgggagatgggtctgatggggccaaatttggagtttctggacaatgggaggagtgtttagggtgggacacacttttggaaatagacatataaaaatagagggtttgaaaacttccttacattcatcacctggtgacatctgatgacaggaacgggaaggggctacaacaggtaggtttctccagtctctgctctgggcccaacacctgagccaatgttctgattggctcctgtttgcttccattccaagagcagatgtttttgctagaaagtgttgattacccgcttcggcttaactgccacagagtttatcaatatatgtgatgtcacacacacacatttagggcatggagaagggggtgggggcttttatgctctttgtttttaggtgctagtcaaagaccttctgaaatgccttcttgggtacctaaagtcaggcctctcctctttccactgggcagggaattgaagataaccccaagcaggttttgttttaccctttattgatatatgataatttacatatttatggggtacatgtgtttgttacacgcaaagaatgtatatagatcaaattagggaaactgggctatccaccaccctcagtgtttatcatttttatgtattgagaaatgtggatcccacctccctaagactctgcatcatcacatactttcaggtggttagggagggccacgtgaagcaaaagtctcccatgttgtctctggggattgtagataattattactattattttgtttaaactatatatatatatatatatatatatatatatatatatatatctttgctttaagatgccagtatggggcttatgatctagagtggagagagtggagtgaaatatatcttaaagtgatatatatatatctttgctgtaagattttagctacagtaagtctttttggaaaggcctgactgtgactttaaggccataatgaaggcaggtgctgggatggagacactcagaacaggagcctggttagtgtctttgtgacactcaggtgactgacttgtgagagttggcctgggccccaagctttgaagggctccactctgtctcttctatcccctggaaagaaaagtccatggatttccgggacgatgtcattcagattatattccaggtacctgggatcagccaaactaaattccaggtatctcaaattcccccaggtaccccaaatgccccaagcccattgccagtacctgcatgggcttccccctgagatttgggctcctctggatgcacctctgcaggggctgtgtgtggggttgaccaagtttgaaatgtgcataatgtagggctcacacctgttaaaatccagcacagtgtggagggggatctagggggaaggggaggtgagtaactccaatgtcttctaaacggtttgtaggcttagttccttctggttggatttggggtgtgatctgccaccttttgatagcagcatcctggtactgtccccttatgacagcactatcaagatactgagcactgggcctaaagtgaatgtcagtttcttacttggccaactataaacacggctttcataagccaatgttttacaagagaagccagcaggcaaaggcatggctgttccactacagaaagctgttctctttcgcacactgtggggtaactgacctgagtcaactaacttagactcagcaactgctccagaaaaaagtgagctgctggagcccaacagagacactggctattactcctaggatctgcactgtaaaaccaaaagcattagggttgaaagaaacagtttccttactgacaagttagtaattttcagtgaggtaaaagaggaggaggaggacaatacatttccaagggtgctttattcagtttgagcttttaaatcaatgggcaagtcttcattatttacccttaattactgtcatcacagtctcataaaccagaagcatgcccccggtgtagaaaacaggccctttaccttggctctcctcccacttccatcagggcagccaagggctccagtggtaaatgctctcctgcaactgataggacattcctcaaaagagcccttgcggtacaatttgtacaacatggccctttgaaacagatagatctgagcttgaatcctggctctacttctagctgtgaaatgcaagccacaaaacctctctcagcaagttcctaaacctttctgagcctcaatttgctcacttgtcaaatgggaatgatactgtgtactccatgctgttttggtgaaggttcaataaaatacatatgcaaaacacataattaatgcctgacacataagcatttaataaatatagcatttcaaaaaggaccaaaataacatagcaaaagcagaagaaataagaagaatgtaaggtaatgaaagaaaaattttaaacaaataaaccagaacaaatgcatccaaataacaattacttcttaaggctactatggggactatgttaagttactccaaatgttctgctgtgtttgggaactcttatccaggatctcaaagtacgttccttagaccatgacagtggtggcaaatcatttgagagcagatttgattttggaaaaccacaaaaatcatttaacagaaaataaaataaaaacatgatcaacaattttgttttaaaaaagtatgattatgaaatactaagataaattttatcttctcagctgccaacatgatctctctaaaatgtcaaactaatcatgttcctctcctgctgaaaacacttcaatgattctccactgcttttagaatcaagttcaaattccttcatgtaacacaagcatcctttgtgatctgaccccgggtagctctccagcctcaggccctgcctctcccctgctgtgcccttttccctgtctgcattgaggtgcttgaatagcatgctacttcagttctccctacttttacctatgactttccttctccatggagcattcctgctagttgtctttagaaattgtatagctcactgctacctgtcactctgaaattgccttctatgcaaagcagttatgtctgactttgaacaagatgccccctcctctatgcttcccctaacatatctacctctttcttggagctcgttacacttggcagtaatcatactttcatttatctctgtcctctattagactgaaatcacatgagattgtactacagcttatgaaatttacatagtcgtagtctactctatgctgttttggtgaaaatcgagttcttggcacataataggtgatccattcgtaacattaatgattatttatcttacaaatctcatggtttccattaaagtgtttcaaacatatttaaatgatgatataattattagaagtagtacatagactcccctgcagactatttgcagagaagcaccatttgtgcatacacataagttcttttttgttgctgttaaaaaattaccttactggattctggtataaaatgatatctgatgaagaaaggagtagtggaatataaccctaagtgtaaaacaaatattggtgtatatatatcctgagtatataaatatattgagataaataaacacataaacagagagaagagacaaatatcccatacaaaagaattctaaataatatatgtagataattcctcttcaaggaggtggagcataactccccactccttaggtgtgagctgtgcatagtgacttccttctaaagactacagtgtagaaagaggaaaaaagagtaactgtacattggggaaacctgacaaacactacttccaccagacgatcaaggttaacatcaatcatggtaagtcattttgatagtatgtccccttgatatgatgtgattaaaatggcacttaacctctgtgccttcctcccccaaacccataattttggtgtaatcgtgaggaaaacattgaacaaattctaatagagggaaactctacaaaatacctgaccagtttgctcgagactgtcaaggtcaacaaaattgaaaagtatgaaaaagtatcacagccagggagagtctaaggagacatgatgaatcaatgtaatagggtatcctgaatgagatcctggtacaaaaaggggatatttggttaagattaaggaaatatgaatcaagtatggactttagttgataataatatagcaatatggttcattaattataacaaatgtaccatatcttaatagaggaaactgggtatgaggtataagggaactctctgtactatcttcccaatttttctgtaaatctaaactgtcataaaatataaagtttatttctaaaaaatgatacctcacggctgattctccatgtaagttctcccactttccacagaatacctaaatgaaaacctagaaaccatcaataactaaaactgataacctactactagaatatgagaagaattttcaccaagtataaggcagatgcagctggactcagaaaaataactagtagcttaaccatgctttatctccacccccaaaatgaagcagtcccccttggtctgaaagaagatgggaaggcattgttctgaaagcagtctccagagggcagtgttcctttctgtactgtctgagctctcattcagagacccaggatctgtgctaaccagaaaattaaccagttcaccttctactgaatggtagctgtttttgaagtattcgctttcatcttgtgggaaagagtcactgcaaataaagcactgtatgatggtggggggtgggggatgttataatataaataactactacttttgacattatatgaacacagtggtaaagattttactggcgttaattcacttcatcgttattaacaatcccacaaggttgggaagtgagaacaatgaagcacagagaaattgacctgccctgagatgcacaggtaaaaaagtagcacagctgaaattaaaatcctaatagtctcagaacaaaggttaaaaaaaaaccttaagaataatcctaacagtctaattaaaaaaatttttcttttttttttttgaaacagggtcttgctttcttccccaggctgtggcatgatcatagctcagtgcagcctcgaattccagggctcaagggatcctgccacctcagcttcctgagtagctgggactataggtgcatgccaccatgcctggctaattttttttcccttttgtagagatgagatcttgctatattgcccaggctggtctcagactcctggcttcaagcaattctcccaccttgacctcccaaagtgctgggattacaggtgtgagccaccgtgcccagcctctaacagtctaatttaaagcctgcccttttaatcacctaactgtagttcattcaaaaaccctcgtagcagcgtatgctgaggattgagattcttgtactttaattatgatttttatttgtattttactatacttgatccactcaacaaacatttcctacatgcctactgtgtgctgctggtactgggcacataatggtgaaccagacccatagacatatttctatacataagggatccagaatccactgagacctgatggggggaagaatattccatctcagcctagcaggagtacactagatctatgtctacatgctagatgctgagaatcagcctagtaactaaatattagtacataagtttgctccccttttgtatatctaaccaaggagattcaacaggacataagtggaccacaaaagagctcaggggcaaccccaaagtcttgcctgttggcaaacactgcagtccaagggaaggagagaagcaccctaaaaacccagagagaatgttttaatacatctgataattgtttcatgcatgcaaccttttagaaatcttatgcttagtatcttcaaagatacaagaagaaagagcatcattgaaagtggatcagaaaaccatataggcaaaatatgtttgaatgaaatttataaaacaaacagaagaatgagttaacatagttcaactgtcacttgctcagggtggtctctcctgaatgtatccacagtagccccatatttttagtcactttttattaaaacatcctgctttattttctttatgatacagtataataaatttatcttgctaatttatttgtttacttgtctactgcctgtcttactagaatataaggttcatgacaatatgaatactgtttgatttttaactgctgagtcctcggtatggagaatggtgactaccaaaaagtagaagctcaacaaacatttactcagtgaatgaatatatagacaacaacagagatggttaaaatgtggaacagtttcaaaagaactcaaattataatagcagaatttaagcccacattggagttaataaatattttttaaatgcaagagctcagaatcaacaatcaatggaaaagaatgcagaacagaaatgggccaacacttattttttaaacaatggtgccaaagtgatcccatggaaaaagaagaactttttaataaatgataaatattttatttaaaaatgaacctcaatggctatcaagatgaatcatagagcaaaatgtaaaagctaaacccaaaaaagcttttagaggagaaaacagtacaatatattcttgatttgtgggtaggcaaaggtttcttagatcactaatagcaataagctttaaattaaaaaactgataaattagacttcatcaaagctaaaaagacaccatgaaaaaatcttatcaaaagacaccatgaaaaaatgaataagcaagctgcaaattgggtgaaaatattgacaatacatatatctgaccagggactagtatccaggatgtataaagaactcttccagtcaacaataaaaagacaagcaatcctattaaaagtgggcaaaaaaattggacagctcacaaaagaagacatccaaatggtaaataagcacatagaaaaagagtacaacatttttagtcataagggaaatgaaaattaaagccacaatagaatattatgcacttaccagaatgactaaaattaaaatcaatgatagcattaaatactggtgagactgcagaacaactaagactttcatagttacttgatagaaatgtacaatggtatagccactttggaaaaatatatacctggaagttcttataaaactaaacacatactgaccttttgaccaagtaatactaggtattagcccaagagaaatcatagcatatgttcacaaaaatacttatacaaaaatgttcatagcagctttattcacacagccccaaaatggaaatagccaaagtattgatcaagaggagaatggataaactatggtataatcatataataaaatgttacttagcaattaaaaacatcaaagttatatacccaacctggacaaacttcatatgcattatggtggttgaaagaagccttacctaaaagagtacatattgtataactgaatttacatgaaattctagaacaggtagaattatggtggaaagaatcagaacactggttgtgtctgggggtagcagtgatatcctggggacggagcaaaagggaactttctggggtgataatatatcaagacatttttcctattgaaaaataacaaaattgttgttttaagctaatacattttggggcattttgatatgcaagattagattaccaaaacaaaaagattatgcctaaccaaatgttatgaatacaggtatattcatactgcaaaagcacttgtataaatttaaaaatttgctaatgaaaatgtaactaaaaatctacaatacatgaacaaaaactaggaaactatagggaaagtgcatactccaattctttttttatatagtaagaaattaaaagatactcattcatttttgtcttgagaaatattgattaaagaatgcttttgtaaaaaaaagataacaaataattttcacttcaagtaaggactaaaagaaactaagcaaaatatagtccaaatagtaaaattcaggaaaagcaaagcataagaaagtagaagctcagatagaataagatgaaataatagatataaagcaaaatccctcattaaaagcagaatcttagattagataaaaaattatattcagagcagtgagattatgtcacttataaaaaaaatctcctaacaacaacaacaacaacaacaacaaaaagaccaggagcagatggattcacagctgaattctaccaagcatacaaataactaataccaatcctcctgaaactattcaaaaaaatcaaagagggaattcttcctaacactttctacaaggccagtataacccagataccaaagccagacaaagacacaacaaaacaagaaaattacagaccaatatccctgatgaacatagacacaaaaatcttcaacaaaatactagcaaatcaaatccaatagcacatcaaaaagataatataccatgatcaggtgagatttatctcagggatgtgagaatagttcaacatatgcaaatcaacaagtgtgatacatcacacaaacagaattaaaaacaaaaaccataagatcatctcaaaacatgcagaaaaagcattcaataaaattcagcatcccttcatgataaaaattctcaacaaatcagacatagaaggaacatacctcaacataataaaagtcatacacaacaaattcacagccaacatcatactcaatggagaaaagttgaaagcattccctctaagaactggaacaagacaaggataaccatatgcagaagaatgaaactggacccatatttctcactatagataaaaatgaactcaagactgattaaagacctaaatgtaagacctcaaattataaaaatctcagacaaaatcctagggaggactcttctggacattggcctaggcaaagaatttatgaccaagccctcaaaagcaaaggcaacaaaaacaaaaatagacaaatgagactgaagctaaaaccttcctctacaggaaaaaaaaatcaacaaagtaaacaaacaacccacagaatgggcaaaaagtttccaaattatgcatctgacaaaaggctaacatccagaatccataaggaactcaaataattcaataagaaaaacaagtaacctcattaaaaagtggggaaaggacatgtaagccggcaacaaatacatgaaaaaaatgtttgacatcactaatcatcagagaaattcaaattaaaaccacaatgagataccattttacaccagttataatagctattattaaaaagtcaaaaaacaacagatattggcaaggaggcggagaaaaggtaatacttatatgctgttgataggaattagtaaatctttatgaaaaacagtatggagatttctcaaagaactaaaaacagaactaccattcaatccagtaatcctactactaggtatatccccaaaaagaaataaatcattatataataaagatacctgcacccatatatttatcacagcactattcataatatcaaagatatggaatcaacataaatgtccatcagtataagactggagagaaagaaaatgttatatatatatccacataatggaatactattctgccataaaaaagaatgaaactatgtcttttgcagtaacatagatggaactggaggccattgtcttaactgaaataattcagaaacagaaaaggcaaataacatatgctctcacttataagttggagctaaagaatgggtacacatggacatacagagtagattaatagacatggaaggctacaaaaggtgggaggttgggagcgggtgagaattgaaaaattacctattagatacaatgttcactattagggtgatggatacactaaaagctggctcaccactacataatatatccatgtaagaaatctgcacttgtactccctaaatatattttttaattaaaaaatatatatatatttagatgtatgtagtttacaaaaaaatgcctaaaacaaaatgacccagaaataaaaaataaaataaacagatgagtcaggaattattgttttaaatatatatccttaagaaggatttacctaaaaccccagtagaggttatgtcccctctcagatgctcttatggcatcctgtattttctccttacaagaatttatcacaactattactatattctggtttccatgatttttttttcagtttgcctccacattctaagctctttaaggcagaaataaacctgctttgctcactgccttatttccagtgcccaacccaatgcttagaaataggaaattttcactgaatgactgtattccagaaaaggagtaaaataaaagagaaagcacagataacaacattaatttcaaactaagtcgattccaaggtcaaatcaatgaagtaaaagggtaatcttaaatctataaaagaaacacctcatgttcttgaacctgtttttgcaaataatatggaataaaaatgtataaaacaagaaatattaacaattcaaggagagggatagatgatagactaaaaatatgtttatattccttcctgacaaaatatcatgaaattaccaaaatgctaatatctgatacattcagatcagtagtggaaaatagaaaggattggccagtggtttcaatttatggttaggtaaagaagatctcaaaagattatcactgccttcataacaagaaaaaagagacaaagcaaaaatcatacttcattttaaagctgtcaaagagtgaatgtgagacaaagagaagtctaaacaaataaaattccagtcaagagaagccttttatagaccaataaaaagcagtgactgcttccatatctgggaccaattggttacatagtggagagatgagcctgccatcatagagcaactcctaaaaggagaaaaactagcaatttttcaaatgatagtatgggttggcaaacagactcttatctagaagagccacaaatgcaaaagtaaacctcttggcttgaaaattctctgccacaggaatttgctgtgaaattgatgatgagtgcagagccagaaaactgaaatcttacattcttgcacatgaatttggctggagttgatgccaaagagaactgaaatgaactctagctgcaattcaaacccctcccagctcaaatcctgattgtgaccagttactcaatgcagcctgggtagttgggattgggttgaagggcaaagggaaatcttcataatctctttttaaagcagaaataaactgaaactaataaaaagcttcagccaatccccagctaaagcattgcagatggtcaaatttttatgatcagcctctcattctagctgtctgacatttttaaaaaatcacatatcctctttatgagaaatagaacaaaacaaaagattttatttagttcaaacaaatctagtaaaaatattatttacttttgtccttctatacaacatgtttgatatgcaataaatacttatgaatacatgcaaagaagcagaaaaatgtgacctaaaatcaagagaagaaataatcaatacaggcagacttacagatgcccttgatgttagaattaaagaccaagaatacgaaataacaattataaagaattatgtgttaaaaatttatagaagaaattttagaatatatagaaaaatttatagaagaaaaggtggatataattaataacagttggtaagtttctgcagagaaataaaaccttaaaaaggaaccaagtcaaaatttatagaactgaaaaatgtcagagtgccagagaactgtgggccaatatcatttgattcaacatatacgtaactgggtccagaaagagagagagaataggaaaaaataagtatttgaaaagatattagccaagtattttctgaaatcaatgaaagttatcaactcttagatccaagaaactcggcgaacaccaagcataagaaacataaagtaaaacacatttatgtacatcatagtcaaatgactgaaaaacaaagatctaaaaggaaatgttaaaagcagtaaagaaaaaaacccattacatttaggggaacaacaaaaataatggcagagttttcactagtaacaacggaagccaaaagacagtggtatcttaaaagggctgaaagaaagaaaaaactgtcaatccaaatgataaggtagttagctttaagcagtaagttaccactgatttgatttcttctaaatactttttacattttctataacaattgcattgttcttataatttaaaaacatttttgtttttattattttattttattttatttttttgagacggggcttgctctgtcacccaggctggagtacagtggcatgatccagctcactgcagccttgacctcctgggctcaggcaatcctcccacctcaacctcccaagtagctaggactacaagcgcatgccaccatgcctggttaatttttgtattttgtattttatagagatggggtttcgccatgttgcccaggctggtcttgaactcctgggctcaagtgatcctcctgccttggcctcccaaagtgctgggattgtaggcgtgagccaccaggcctggcaaaaacatttttaaaagaacaactaagacaaatattgtatatgggttacacttagtatacaagaatcctcagaaaactatctgactaatctttatcctcataccaaatatctacacgattactactgttttcactagtctttgtaaaatatttatatatgaagattaactaaaaaacagtttttatgtgtcaatagcccttttataaagagattaaaagtaagaaacaatcacatctcttggggtaggtgagaaaacattaatgaaagacgtgaaatttgaggtttgttagaaaatactttaaggaaatggagaaaagtttcagaataaaaatttcaagatatatttgagaaacacaaataaatctaggttttttcatggagggatgaagcgagatattgatgtcaatagtggagaatcttgaaagatctaatttgtaggcaatggaaaaaaatatttacctaatctaacatgttttgagtaaagaagaatttacaaatgagaacaattctgtatctactggtgtgctacatttggatttctaattgacagcttggtattccttgtacctgtgaatcaacatgagtagatagttatcatttggacaatcactagatcattgtctgacagtaacttggtctgaaaaaattattttggtagataaaaggatgtttaagtggaactcttcctgagtttataacttagaacaacaggtactatattctaaaggtacatgctaagccataggacttggaaagaaaatgccccaaactaggtctacctcctccaagctgagctgctcactgttcatctctgaattgtgtaagaaaagggtaacagtttatgagagagccttatatggaagatttcttagctagggtttcttaaagcttccttctacagaactacttggagaacctaatatgtatttgcccaggatgtgacatgctagcagacactggtagctgatccatacctaaaaattctaaaggttagtggacagaaggaagagagtggagtgctacattgaggggacctgtgtttgtacaatttaatgagcaaagactcattaaattgagtgagttttcccctgacccaaaaagacccatgaaaaataatcagaccatggaagcaaccctagtatccactaatgtgtgaatggataaacaaaatgtggtatatacttacaatggaatattattcaagccttaaaaatgaaggaaattcttacacatgctacaaccttaatgaacctggaagacatgccaagggaaataagccagtcacaaaaggacaaatattgcatgattctatttatatgaggtagctagagtagtcaaattcatagacataaagtagaatggcagttgccacaggctgaagagaggggagtggggagttagtgtctcatgggtacagagtttcagtttgggaagatgaaaaagttctggagatggatagtggtgatggttgcacaacaacgtgaatgtacttagtactactgaactttacacttaaaaacagttaaagtcataaatttcatgtgtttattttaccactcttttaaagcaacaacaaaaacaaaaacaacaaaaaataaccttcaccaagaggactgcctagagaagtgagctgacccccacagagggagggtcaggatgggccagtggaagccaggaatgagaatggattataagctgttagtcaggagaggcaaacccacaagtaattgctaacaggagattcccagccaggcagttatctgaagaatttataaaagcagctcattacaaaaagaaaatgttggtgtctgacacagatggccctgaaatcaagttaggaaatcctaagactttgccctttcatcctacctccctcttgagccctgtacctgaattgggagataaggtgaagtgaggaagagtaaagaagctatgactgtgtctctctcctgactacaggcttctaaatgaagggaagggaagaagctcagagacaatttaacatctgtgtgtgcagacaatttaacatctgtgtgtgccaaaaaagtggtggaatggtactagacagtttatacaggagtggggatgattgattcaacagagtaagtttaaaggaagaagagtgagaaagaatgaagtggcattctacttgtagtctctgagtctagccctttcatccagtgagagaaaatctttcctcggagcttagaagattcctgatgaaagaatcactgcttccacttctctccttctcccttaccttcaggaagtcagattggcttcttcatcctcatctaaggatatatcccatggaagatggtatctaggaagaggtctaccatcctccccaaataaaagcgcaactctgtatctgtacccatggcttatgaaggaggaagggaatacgagctgatgttatgccagtctgtggtcagcaagactgccactaagagtgactgtcaattctcccaacatagcccaagcttttccattccagaatgttgtcatggcagacaaaatgattatttgtggtgggatgcattcatttattccatatacttttattgagtaccaattatatatagaatactgaaaagaataaaagctagataagacatgatcacacacttcaaggcacatatgtttcagcagaggtaaacatacagacttacaattaatgacaatgtagggcaaacaggaacaaaaaagctttgggattagaaatttttatagaggagattacatttacattgtgctttgaatgatgggaacattttgagtggatatggcataattgaaacagagaatgacaaaagtggaggggaggttagagcagagatcagatggcagagaaacaggtagctggtcttcagactatgacatcattgggtttgtaagtagcatataatactcttgagaagagaaatgagagccaggggtaggaaagtttggtatgagatttctgagggcctcaaaggccaggacatttgttctttaataggtaatgggggagtaatttaaggtctatgagtgggtgagtgatgaaatctaaaatatgttttaggaagaacaagtagaaggctattgcaattgtccagtgcagaggtaatggagcccttaagtaggatggttgctgtcacaattggaaaggcagaaatagatgggagaggctttggggaggtagaataaaagaggcttggatcctgatagcatatgcctttttcttactctctgtcaaaccctcatttcttccctcttctgatcctaaagctgtatgcagtgtcccttagcacacagacttatattttctggcaaatttctcttcagtattaggtaaggcttcatttgcagtaactgtgaaagacaccccaaaggacagttcctgatgttcaaaatgaggaagttatattctacatctacatttttattttatttttctctgtattgtggcttttagaaaaaggttcctccttttacctaagaatttctactctcagaaaatatgaacctacattagcatagctcttctgaagctcttggtcatatagaatggaaatcaggatcatgaaattaaagttattaaaatgatagtaaatgcctctctttgttccattattcagctttaagagcatttctgctctctaagagccttaaagtattaattttatatatttaggacaaaggattttaacaatagaattgtataattaaattacaagaaattaagaaaaacagtcatcaaaataattgagttgataattcaattgttaaacaaaatccagataatgtattagtcactccaatttttaaaggctagaacagtagaaaatgttttgtatgcttacatttctatttctcaccatgtgtggattatggctgaaataagctgaagttgccaatatgtgacaacagggaaaggactgccttgcatggtaagtcttttggggaagctttgtccttggagatgtctagcttttaaagacctgttctgtttctgacatggtaaattttgtatttctatgccctagacttttctgcagatacatgtatagtaacacaggctacagacaatgggcctgcattgagcaaacactggtgccctggagcagctgcacttgcgatgcttctgggatgttcagtggtgtgaccaaacagcatgtatcaaagaactaggaaacaggcaatctgttttcagctctgactttaagcaggtagtaattttcctgataaaacaggcgaaaaaattatagctccccagtcagcatagtcttacaagaaatcttgggctaagtagacaaaactcaatgaagattaaggactccaaatgcactggttggtaagaacaactaacttttattaagtaccagttgtaactaaacactctttctaaacactttccctgtaatttttttgtaactgttaaaacaggcttgaaaatttttttttaacttataatttttgtaggtacatagtaggtatatatatttatggggaaaacaggcttcttatacccatttaacatatgaataaaacaagattgagaggttaagtagcttgcccaaggtcaatagctactgaaccaggattcaagcctaactaaactgatcaggctaatactaaaatcgacactttaaatcttctccctatgctgccttttgcatggataaagttagcaacctccttctgcaggggacactgacacaaagcaagatctgcattaaaagtgtacttaaagcaatgaagtttctggtttagaaataggtagatcaatgggacaaagtaacatgtaaagaaatatacttgaatatatataagaatttatataatttaatgcggtatttcaacttgttcaagcaggcagataagctagatatgagcaggagggtgagtcccctgagaaaagggaggtttggaaaaatctcataacccagagaccacccaaaacatgcatcctagctatgagcagagaggaagggaaatacctatggagaaagagatgccccttgactcccagtaatcactcactccacaattaaactgtcctgtcagaatgtagctagctacatgctgttaagcgggtaaagagggaaaaaggagaaattcctaagagatacacaggtgcaataagcacagctttaaccactttccaaccttcctcaggtggtgataatgagtaatgcaggcattatatagaatttgtatccaacactggcctgcacatacatgtgaactaacagtaggggggaatcccacaaatttggagtggaaactaggtggggacttaaggcagaagtgggaactagacaaagacaaaggtggaaacttgaggcagaggcagaagcctgaagaaacagtctgccataataaccacaatgcagaactcttggggctgctgctggcttatcccttttaaacaccctgctctgcctcatctttcagcgtgcactgtctctgctactacctaacctttgaggctactactcctgtttctccagctggaccagcctgctcctttcttggagtgtccttctctcaataaactctgtactctttattttctttcaataaatcttttgcttacattactaattggtctcttggctgaattctttctcccaggtaagacaagaactgaggattcctgtacttcccagtaacaaaatcattaggaaaagtagccagtattaaatgaatatatagaaatcagtggctgtttgggagaaaaaaataaagttaaagccctattttttttaagtgtacttccagtgagctctgagtgttttagagactgtactctgccccatttgtgagaattattagtctttccagggaatatatatggagaatatttactttcagaggatgtaccatggagagaagtatttttatgaaaaatgccttgggaataggatttttaaaagacagaagagaacagtgtggtgctgtctcttgagtctcatgaacacacagcaagacatgtattcccattaactctctaggccatgaactacttgtgctccctttttaaggaaggaaaagattctagggtggtttttgtcactgggtgctgtggaatggattatttccctccactcttgttgctaaccggaaaaaaaaaaagacactgcaataaggttatgggactgaaagagctacatttagacacagctcttttggggtcaaggtcaagtaggacaataatggaaaagaataagcaaaaatgagacaacacaaggagaagaggaacctgggcacacctgagtggggaatcttcccttagccacagtggaaaaggggaaagcactagcccaggatctcagaaagaagggataggaatgatagaagggtaacatggcatttggctttctctctcagctctgttattactattttactttttaaaaaactttgttacataatatatattctcataaagtagctcaaatcttttatgggactaagcaagttataaatacatactttccatagaaatatttagaaaaatattacacttacacatattcatatataatatgtataaatacataaatttaaaaatatatattcagaagttgatgtatattataatatacgtatatctcattcctgaatttgggtttagtagctctcaaaaaatcactttttgtctttataaagtcctcagggtaagaaatccttccagatactcttgcacatggattcctaggccagggagcggggtggatgccacctgatcactagtgtcaagaatttcgtactcagtggggtgggagttggctgagagtggaagcggcaagagcaagatggcaacaccataattctgactgggaatgccactttccacactggcacaaaataaagcatgtggaacaaagaagtcaatgcctataagtcaacttcttgaaagtttcagattgtcacaaggctaagagttgggctagagatttgtcagagtcagtaataatttttgtgtctaaggacagagggatctgagttacataaacaagaggtgttcactatgaactgaaataagcaattcatgggtaaagagactggggccagaaattctagggtatatgagcattttctaggtaatggtaactgtggctcattggggtaggagtagtgccagtgagagtggtgccttttactgaatcttcccatctgggggtaaatggccattcatgctgcaacgcagttattctagctccttctcaagaggacgacgatgtgccagaggtagatgagaagtgagaatatgggcatatgtaagatgttctctctttgtgtgttaattatactgtgacataatgaagtaggatttagatgggactagtgtatggtgtgtccttctttttaatagctgcagttactgaaaaacaatgggtgaagcaacactgtggagatcagaatttgatgatggtgaaggaggcataactcaacatttgctgttctaaattcctgtcctttgctatttctccccaatccatggtgatttctcagtaataaatatactaccacaaataataatagtattattgctatgattttacgaatacttattaacatcttcacatgcttcatctcatttaattctcacaattgaggtaagtgacagatccaggatttgaaaatagttctgcacacagaccttaatgctatactaatgattcttatcagttggttgaatacttatagttcactcatttattgatgcatcttatagatactgtttttagtccttactataaaaagatattacatataaacgaagcagggctgtctcagaagagcaaaaagcatcccttgccaaggtaagggattctttccttcctccttctttccctcccaccctccattcaaaaattattcaataaatcccaactttgcactaagcaccctgctaggcattgcaaataaaaatccctgtgcttctagaatccatgatttagccagaaaattaaaagcacatagatagataactataattttacatcttttacatctcaaatcagagcagtgcaggtaacatcaatttgcctacttcttatatctggcttgacacacagaatattttgaagatttcatgtgtattatatcatactcttctatatacttttatcttggcactgacattttatcttgcctacttagtaagtatttcatagatataaagaaaatatttggtaaaatctacagagcaggccaggtgtggtggctcatgcctgtaatcccagcactttgggaggccaaggcgggcagatcacctgaggtcaggagttcaagaccagcctggccaacatagtgaaacctcatctctgctaaaaatacaaaaattagttgggcatggtggtgcatgcctgtaatcccagctactcgggaggctgaggcaggagaattgcttgaacccgggaggtagaggttgcagtgagccgagatggcaccactgtactccagcctgggcaaaaaaaacaaaaacaaaaacaaaacaaaaaaaacaactacagagcagaagctagaaaaaaacgagtcttgagtcaaaacaagcgtctgagattcaggggagattagaactgctcttttggaacttagtgtctgagaggacatatgtgcagacatgggaacaggtcaaggttcttgatgggacatgtgttgggggagggaggaagaaagggaatcggataatgacaggagtagctttccccatctaggtcatatatccttgtagtgaattcttctcctacgataagaaaagttgtgactttatagattatctatacatattcaaatctaagtttaaaataaatttgaaatcctgccaaattatctttggattgtcactatttaataaatgtaattttaaaaaatctatatctaaacataggacttatatgaatgggcttcaaggcatctgtgaacccctgaaatcatatgcaacattgtgtttctctggacttcatgagatttaaacccacaacctaaaatgattaaggcccaatgaataattaaaatttgagaaattaagccccataaccagggaaattttttccctcataaaattagagctgacagcatacaaacctgacataaacactgtacttacatcaagagccacagactgcttggcccaggacttcttcacttgatcatacataattgtgttgttgatgccaagtccacaaaagatgacaaaagcctaggaaagagcaaacctgctaattaaacattgcagcaactcattggcaaaatctaatatgaaagcaggcagccaccagggatgggtctgaaaatacaatcttgttgtacacagaggtaggccttggggaaataggcacattaaaattcttaattactattgttatataacaactttatagctcacactgcacatgaggaaaaattatgaatttaatgtcattgtagagaaactatttcatatgtttaaaaacatacttacactctgtttaagtgggttcttaatttatttaggttgtggactgattttagtaaatccattctatttaaccaaagcaacctcttttagttgctaggctataaaatactttggtaaagaaaccaagttaatgtaaccataaggtaaatgttaaggggaaggaggattgagttagaaccattaataaagaagctatgaggtattcttgattagagaaagataaccatgggttttcatgttggctactggtacagtctatgaggaagcccattcaaggctagcttctccagctagagcgcctggagtgaatgcacggaagcgtgtaaacaagagaaatgtgagggcagcacgcctggcagagctggctcagggtttcatgactctgaacacacacaaacaagacaagaataagaaaatagcactttggggaaaagagagggtaattctgtaataaaattaagataaaaataatggatggttacaaaataatccaattcataaaaaataggatcaaatctcacttaagcatttacatattccttaaatcttcctgttaattttgccctccatttaagtataataataattgactaataattgtttgtctttcaaatttgggcaagctgcaaccaggggactattgatgactccacttggtttataaatttattttcttacctcaaaaagtcgttgatctgcatcatcaaaaggtttcccatcaagtctgtttaacacttgagccactcctatggggaaagagtggattatgtggtcatttttagtactggacattgtgtttctctaatagagtagccacagctaactctatgccttttttaaggaactgcactcagtttaaactctggtctctcaagtgcctgccgatttcatgagaataaatctgaggtgtaggacaatgcactctctcttcaaggctgatttatttagactagatctcagtagttcggagttctaccaaggctttaatctgattctagatgactagttacagtaactctaatatattgcccatatattatatatacaactgagtatatatgtagctgaatatgtgtgtgtattcagctacatatatatatatatttcaactgaaaatatatatatatgtgtgtatatatatatatatatcatactctgaagcacaatacttgaaagaggcagtatggcactgtgattaagaacataagctttggacttagatgatctgagatcaaatttcaactccaccatcaggtgtgtgaccttgggcacgttacctaacttttttagcactcaatttcctcatctgtaaaatggggattaaaatgttaactacctaagaaggttatgaagattaaatgagataatgttagaatgttcataaagcatttagcatattgcttcactcagagtaaacattcaagaaatgttaggaattattacaagcaataaaagttgatataatacagttaaccttcaaagcaaagttagttctgtttcctgctaccagggggtacatatagttctacaaatcttaatttatgagtgattactttttccaaacttcacctctagtattataccagatgttttagggcatgacttcccaaatacacaagtttaacaagaaaaatcaactatcttgaaaaccactagcctgtgtccccatttagtacaaaagaaaaaaaaaaccagctgtaattctaaagtatgcttgtatttttaaaaacacccaacttcccaccagggaggtaagtcatcatatgcaagaagacatatatatataaataatgaaacacaaaactattagcatgtaaccaggcaaactacggttctaattttgaagtaataagggatgtttacttttaggattgaaatgtaggactacgagattgccacggaatatcaacaggtaacacatggtgtttcttatggactttccctttaaacataaatttatttaaaactctgtgcatgatgtagtttaagtctttgtactagaggcttagatcccaaaccttagaatattctttatgttcagtaacataccaatattcttatgcagactaagctgatgaaaaacattatctcagaattcatatcttaaaaacactcacagaatactaaatcctttaataagcagcagtgtcttagactttaacaggcaattttagggggaagcagagaaaggcaaatggatgcattagttaccaaatgaattagtgttcttacgtctcttaggaaaaaaagtcacatttttattgtgtttcaataatttcaactaattcctccatccttcatgacttctctatttcaaccatgaattctccttgcctgggcttctttcttgaatttgatgctttcctaattgagtttttttgaggagaaggaaaggagaatggaggaagagaaaaattggaagctgcttttgcccatgattcccttattgtgaggaaaatgtggcctatttcagaactgcccaggcagaaaatgcatgctcagtatatgtccaatatagaatgttatttcttcctttgcctttacaccatgtataaaaagcacagatgtaaacacattgacatagtaagaaagtctgcactaggagttaggaagcctgaattttgttcctgaccttgctattaactttgtggccttcttgaagtcatttctctttctctctttctctctttctctctctctctctctctctctctctgtctctgtctctctctggctttttttttcactctctgcctctatttccacagggtgagataaaagagttctattggttgataactcagattctctacgactttaaaatttattggttctttcaatttaatacatatttgttcaagttgtggataatgttgattcattaggagcctgtgcttatgaaattatacgagagtgtgagacatagtttgatgagtcctggccataaaaagagggaacacataaaaaagatatgggaatattttaaagcaaacttctgtttctttattcaagaagtttaactatttaggtcatctcttaccaattatttggtggttgctattccaaatagggacacaaagaacagatcttatgtgaaaaccagatatctggtctgcctaggaaacaagaaagaagttaattaaaattgaatattaactattcatttttgatttacattttttccatttttcataacagatattcaaaaataactttttaaagctattttatacactgtaacctaattttgtaatgcataaactcactcacctgcctccttcatcacaatgaacatcctaaaggaatcaaacccaagccaaatatgaatcaaccaaataaatccaaaaccaacatgacctccttcaatccctgcagccatagagagctggacataaaactatcttgatcatgaccacaccactagacaagaattccagcaactgtttctcctctgggtatttaaagcattttaattaaaccagtgatcaatttttatctttgactgggtgcacttgttagtaaaacatgtttgtgcctataatgctgtcatatttacatttacttttaatactctatatttttactgttactatattattatgtatgttgtcaaatctagatacaaaaaaggtaagatagaggtagaggtttgaatattttccttctgtaccccaaatatgtcaggaggtgacatttaaaatacagaggtataattatcaacatcaaacattgagtaacaaactccatttaatattaaaaacagtggtccatatttgaatggttagagagaaaccactaagagtgaaagggtcttagggagttaatatgaccttgattttcagtgaggtcaatctattgttctaatacaataggagaaaacaataagatatgaaggttttggatcatggatatggagataaaaagatattttaaaatattctttgttgaaggcaagagccacatattttaaacacttgaaactaaaagttaatttacatacctaaattttatactggattttttctttttgacatttctctttgagaagttaattttccagatatcttctattcattgtaccaatatgttagtttctctttttcaatgttttttgaagattaacatgcatgtagaaaggccccaaaattgtaagtatacagcttaatggatttttacaaaatgaacagatctatgcaactaccaccaagatcaagacatagaatattatcactgccccagaagccacctccaaacccctaaattcttgtacatacttagtgcatatatgcatttctgataggcatatacttataataaaattgctgagttattcacctgttcagcttcaaaatatatattttaaagtttttgcaaagtacttgtaccaatttaccttctaaccagaagtgtatgagagttccagttgatttatatcatcaccaacatttgatgttgtcaggcttttaaaaaaaaattttgacaattctgatagatatgtggttatatctccttgtgaaagtaatttgattatctctgatgactagggtgaccataaatcctggtttaagtctgttttcctgacataattattaataatatgcctttcattctcaaaagtgtctaaatttggacaataaatttataattttcctacttatgattaatgaagttgagcaacttttcatatacttatcatctatttctactctcttccatgaagtgcctgttcagaactttggtcttttgtcctgttgggttgtctgatttttaaaaattggctcgtaaaagtatcttctatattctggataagagccctctgcaagatatatgtattacaaatatttttcttattccatggcttgtttttccactcttttaatggtgtcttttgattcagaggtccctaatatgatataggcaaatatttcaatttttaaatttatggtcagtatttttttggttttgttcaagagatctttctgtattccaacctcatgaagatattcttctgtgcttttcctagaatccttactgttttaactttcacatttaaatttataatccaactgaaaatgattttcatgtataatatgagctaggagtcaaaatttcttttttttttgaaatggatattcagttgatccagcactgttttgagggaaaaagcaatacctctccccatcactctactgtgccatcattttcattaatcaactgtccatatatatttggatctgtttctggactctctattctattccattgatctaggtatctatccttatgccaataccacactgtcttaaataatacagttgtatgataaggctcagtatctggtagtgcaaatcctccaactttttccttcttcaagattgtcttgactatttttgacctctggcatttacatataaattttagaatcaatttgcagtttatacacatacatatacattcctgggatttttatcggtattttttgaatctatctgtttgggggagaattgacacctttacaaaactgagtctttcaatccataaatatcccttaatttatttaaggctcttaaaatttctcttagcaaagtttggtagttttccatgtagtgttcttacacataatttgttttatttgtatcctgatgtttaaaaacttcatgttattgtaaataacagtagtattttattttctaatgcttgtaattggtacataaaaatacaatcgactttttaatattaaatttgtttccatcaatcttgctacattcaattattaactttaatgtcttacctgtaaagtgttttggattttcttgccacatgatcacgtcatcttatcctttaattcttataccttttagtcatgtaattttagattatgtgatttttccttttttattttgttaatagagtgaattagattgattgatatttgagaattccagatgcaaaaacaaaaacgtaagcataaatcattcgtccagtgtactcttccaaaaaatatttatttaccaccttctatgcaccagacacattgcttagtattgaggatagaaaaatggattcaaatagtcattacccttgagctactcacagtctaggaaagatagaaatattgagataaaataagtgtccaagtagaggatgttcaaacactattggaaagacaacaattcactctgtttagagaaatcaggagcagcccaagaccctttacaatgagtcttcaaagacaacagtgatgatgataagctcacatttgctagatgttcactctctgtctggcattccgctcagcactttcttatgcattattttatactttttacaaccaccccatgaagtaggtactgttatcatcctctcttatcagatgagacttagggagattaactgccttgaatgagagagactggctcaaaggagcacagccaatggcaaacacatccatcaaagttatcttccaaaaaaacaaactggttttcttcccctccctaaggataaaatctgaattaaggcaataccagtaagcatgaagagaagaaagccaattttagaaaggtataatctacagacttaggctagccacagcagcactaggatggctgggtctgctttgttttgctgtgggagcgacacatatcattgtacagaccattgggtttgaggcagcaccaagtagtaaacacaattgtctctgccaactctgggacaacagtagctcctgtctaacgtttcctacgaaatctgggcagctgaaggacaggtcacaatgggcaagaagaaaaggaacatgcagtaagaaagacaatttagaagctggtggtgagaaaaacaaaccttaggctgttcgccagttaaataaaagagaattttgtttacccatcacttttaaagtactacagttccccaaaagagtttttttttttcttctgggaaagtgggagtatgcactctcccatccccatggaggataacattgaggtttctggcttgagtaaaggtggaagagttcttgaagtggggaacacaggaaatttgagggaaatgatacgaactccaaatggacacacattacaagtgagaggggctggagataccaatcttggagtcaccagtcctctgggttaattgcatgggtaagatttaagttaattgcatagttattgcaagagagaacttgtccaacaaaaagactaaaaactgaactttggggaacacaatatttagtgctggaagaaaaaggtgacatcagtgacagggatggacaagaactccaaagctcatgctcttaacctgaaggctttactgcatccataatgtgtgtgaacagatttctacaacctttccggaaataggtttattgatgtgtatccagagcctaaaaagtataaatacatactctttgacctatcaatttcatatctaggaatttatcctgtggtaattatcaaagctatgcacaaagctttacatgtaaaagtgtgaaccacagcattatttatcttagtgatttattagaataacatgaatattcaactgaaggcagttggttaagtaaatcatagcacattcacataacagaatattatgcatctaattaaaatcatgctatagaagaatagttactcatatggaaaatatttaatatattaaatgataatagtgtacatgcctatgggtatacaaaagcatattatatacattgaaggatcctagaaaaattatgaccataatagtttcctttgaatttcttggctattagaattttaaaattattgctcctagtttgtaaattttagataataaacacagataatttgtccataagggaagaagttattttctaagtagaacttagggggagcagcagtgtccaatgctatagagaagtctaataagataaggactgaaaatggcttactgaatttagcaacatagtgggatcattgaaggcaaaaatggtcaagggaagaaaggatgtgatcaggaataaaagtcaagtggttagtcctggaagagaggaaggccataatgagaaagcagagctgcaactattcagagctggagtcttgtatgagctgagcacaggagaagaggtgaagcatcagagaatgcagagggtgtctttaaagtgtttccactgtgtttgagggaaggaggtgaggctaaggaatggtgatgatcaacatgcttgatgagcccaatcaggtgggagaggagaacaaggaaggatggcagagtgtgaggagagtgaatttttccattttaaaatcattaatgaaatcccctaattgcctatttgcggcagcagctattttttctggaaaactgtgctaatccaggttagttcatgtaaccatatgaaaaggcaaggcccaggagtccattttatcctctgcaggggctggaggaaaaggagaagggagatgaaagaagcacaggatgtctaacgaataaattccaaacagggagaaagagtaataagcaagtatgaaggaaagaatcattcctgttcaccagataaccccaactctccatatcaaatcagtcaatggagctcaaaaatgcccatcagccacaccaccccaacgaagtcacccaaagtttcaatgcctcaattttatcattaatatttatctcctgcacaccaaaatggtaacattggttatcttcatattttggcctcacagctgattctcatctttgtgctttttcttgttttccaagttgttttatgaaaatttgtgtgtgaaagggtttcaaaatttgtaaggagttttacaaatacaaatattgctaatattgaaaggaacaactgccaaaaaaatctgctttattgttccacatggtgccttggtcattcttggtttaacatttacaccattagagtctcaaaagttagacaacatgagacaaagcagcctttctagaaggcaacagttaaactaaatatatttctgcgagtgcttagttctttccaagcaaagatatgtctacttaaaaatgttaactagtttctgtcctcatggggcctttccaattaatggatctaattaaagatggtttagctcttggagccatcaacatgtacttgttatattttctagcctctcaaaggtggtcaaaggaaatgttaaataaattggtgataatataatactatttattaatgttcagtgtatttcctttctctagaaagatacgtacaactttaacaataatctaaagcaacactttctccccaaagataatctagtggtgagaaattctagtaaccagacaagctgagggagccaatgttcccagtcagtcccttgatttccatgaaataatagagagagaactgagtttggcctatcttacctgcacataggataaatcctaatggtttgtagaatagtgcctgtatatgattccttaaattcctgaaaaataaatgattgtgcttggagctgaggcattttctccactgcccatgcagcaaagtctgttggattcttagaactgtgggacttgtatttgttttcactacccactgcttccccattctatattttatttaagtcttagtaatccccctaacttctaacctctaaccttcctttcccttctgctcaactgtaattcttacgttcactgtccaatctacccttcttctcaggaaaggttctcaaactggttcacactaagtaacagaaactgagagaagattgacaagagcaaatgaatttcagctgatccacagagctttgtctcttaatgtttccaattttgcacatttccctttgcaacagaagcataactgatagaccagaaggtgttacagagaatagagaatgacctgtcctgccaggctagctctcagcagccactgtgggggtgcgggagtgctccaccacaaagatctggcaggcaaaatgggctttaatgctctaaatcagagaatctcagagcctggagccccattatccttaagtgctacatgacgaggataagtaatattgagttgtctataataggctttaaaaaaatcagaggaaaaactttacatggaagaattgcatgggactgaagagctacagagttcagatcacaccaccttagtgttaattgtgtaactctgggcattggccttccatggcagagaagatctaggtactgatggatttcccacgtctcctgaatttgtaacaaataaatggaccaccaaatccatccatgcataaggcctgccctactttttagttaatttctgacattccctttgctgaatgaaccttttctatttaaatgttgagtccaagtgttcattcttattgtaggcaaaaagcaaatactgcatgtgatggctctgaaaattctctccataactacacaaatggaaggaaatactgaattaaacaatggaatataataccttagactgactaaataatggcttgttttgcattagtgtatttattttaatgcattctttgaatctaataagaagagaagggcagaaagtgtcacagatgatatactaaagtgcaactaactacagaaaattgaattccgaggcacaatgccagttgaaagcaaggacagaatgattgtaatggtgaggatatttgtaaatagagtatgcattctaagaagtcacctaatacaagaggcggtcatctgcaaatgcagtttatgtacatgctattggggcaatctcagacaatgctcctagttggaataaatcccaagaaacagaggcaaaggcgaatagaaaataatccatctgaattccccaaagatacagcaaggcaagttgacttgtttagatattatattatttcaataatggttttagataattgtttataactttaagaagactcaaaataacctggtaaaacataatttcatataagatatagtctaagattttagaatatctttaaaatttttcatgattataaaaataatatgaacacatgaaaaatttaaagcacaaataaaatcaaaagctctaacctttccatctttagagatagcaattattaacaagttggtacaagtccttcctcaccttttcttataaatatgtattaagttcatgtcaatatataatatatttaatgacataaagcatattcataaattacacatagataatatatttgacaatattgaacaatattcaacaagaatgtctattatttactaaacatggttctaggtgttggggatacagcagtgaaaaacaacaacaaaatcctcaccttcatagagcttacattttagtgatagaagagagatggtaaacaatacaaagataaatgaataaattatatgttagaagatgttaagatgatagggaaaaaacagataagaggggtaaggagtaccaagggtatcaggccttactgtcaggtaacatttggacaatggtcttaaagaggagaggatatgagccatgcagatattgggggaagagtatttcagctgagggagtagccagtgcaaagcccctgaggtgggcgtgtaagtggcacattataggaacaaggagactagtgtggcttgcatagtatgagtaagggatgggggtggatgatagggtgccagatggtgtatggcattgtagatctctgaaagaattgcaaatttggcttttactgcagtgaaataaggagacactgaagagtgtgtgagcagagttgtaacataacttaaaatttaatagcctctgactattgtgttgagaaaagagtatagaggggcaaagtggaaggagagggacagtttaagaggatttgtacatgaaatagtacagggatgatagtaggctggatctcggtggtagcagctgagtggtaagaagtggtcagattctggataaattaagcaattggacttcctgatgaattcatgttcaacatcagagaaagggagaatcatgcctatactttttttgacataagcatcctgaaggattgtgttgcctcaatagagatatggaaacagagagaggagcaggcttggggggcaggagactgtggcctgtgctttagacatgttaagtttaaaatacctattaaaaatatgcatatactgtttatgtatatacccacatatattattctatacatacttctatacattattttaaacatacttctctgtttacttttttcttgtagacattttaaaatatcaggatatatagattgcttcatggggtagacattgtgcatggactatattttagtctttattagggtatgataggcaaaattcttttttttttaagatggggtctcatgctatagccaggctggaatgcagtggcatgatctcggctcactgcaacctccgcctcctgagttcaagcaattctcctgcctcagcctcctgagtagttgggactacaggcgtgtgccaccactcctggctaatttttttttttttttgtatttttagtagagacagggtttcaccacgttagccaggaaggtctcgatctcctgaccttgtgatccgcctgcctcggcctcctaaagtgctgggattacaggcatgagccactgtgcccagcctataataagcaaaattctaagatggcctctaagaatcccacctgccaccacccccaactctggcttcctacatatcttgaataatcctttcccttgagtgtggacagggcctgtgaatatgttagcacggtcacttccctggtgatgttacgttacatggcaaagacgatgggataatcactcctgagattatataagccactccggacatgaggtaagcttctgtcacagccaactggagtgagattctcccattggctttgaagaagtaagctgccatgtgatgagagggccacattctaggactcaagggcaatctctgggagctaagacagaccctgggccatggccggcagaaaaatgagagcctcaatctacaactgcaaggaactcaattctcccaacaatctgaatgatctttaaaaagaacgccaagatccaaatgagaattccacacggccaatatcttaatttcagccttgtgagaccctgagcagagaacccagcaatgccatgcccagacttctgacccacagaaactgtgagataataatcagtgttgttttggctgggcgcggtagctcacgcctgtaatcctagcactttgggaggccaaggtgggtggatcacttgaggtcaggagttcaagaccagcctggccaacatggtgaaaccctgtctctgctaaaaatacgaaaaattagccagccatggtggtgtgcacctgtaatcccagttactcgggaggctgaggcaggagaattgcttgaacccaggaggcggaggttgcagtgagccgagaatgagccactgcactccagcctgggagacagagaaagactccatctcaaataataataataataataataataataataataataataataataatcaggtgttgttttaagtgctgagtttgtggtgatctgttttgctgcaatagaaaattaatatacataataaccctgacaatgtcttcagaaacacacatggataccctgttcccatggagcagatgactgataaagctacaaaacctaagaacagatgacccataaacatgagggtttcttgtactactataaataaatataatattatattgagtaggtcttttctgtcttacattcttttcatagaatcttgtaacagaataaacagtgattttcataaggtcgcagaatttaaagctcacaaatgtagttctagctctgtgacatataatcttttgtcataatttttccacccataagccaaagagtctggccttaaaaccatgtatgctatcaagcccagcaggtgccacttttgagagccaactcaaacaggcattcagaaggcaaataatcactatggctcacctgctaagtctgctctgttcaccacaaggagggaactccattaaatatttaagacaatcactaagagaacacccagcaggcaaacaactatgattacttgccccatagccctctcagcaggcatctgacagcacttgggatggggtttacatcacattaaagacatccctttgtagctcctatcaaaaggaagaccaacagtttcaaaactgagatttcaaaataaggatcattctcttgctgcatatcttgggcagagtttctaaggacttccctgaattttatcaagataggaaagacacagaaattagaaatctagtttcccttcataccttaactgtatgcctaaagcaaagcttgatagagtaaattatctcttactaacagaaaatacccactggtgtcatgaattcccaaattggcaagcttcctatgctagtctgaattgaacaagaagctatcaaatgcacacaagtgggtgtattgggatcagcaccagcagttatcaatctgaagaattcacaatatggtccatggggcaagtcattcataagttgctgctgaaatatttcattcacataatagggaacacctccctatcccaccaacactgatcaggaaaacccatttgggcttaatatgaacaaaaactaagcctctattatattaaaccacagaaattttgaagtttatctattactttaactgatgcagggattgtaaatgtagtcatcagggctatgtttgaaatatacaagtgcaactggctttagctatgtcttaaggattggtgcggctttagctatatgtttcaaggattggtgggttgcataggcttgggcagtacaggtattacagtaggtatctagtcaggaaggagcacggcaggagaggccccccctgacccctccacgaatgtcaggtgaccatcaggtgatggtcaggtggttgttaaactgtctctctaaaataataattggccacagccagtgccaacaaaaggcagtctcctgatagatagaaaaaccctgaaactagtgatcagtagtgtgatggttaatactgagtgttaacttgattggattccaggatgcaaagtattgatcctaggtgtgtctgtaagggtgttaccaaaggagattaacatttgagtccgtggtctgggaaaggcagacccacccttaatctgggtaggcaacatcaaatcagctgccagcacagatagaatataaagcaggcataaaaatgtgaacaagtcagattggcttagcctttcagcctacgtctttctcttgtgctggatgcttcctgccctcgaacatcggtctccaagttcctcagctttgggattcggactggcttccttgctcctcagcttccagcctattgtaggaccttgtgatcatatgagttaatactccttaatactcacatccatctatctatctatctatctatctatctatctatctatctatctatctcctattagttctgtccttctaggtgactaatagaagtcgcttcctgataagatcttgggagttgggcaagcagactcaagcatgtgcattaagagacaaaatggaagagtttaactggtatatgaccttcgagaaacattccgctggtatgggaagaatgcctccagtaagcatgcagacaactccagtaaacacactatgtgtgctccccttccaagcgctagcaggccactatgcatgcagacagcacactccaagggaagagccagggagaaggaatgaaagatcctggaagtatgtcaatgcataaaattccaagtcaaagatcaaacagcgcacttgatttctcaagtcacctgcttggccctcctccaagtgtactttacttcctttcattcctgctctaaagctttttttaaaaaaactttcaatcctgctctaaaacttgccacagtctcttcttctgcctaacgcccctcagtcaaattctttcttctgaggaggcaagaattgaggttgctgcagacccacatggatttgccaccactaacacagccagcccccacatttaatcatctccaatgtgcctaggaaacctggtgcctggatgtctggccactcttatcatactgctgggtcctataagggaggacctggtgactatatctgcacagtttataagatatttatgtaggactttacatgttgcaaactaagtgatatgtccaagactcctcagctcttgagcacagcagataggacaaaaaagtaggtatgctggccatgagttcatgtacctgtgaggaaggagaaaggaagaatgtggtgactctgttgcctaggcagaccctcagcagctgatgctctccccaagaggatgctaaaggaaagagcactgaatcaggaaccagaaggcccagagtgttttctgtgatctgccttaagaaagctgtgtggtcttggcagaccaccagctccccaagtctccatttcctcccctgtaagctaaaaaatatccaatatttctatttactgaaagttgatgtatccatagtatgaaatcccagaatagggccaatccattttggggcattctatcccagtttctgatgaattggggtcagtaaaaagaattcattgccagaattagccactgagctattgagaaatttagaatagatattagtgatagaggcaggaggcagacaaaggcgtagacagatagagaaggatctctggagaatttccaacctgccccacaagtgttacaccagatgttttgtgcagataagggaacctgcacagggggcttacctgggcatgcccacggcagactagaggcccacatgcactgggggaatggtgtggagccaccagaaattcgggcctaatgcagaggaggagcctggcctcttcagctggtgtgtagtggccctggtattcaatttgggaggtggaaacctgcttgcaggaccccctctctttgctgagaggtttcttttcacttaatacattccaccctcctcacccttcaatgtgtctgcctgcctaattcttcctggtcatgagacaagaacccagattagctgacctaaggagcaaaaaaatcctgcatcattttggtggcctctacggggacttgtcagaagggtgagtaaaatgcagacccaaacatctctctcacttttgtttctgagctttcttgtcctcagactttttctgaaggcagaggaaactgcccccttccccaccccatcattctcaggcattggaaatgtcggcctcagtcaaacccagtcttttccatggattttccttcatttttgggggaatgtattggcacctatcttttcttttacaatattaggggtgtttcaccctcaccccaatggttgcaggcatgtgcacaggacagacaggtgagcagtggctccctgccccactcccctcctgtctggggcacacagcctgggcctggggtggctagctggccagtgttccccaccaggcacccacgcagtcttcccttcccctggccaaggggtccagctcagtgggagtcccaggaaggagacagcaatgaaaggtttctctccctgatgaagaaacccattgcataagaataagaggtttctcccccaggaatcttcccaggcttgcacctaagcttttttttcttccttttctccaccctgtaggcagttaatgcagccttgcagatatagggagcttttctatgcaagagttttttttttcattttggaaggcatcttgttaggccaggacccaaattcacaagacaccctttttctctcccttgttggaggagaacccagctcctcagctttaccttagcattcagcttatgataaggaggcagcagccagctgctggctgcagtctgtcaaggtctaaggaacgcaaaggttatgacaacagtggagacagggtgtatgtgggtgagtacgatattcccaccctctaggcccctgtgttaacgtgagtggaagctgcactgacacctatcgatagcaccctgtcaaggttgccaggacttgaagatacaaggacagaagaaagaaaagaaacacctcttctttctctgcctcatgtaccccatatttgctgggaagacaaaggaattagggacaccttatcctgtcttcctagctgggtaaccattcatctttagtctgtacctctctcaaatgcatcctgaggcaggggggctccttagagaaaatgccttctttttcctttttcctcctctgtcctctcttcacagaggggtaattgtgtccccctactacaggatactcccctcggatgcatcctccaaactgggaaaagttaatttcccagaccttaaactgcttggtctagaactgagctgagggtgagaggtgacagcgtgctggcagccctcgcttgctcttggcacctccttggccttggcgcccactctggccacactataggagctcttcagcctgctgctgcactgtgggagcccctctctgggctggccaaggctgaagccagctccctctgcttgtggggaggtgtggagggagaggtgcaagcgggaactggggctgcgcatggcactggcagcccaccacaagttctgggtgggcgtgggctccgcgggccctgcattcggagcggccagctggtgccgccggccctgggcagtgagggacttagcacccgggccagcagctgcagagggtgtgctgggtcccccagcagtgccggcccactggcgctgcgctcaaattctcgctgggcctcagctgcctccctgctgggcagagctcgggacctgcagcctgccatgcctgagcctccccactgccgtgggctcctgtgctgcccgagcctccccgacgagcgctgccccctgctctgcagcacccggtcctatcgaccacccaacagctgatgagtgtgggcacacagtgcaggactgatgggcagctctacctgtggccccagtgcgggatccactaggtgaagccagctgggctcctgagtctggtggggacttggagaacctttatgtctagctaaaggattgtaaatacaccaatcagcactctgtgtctagctcaaggtttgtaaatgcaccaatcagtgctctgggtctagctaatctagtggggacttggagaacctttatgtctagctaaaggattgtaaatacaccaatcagcactctgtatctagctcaaggtttgtaaacacaccaatcagcaccctgtgtctagctcaaggtttgtaaatgcaccaatcattgctgtgtctagctaatctgatgcggacttggagaacttttgtgtctatcttggggattgtaaatgcaccaatcagctccctgtaaaacagaccaatcagctctctgtaaaatggaccaatcagcaggatgtgggtggggccagataagggaataaaagcaggctgccggagccaacagtggcaacccgcttgggttccctaccccagtgtggaagctttgttcttttgctctttgcaataaatcttgctgctgctcactctttgggtctgcactgcctttatgagctgtaacactcacagcgaaggtctgcatcttcactcctgaggccagtgagaccacgaactcacctggaggaatgaacaactccggacgggaggaacaaacaactccagacgcgccacctgaagagctgtaacactcaccacgaaggtctgcagcttcactcctgaagccagcgagaccatgaacccaccagaaggaagaaactccaaacacatccgaacatcagaaggaacaaactccggacacaccatctttaagaactgtaacactcaccacaagggtccacagcttcattcttgaagtcaatgagaccaagaacccaccaattccagatacaaggggaagggaatccagaaacctgacgtgccagcaaaagggtaaaagtttcttttaccagttggacttttggcctctccctccgtgtgcaaaccggtaaaaggaatggtaaggatcactgtttatattctctgtaaagttttgattaatgaaaaaggatttatgagtttggtcttaagctgtagccaatctggtatgctttgcatgtctttctgtatggttctatcagaaagagaggtactttaggacaggatgtgggtgtaggaccccataagtccacttttcaagtcagcccagcaaactggtcagtaacaaactttgctgcaggcttgcatcttgtttacatcctggggagcatgacctgtaactacgtgggagtgctttgttttagtctgacattttacaatggtggctcaggttcaatcctggcttggagaatgggtactttctttctttctttttttttttttttgagatggagtctcgctctgtcgcccaggctggagtgcagtggcgcgatctcagctcactgcaagctctgcttcccgggtttacggagaatgagtactttcaagttaatagctgtgtgacttctaccatttgctgattttcttcccttccatgaacaacttctagattctcttcttaaatcttcccttctctgagctacccttaaagattctagatgttgtaaaaactgcttacctcctgctttgaaaatacttcgtacactggtagtaaagtcataaccttaattgaggcttgttggtttcacctgtgaggttacttttggtaaagttcaaaagccagaaatattggctgcttgacatggctaaagtcaggtaatacgggatttaaaaggactttcttaaggagtgctcagcttaattaaaagcagatacccaagtatgtttaaaggacctttatggtttttttcccttcttgaatcttgtttttctggaaaaaggtttcttctcagttgattgaattatttttctccattttgtcttgccactcttaaggcacacatgagaggccctaaaataatttctgatggcctgtgactccttggcaaaaacagaaaaggcaccacagatcccattttgtgagaaacctgttttcctcatggaacctcagaaattagaggcaggtagatccctctcaaaatctgtttttgtcttccagccatacctgtttgttaggccctagaaaatacaagctttcctagccttgctcttaaagggctccacccagaggccaataatccaattagattggcaaatgaaaaatcttacaactactagattttcttctgtctgtctacataatcatatatgtgttatgtgtgttatgtttataaagaaaagagctctaattaattggtttgaaggaaaataagcacttaaatgaaatatttttttaaaagaaagacaaaagctgtaatactttttagtatttagtctatcgttccttctccaaagaggtaattctaactgccattagaataggggcaaagacggatcttaactgcttcctgctgacagggggcactattttgggaagatggcagtcagatctcccccagaggcctagctaagtgtccccagtaaaagggagccatcgtctgtggttctggttgcatgaccgtttggagttcgatggcctacaggggagaagagactaacttctctgatataaaatcagtcctaactcaaccacaatggaaaagtatataaatgttgacatctgtaaatcattttcagtgctccagtcatataaccaagttagtagtgttctaccttaccagaggagaactgaagaactttgaactgtgaactttcccaaggaaaggtaagtcaaatttcaaatttagtgtataaaaactgaggagaactagagggtagtcagtgttaggatagccaagggagcagctggaaaggcacccaacgcagactaggacttcatttaaggatttaggagcctctaacctcaagaaggaatagaaaatacatggaaaatgtagcctggggaagagagttctaggcagctacagggaggtggtaagtttgggaatataaggttttcctgcagagatctgcaaagatgatctgactgaagttgtaaattagactttgaccccagcctccctgccatcaccatgtcctggccacagacaatggagacagcacagggcaggattaagattatgggctgtggagtttgagaggtagtaggactgaatttttgtctgcctccagagccatagagcagctctcaatttctgtaaaatgggaatgatgacatctacttctcagggttgaagtttaactgttcagttgttatcattactaacctatcccctgctttgtagccagtgtgatcattctaaaatataactcttgcttctcccccatttaaaactcaatggttccccattgcacagaacaaatactccaatttcttaacatgcctttcaaagttttttggtgatctggtccctgcttccctctccagtttcatggatcatggcccttcagccacattagatcatctcacttccccaactccccatgcctgctcagctttgcctggaacacacatctccttacccttcctcaccaaaaaaatgcctcctactcttcagacttcagctggacaatcttcaataggaaaccttgtatttaatgaatgtgtatattcaatatgtatatatgagtatatatatagagagtacacatatgtacatagagacattatcagttcatgtgaatttatctgtatgatactctacactaccttagaatgtaaacttcaaaattgttttaatatattctgtatatcaacacagtgtgcctagataattaacattaaacaataatgccaaccaatttactgtttcttgggagcaatttttataaatatggtagttgttttagggtctattgggaaataactttgttatatacacttttcattaaatagttcatagtttaatataaaatatacccaatcataaacgagcatcagactaaggataaccatcttgctacaaatcatggtagagtcagacaagtttttctaacttagagtcaacagtaggcaatgctaaaaataagatcacaggggaaggatgcaaaagaattgctggtaagtattcctttttgtgtttcaactgttttcaacagtgcgacaactgaaacttaggattgcaaccagaggggctcctcttacctctgcatcaaagcgcggatcctggtaggcatcactgatgttcactggaaggcctgttgaagcaaccagctcagcaatgctgttatttattagccagtcggagtatgatgatttctccatgctttctttgaaactatcagagcaccaaggtaggcaggaagaaaagagagaaacgtaagttttcttgaaaggaaaccctataaactacactaatatcaggataatctgtccttattaagaaaaaataagtgacattagtcacagaacaatagcaaggtaattatcagtagctacttcgaaatgacttacctgctataatgtataataattaaatccatgggcagaaaccatagattccctatgattcagagagactctaggctgtatttaggtcccaaagctggcaaacacatgtaaggaccaaaattaacaataagacaccaacaactaataaaattccatcaacttcccagcttgccctttttaattgaacagactagatgttttggcacaaggaagaatgaaacccaagtagggaaaaatcaggaagtaaattgggaatttaaaaaattacaaatgcagcaaaagaatgtatctagactatggtcttttaattagtaattatttgaaaaacaattttactatcttagtcattattttgataacattaatattttaataacttttagtatcttagttaactattttggtaattttagattatgtttcttaacaatagcccatataccacttacaaaatctcacttaaaaggctatttaatgcaacagacccttaacattaataattaaaactattttcatatttaatttgaacaaggaattttatgccaaatgattttttgaactttcccttgtatcattttcatgacagacactacataaacagaaatgctgtaagaattagttaatatccctcattcttctcctttccatcttttcttccacaagtatatattgagcactgccaggagccgtggagatacaaaattgagaactgttcaaattagtattggcaaggaaaattttcctggaggatgtctgatttgtcgcttggcaagtgataactgaaattatgtggatggatgcaagcatactagggcaaggttttcaagctgccttatgtggaaccctggatttcatgagatgttaaatgagtatactacagcaagaataatcatcactctattgactttttaatctaaactgcactatatgtaagaaaacactaaatgtgcacatcgtctttgttattatgcaataatgtccctgtgtaaaattatgccatgttgagaaggcaggaaactgcatggaaaggccattggatgcatgagtgagtgggacacatagacattatttaacatcattaatatatctcatctgtaatgattgctggcctgtgtctgataaattcagcatgtatttgtaatgttattcatcccttattgcatattaaacattaataatacataaactttattctctatggctctctggctgaaaaatggaagttttaataaaaagctgagtcttgtagttcttagatggcacctaaatcaaagaagtaaaaagactgagtacttcaaagagaagaagaagctttattttctaaaacaaatcaaaacaaaagaacaaaaaagtttttattttctttttgctgttttatatgcatctcatttcatgagatgaaattttatgttgtgctgcaatgaaagcaaaatctaggagaaacaagataatgcacctcacacaaagatctaaatgacttagtgaagtcatttctaagtttataaaagggtatgggctaaattctgacctttcagggattaattggcttgccagttcattctgcactgtgtactttattccacattttaatttttgaggtgttctgtgatcacaccgtttcgaagctgctgacctagagtgttctgtggagtgtgggaagcagcgctgcagcaggagctggggagaggtctgggcacagaagtaaaacggttgggtagggtggggctcaaggaaggagccagttttaccaataagtgtcaacaatcttcaagctgggtctttcaggatgagaaagagttcaacaaggagagattggaggagttagaaggaaacagcaggaacaaaagacacaaatgcagcagagtacgaagtgtgttcttggcacaatgagtaattgtatggtgggaataaaactgaaaaagaggccaaggctcaaaggtgaggccttgaccaagttgctgagaccttagttataggcaatggagaactgtttaagaatatggagcagggaagtgacgtggtttaagatgtgattttagaaagcttaatccaggtacaatgagcaagaagaactgggtaagagacactgaggatgggaagaggtcttgtaaaccacagaagtcatgcaggtgggaggtgatggtgctggtgactcaagaggtactgcagaagattccacaggctctgtggccagatagcagtggcttacattttgttcccgactgcctgtggccctattagcagaacacagttgttttaaggagtggggagataggggaaagatgacagatattctgtaagcctgggacatgttcatttttgaaagtccaggaacaaaatcctatcagtcctcaggactgaaaactctaatccagagttaggataattttcacggagaataaaatgcatgagatcactcagggacagaacacgtagggaaatctatatctagggaagggaaggaggagaaaagtggtaataaagggggaagggagaaagagaagaaattttaaggaagaaaaactgaaatttattgccatctactgtgggccaagggtcaggccagatactttacccaactaatttgttttgtcctcagataaatcctgtgagatggatatgcttctctatattttatagatcagaaaatggagacctaggatgctcaataactttcccaagtggagatagaattttcacctaaatctgaccccaacatcctaaattatagtatttttcctgttgcctttcagaaggagttaatggatagcgttatagcaagaatagtgggttgtcacctaagaacaaatagggaggggcagtccacatcagagagagtttaaggaagctgctaaagataataaacacttcactgtgagactttagtcacaggaacagggaggaaaaaccattggagttgataattaagagctttaggtccctacttacagaattcccaaagaagatacgatgacaaaaacacttactgagcaggggctcctgaaaaactcactctaaatctaaaacatgcttagaatgtggcttggttcagtatgcatactgaattgaaatcattgtaaaatcagtgaacagtgtagaaggaatattgactctgtgcaaggcagggttgaggccgtttctaaagtataagctatgatctctgctctcagggagtttgctacttaactggggagatgagaaataaacacactgacatataaacaatataaaaattaaatgcccacttcaaatttcaaatgaaaaatttttcacatagatgtgttgataagttaccaagtcaactgtaccaatcacgagtgctgaagacgtccatggagggagaaatgacttcaggtgttgtaatctagctaaggcttcagagaggaggtgagattcaaactgacctatataggtcagtgcaacagtgcaaacagattttctgaaaatcacctctgcatttcttcagtttaatgttgcacaggaacataaattaaggcctgagtgatcagatcctcagagagacagataggaaagttgatttgtcacttggtatttacatcactgtcttagtccattcaggctgctagagcaaaataccataagttgggtgacttataaacaacaaatatttatttatcacagttttgagactaggaagaccaagatcaaggcactggcagattcagtatctagtgccttcttgctttagttcagtgtctagtgccttcttgtcctcacatggtagaaagaatgagggatctctctggggcctcttttataaaggcactgattccattcataagagctccacccccatgacctaatcacctcctaaaggcccaccccttcataccctcacattagggactgggtttcaacgtatgaatttttgggcagacacaaacattcagaccagagtaatcacattctggcttacgcaccagctcaattttggaattccttttttttttttaattaattaattaatttatttattttttattgataattcttgggtgtttctcacagagggggatttggctgggtcataggacaatagtggagggaaggtcagcagataaacaagtgaacaaaggtctctggttttcctaggcagaggaccctgcggccttccgcagtatttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggcaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcagccgggcagaggcgctcctcacctcccggacggggcggctggccgggcggggggctgaccccccccacctccctcccggacggggtggctgccgggcggagacgctcctcacttcccagatggggtggctgccgggcggaggggctcctcacttctcagacggggcggttgccaggcagagggtctcctcacttctcagacggggcggccgggcagagtcgctcctcacctcccagatggggtctcggccgggcagaggcgctcctcacatcccagacggggcagcggggcagaggcgctccccacatctcagacgatgggcggccgggcagagacgctcctcacttcctagatgtgatggcggccgggaagaggtgctcctcacttcctagatgggatggcggccgggcggagacgctcctcactttccagactgggcagccaggcagaggggctcctcacatctcagacgatgggtggctgggcagagacgctcctcacttcccagacggggtggcggccgggcagaggctgcaatctcggcactttgggaggccaaggcaggcagctgggaggtggaggttgtagcaagccgagatcaagccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgcgtgcctgcaatcgcaggcactcggcaggctgaggcaggagaatcagacagggaggttgcagtgagctgagatggcagcagtacagtccagcttcggctcggcatgagagggagaccgtggaaagagagggagggggagaccgtggggagagggagagggagagggagagggagagggagaggctggaattcctaatggtctactataatgcagaatcgtaacactgagttagagctttcaaaagcttgcttctcttctttacaaacaaaaggtaattttatgttatgattaggatcatgagttttggcatacctcaatcaaatgtcccctttgctgatttctagcaaagtgatcttaggaaaacttccttggtaaaatgggtataatactactactgtagagattaaggtgataattcatgcaaagtgctcagcatattatttagcccatagcaaacattttctaaaagcatcacaacttttaaagcaaattctgcacatgacagtacccctttatacatttcagtgatgtggtgttgtgagtttaatcacaaaggaaagggcccaaattatttctgcttttggaaggacacatctaacttttagggtaagctctttcaaaaagttcctacagctcatcacctccccctgatttatgagggaacttttattcagtatggttttctcttttgcaattggttgctgttgggacagaacatggtaagatcacagacacagccacgtttagttgtgcaggttctgccttgcacacggatgccctataaaagggagaagtgggggtggaaattagtctaactgtgcttgtttgcttgaagttgcatccacctggagagggcaccttttcctaattctcacagagacatttgtatgggctttcaatggccctccttcaagcttttcttcaacacatctgaaaattgggcatgtaatctcaaatggagcaccatcagtgacaggaaactcactacctatcatatattacattatattttgtggcagctcagtttactttctaatagtcatcatccttggttccaagttccatggtttgtggccacagagcatggacctcattatctgacagccctcaaaatatttagcaatagttaacatgtcacccatgatcatccacctaacatcattcttctcccacctgtctccaattccttaagttactcctcttgtggcatgccttccttattcgtaccatgccagccctagatgtaaccccccttgttaatagtcctttggagtatgaaagccagtccagtccacagttctctccatggggtctgagtaggatgaagtgggtatgaccacctccttcattctagaacctatttctagcaacaaacatcaggagtgatagttcccaataggtcttatttttgataagtttttggaagtttaaattaatattaaccaactttcttgagtctaaattaaccaactttcttgagtctaaaaactcccaccagagatatcaaaggccaacaaatccaatactaagattttcagtttgggccagaaccaagatagagactcactgctgtttggaaacacaactacaccttgattacaaccaggcctccaaagcttatgggtgcaaatcagttcatgtcaactcagtggttcttagctgccatgtatataattgtaagacgacagacacctccaagtccttccctgacctccaacctttggggatacttattctttcattcaaggcccgttgttaaagcctactgcttagaaatcacttgagggagcctgacccgtagctcccagactgccaaagcttcatagaagaagggaagaatactgtctgccaagctctatgcagcatgttggtgcctgagccctaatgccatattgcttgtgcccacgttgtcactagtttcctatttaaacagctccttttgcctttgcccatacccctctctgtagacatagagggcagggctgggatgcccattcacattagacgagtactcatgtaccaactcattctttcagcaaaaagacaaagacccttatcaatctcctcatgcaagtgaatgtctagtgtgaatggtgtgtttgtgtgtgtgtgtgtgtgtgtagccaacacattaactgtacactggtgcataacaagaaaaaatggcatagaattcttagcaacatttatttgttgttgaagactaatggttgattgagaaaccattcaaatgtttctaaagtttttttttaaagcaagtcatttgtccatgtttaatttcacttgtccatatttaatagcttcatacatttaagtcacaacactattttgatccctacagtggggatattttaaaaaattctggcttaaaggaaaaaaacagcagacagtaaaaatatattgatataaatgtttgagaaaagtaaaagaaacatagttgacacctgaacttcagtgaaacttccttaaaaggtcatagttaaccacttaatagcttattttaactctctacaaagtagacctccctaagctcgattcacttcagcataacactctaattgtaaagaaatcctttatcttgttattttgctagaaaaaggggtataagaaaatgtaggtttttaagtgagtttcacgtaaagggctgtagtttagattcttctcagtggtatcttgcttccaaatgtgagactcaaactgacttcaaagagagcttcatgagctcaaatatattgactgtggagggataaaagagaattgccctattacagaaaacacgtaattcctgaaatgtggctgcccctgaagtgagggccggtgaggtatatataaacctcagggctgacaagttgcagagtcgtgtaggaggtaaatcaatacgagcaaagaaaaacaagacaaaataaaataccccagaacaagtgactcaacatctttaattgtctgaaagtcctggcttagctgaaggttcaaatacagagaactgtgtgaaaataaaaagactatcttcagcattacttttccaaaaaaaagagtctccacattagaagacaaaacatcttaataaaataatgctaatcattagactgtgcttgtgttcatgtttctcttctcaacataacagtttacttagatgtcttcattagaaactctcaagagtctttcaagaatgacaactagtttggcctctactaagtgctggacaggagtgagccaaatcttgcattaagcgaacaataaggatcttttccttgttgttgaaagaagctggcacatggaaacccatccttacacggatgtcagcccagcctagcccctacttatacagaaaggggtatgggcagaagccaaaggggtatactctcagggagctcacaatagtgatactgaattgtgataaatggcctaatggaaggatgtggaaggatgttggtctaagctggtctttagaggataagtaagagttcacctggaagagaaagaagataaaaacaattcagtcaaaactatagcatgagtaaagctttaaaaagtgtggggttttctccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaataccttttatttatttatttattattattattatttttagtagagatgaggtttcaccatgtagtcccagctactcaggaggctgaggcaggagaatggcgtgaacccgggaggtggagcttgcagtgagctgagatcgtgccactgcactccagcctgggcgacagagcgagactccatctcaaaaaaaaaacaaaaaaacctaggaatccaacttacaaggaatgtgaaggacctcttcaaggagaactaaaaccactgctcaatgaaataaaagaggatacaaagaaatggaagaacattccatgctcaaggataggaagaatcaatattgtgaaaatggccatactgcccaaggtaatttatagattcaatgccatccccatcaagctaccattgactttcttcacagaattggaaaaaactactttaaagttcatatggaaccaaaaaagagcccacattgccaagtcaatcctaagccaaaagaacaaagctggaggcatcatgctacctgacttcaaactttactacaagggtacagtaaccaaaacagcatggtactggtaccaaaacagagatatagaccagtggaacagaacagagccctcagaaatactaccacacatctacaactatctgatctttgacaaacctgagaaaaacaagaaatggggaaaggattccctatttaataaatggtgctgggaaaactggctagacatatgtagaaagctgaaactggatcccttccttacaccttatacaaaaattaattcaagatggattaaagacttaaatgttagacctaaaaccataaaaaccctagaagaaaacccaggcaataccattcaggacagaggcatgggcaaggacttcatgtctaaaacaccaaaagcaatggcgacagaagccaaaattgacaaatgggatctaattaaactaaagagcttctgcacagcaaaagaaacgaccatcagagtgaacaggcaacctacagaatgggagaaaatttttacaatctactcatctgacaaagggctaatatccagaatctacaaagaactcaaacaaatttacaagaaaaaaacaaacaaccccatcaaaaagtgggcgaaggatatgaacagacacttctcaaaggaagaaatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggagggactgtaaactagttcaaccattgtggaagacagtgtggcgactcctcaaggatctagaactagaaataccatttgacccagccatcccattactgggtatatacccaaaggattataaatcatggtgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaaggatgagttcatgtcctttgtagggacatggatgaagctggaaaccatcattctcagcaaactatctcaagaacaaaaaaccaaacaccgcatgttctcgctcataggtgggaattgaacaatgagaacacttggacacaggaaggggaacatcacacaccaggcctgtcgtggggtggggggatcggggagggatagcattaggagatatacctaatgctaaattacgagttaatgggtgcagcacaccaacatggcacatgtatacatatgtaacaaacctgcacgttgtgcacatgtaccctagaacttaaagtataataataataaaaataaaagaagtgtgggattttctgtattggtatagtaaataatagagctgacgcttaggatacacggtggaagtggtgaataaggctactgcggaagaggccaaccaatatattgtgtggtttcatgcacaagctttgtatcccaaactacatccatacagatgactctttctgtttttcgtttttaaaatgtctttttttttaacttttaagttcaggggtacatgttcagggcatgcaggtttgttacataggtaaacatgcgtcatgggggtttgttgtatggattatttcatcacccaggtattaagcccagtaaccattagttatttttcccattcctctccctcttcccaccctccaccctccagtaggccccagtgtgcactgttcccctctaggtgtccatgtgttctcatcatttagctcccacttataagggagagcatgccatatttggtttcccatacagatgactcttctctgtatcagcagcccctagagtccagagttccctatgtatatacctaagtactttctggggacttcctcctgagcacctcaaagttgccattttcaagatcgaactaacacactacccttgatgcactagtggtcattaatgaagagtgtgaccattaactaaaaatagaggattagggtgggactgaaagtttcaacataagcacaatctattttctcattaccaaggaatgattgtcagttgcccttctgacagcttgagtgttacccagtgaggggtaggagccagagaggcaaagagtcaggaactcaaataactatttgggacagatttctttttaatgctttgcaaaccaaatattgatttttgatctatatgatagtatttgacattttgtttcattgactagaggtcaatctgaggttgggttcacaaaaagaaactgcattccttacttttttccccctcagctcagcctgtctatccctggagcccttcctgaagcctccagctgtgcaatgctttttgaagttgtcttttaattaggagattagggaactaagtaaataccagtgggactcaaagctaggacctcagcaggaaagtctcgaacacccaggacttgggacattaaaaatcttttaatggcttaagtatatctttgaaggttattgaacaagtcttttagtcatataaagtaatgggagagagtgtaattaacaagcagagccagcctgtcagctcttaccctgtggtaggaaaagaagattctctaagttgcaggagttcctaaatttatcatgatctgttagtggagtcgcctttaatgtcttgcctgaggacacttcatcacacttttattcctctcattttaagcattctgtattaacagaaattaacacatggtgaccaaagaacacattttctatcttttatttcctcaacttctgcaattagaatgatgagatttatcagccggtgtcactgtgcagttgtgactatcagatgggtgtcagatgacattgctgtaagtgattggtatctaccatctagcatcatataatgacaattgcctgcttctgtcacagctgaataaatctgggtggtttttttgttgttgttgttaatcttggtccaacatttcctgtcagtgagattacagataattttattattatctctaatttttagtttccataatggaaaacatgggaaataaaactcactttgcagggctgtttggaggataaaataatagaatgttgaaggctgcatagcgcatagaaggctctcaataaataccggctctttatatcacaaagatttttctttaattaaaaacaccaaggtgagacatgctctgtttaactgcttaacttctaggacagtagagagatgttaaatgtttttgacggtggcatcattatcagatttggagaaatactgaggagaaaatgtgccagctggcaaaactgctgatactagagcagtcaggattctatcctgctggaggtttcaagtagccccacaatatctctctgtgagggtgctgtggatacctccatacatctctagattgagggcacaccttcccaacaagtcctgcatatatatatatatatatatatatatatatatatatatatatatatgtgtgtgtgtgtgtgtgtgtgtgtgtgtgtgtttgtgtgtgtgtgtgtgtatatctatatgtgtgtatatatatctatatatgtatatatatctatatatgtgtatagatatatatgtatatatgtgcatatatgtatatatatgtgtgtatatatatctatatatgtgtatatatatctatatatgtatatagatatctatatatgtgtatagatatatatgtatatatgtgcatatatatgtatatatatgtgtgtatatatatctatatatatgtgtatacacacacacacacacagcaagaaagggagcagattcaatttgttaaaatattaattaaagcatgttaaatgagagacctactaaagcaagacagtcaaacataaaaaccaactgctaaggtttctaaattgccataattctgtttactgcatagtattaatctgagggacagctgacctatataggctactttattatgcttgatctcagtacttattcacatggcttattatcatggaacatttttatagctttcattctcgtctgtgacagttttactagagtgacaagctcattggtctgaaataaataggggtaatgagagcatttgagtcttcatattcaatgccatgaaaaagaaaagatggaaattacatatgggtaagaggtaaagattagatgcttgaaaaatacatttccaaattcattaagatgaatttggaagatacacaacttcattaccaaggcttcctttccttcattgatgtttagctcttataattaatatcatgcaaatggggcacagacacatacttcactagtgccaaggagtatatttacaaaatagggttatttgtgggggaaaatatggaatcccagaagtatcaaagcaacatgattccctgagagatgtgcttaggtcaagcctatagtgtttcagtggatcaccccaacttcatacactccgcatattttttagcgaaaggcggcagagaatatctgggtaactttgtaacaatgaagcttcctggtaaatgaagtggctttgataccaagaggcagactcagaattcaacttctggcaccagtcttgtcttccattgagctaattcagacctgctcagccacctccttgccagaaagggaatagaaatgagcctctaaggttatctggatcacttgcttgtcaattgacaacattaaatattggcaaaatgaggttcagcaacccttaatatgctagagagtagtcaaaaagaaagtccttgtttaaaggaagttacatagcaacacaaatcttgcttacattccaagacgacaggtcgtggtagtgatggtgctgttttaattttttaatgttataaaggttttcttcatttccttgacattgaaatatgtagcatatttttgtttatacaaaacacctattacatccttcctagcagaggcacagtagaagaaagaagatccatgcagaagaaaacagaacaaatatgaaatattcattatatactgtggaaatattttgtctcatatcagtgtgtaagtttgacttacattccctattaccttggacatagagaaataaaagaaaaagtaaagagaagaggaaagaagttccagattggcagagtagatcactgaaaatttgcgcctccataaaagcagcgagaatactagcaaaaattgtcaaaatcaactttttcagaactctagaaattaaccaaagacttgcaataatccaatgagtatttattcaactgtagttgaatctcaggaaaaacagcaagatctatggctttttaatttaccttatttgcatctccctctatccatctctggggtagctgtgaaaatcagcagcctagcagccacttgcagaggaagaatgagtttggaactccccaaaagctctatccccagagaattgtcactatttgacctgtttggcagttccatggaaacctccattcacagaacttgtctttatttgacctgactcagggcttgtttattgagaacagcctttacccccagggatatttgtggggaaaagtcagcagtaattgtttaacatggcaattgcttcaggtggtgataacacttgcagctaacaagaagctgagcaaaaagcttaatgagataagcttgggaatgagatgctcccagaaggctttgaaaagcttgtacatattcatagacatctagaacgtatgcaacacacacacacacacacacacacacacacacacacacacacacacactactgtaagaatgtctgggaaagaactgagaaggctctcacctctagcagattttgaagctctgtgttaagtggaaaatgaaacctaagtaaaatccctgtcagaggattgaaggcatccctcatatgcacatagagctcctcagcaaaggctggaagacttattggttcaggcttttaaggaaatctctgtcccattagctgacaaccaagctaactgagcagtaccttcagttgccaaaccctcccaaaaatacagacttcaaagaattagttctggcaagtcactgaacagcaaatagcagtaacaacaataatagcaacaaacagaaatgacaacaaacattagatcgtggggtgaggggatagacttgatttccagagtttccacattacattatttaaaacattcagttttcaataaaaatttataagacgtgcaaagatacagtaaaggatactccatatatgaaaaaacagtcaattgaaactgtccctgagtaaaccaagatgttggacttactagacaaagtatttaaatgaactattgtacatacattcaaaatactaaaggaaatcatatctaaagactgaaaggaaaatatgagaaggctgtctcccaaataaataatatcaataaagagaaagaaattatttaaaagaaccaaacagaagttcaaaaattgaaaagtatagtaacagaaataaaaaattcactaggctacccaacagcatgtttgaaaaggcagaaaaaagcatcattgaacttgaagataggtcaattcaaacatctagtctgaggaacagaaagtaaaaagaatgaagaaaaatgaacaaagtctcagtaacatgtgggataccatcaagcatacaaacataagcataatgaggattctcagcaaaaaaggagacaaagggtcagaaagaatatttgaagaaataatggttgaaaacttcccatacttgattgaaataaacattaatctacacattaaaggagctcaataaactacaagtaggataaactgaaagagaaccacatctagacatattataatcaaactgtcctaagacaatgacaagaaaaaatcttgaaaacaacagcagagatgtaactcattatataaaagtaaccctcaataagattaatatctccatgatcagaaactataaggctagaaaacagctgaaaaatatatccacagtaccaaaaggaaaagactatgaaccaagaattctatatccactgaaactatacttcaaaaatgaaaaattaagacattctcaaataaacaaaaactgagaaaatttgtttccagtagacctgtcctgtaagaaatacaaaaagaaaagccttcaggctgaaatgaaaagatactagggagcaatctgaatccacatgaagaataaagagaaccgataaagaaaattttataagtaaatatgaaagatagtataaatgtatgtttgtaactcttttttctactatctcatttaaagacaatggcataatgcaaaaattataaaactgcattgataggcttatcgtatgaaaagatgtaattagtaggacaacagtaacacaaatgaaggggtagggaacaaagctatatggagcaaagtttttgtatactatggatacaaaagaaggcagtaaagaaggaataggggaatacaaaggacagaaggcatatagaaaacaaatacagaaaaggcaaatgtaaatcctactttatcactagttacattaaatgtaagtggactaaacactccaatcaaaaggcagagatcagtagaatggataaaataacatgatccaattttacactgtctacaagggacatactttagattcaaagacatgactgggttaaaataaaaaaatggaaaaagtatatatattataccatgcaaacagtagcaaaagagagctgaagtagctattcatatcagataaaacagttttttttaaaaaacggttactagagataaagaacaatattttataatggcaaagggtcaaaccaataagaaaatataacaattaaaggattccctatttaataaatggtgctgggaaaactggctagacatatgtagaaagctgaaactggatcccttccttacaccttataaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaatctactcatctgacaaggggctaatatccagaatctacaattaactcaaacaaatttacaagaaaaaaaaaaaaccacatcaaaaagtgggtgaaggatatgaacagacacttctcaaaggaagaaatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttagtgggagtgtaaactagttcaaccattgcggaagtcagtgtggtgattcctcagggatctagaactagaaataccatttgacccagccatcccattactgggtatatacccaaaggattataaaacatgctgctataaagacacatgcacacatatgtttactgcagcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctcagcaaactatctcaagaacaaaaaaccaaacaccgcatgttctcgctcataggtgggaattgaacaatgagaacacttggacacaggaaggggaacatcacacaccagggcctgtcgtggggtggggggatcggggagggatagcattaggagatatacctaatgctaaatgacgagttaatgggtgcagcacaccaacatggcacatgtatacatatgtaacaaacctgcatgttgtgcacatgtaccctaaaagtataataaaaaaataaaataaaataaataaactttaaaaaaatccttgtacaacaaatattcatagcagcatttttataaaagccaaaaaggggaaaaaaacaaaatatccatcaattggttaatggataacaaaatgtgatatatctatacaataaaatattatttgatattaaaaaaagaaaaataacaattataaataagcatacacctaataacacatccctaaaacatatgaagcaaaggttgagagaactgaaaggacaaatagataattcaacaataataatagtggagccttcaacatctcactttctataatagagcaactagacagaagattaacaagaaagtagaagacttgaacaacactataaaacaactagacctaacagacatctatagagcactccacctaatggcagaatatatatatattttaagagcacaagaagcattccctaggatagcccatactttaggtcaaaaaacaagtctcaataagtttaagagggctcatatgataaaaaaaaaaattctccaaacacaatgtgatagaattagaaagaataaccaaaaagtttgggaaattcacaaatattggttagtaaaacaatacttctaacaaagtaagagttaaagaagaaatcaaagggaaattagaaaatactttgaatgaaaacaaaataaaacataccaaaatacactggatgcagcaaaatcagtacttagaaagaaatgtatggctataaatgcttacattaaaaaggaaaaataaggaataaggtctcaaatcaataacctcaccctccaccttaagatactagaaaaaggagagcaaactacacctaaagcaaacagaaaggacataataaagactagagggagaataaacaaactagagaacagaaaacaatagagaaaatcaacaaaacaaaaatttgttttttgaaaaggtaaaattggtaatcctttagctagttttgccaaaaaaaaaaagagagaagtctcaaatcactaagataagaaacgaaagaggggctttaactactaactttgtagaaataagattataaaggaatattatgaataatggtatgccaaaaaattaggtaacaattatagaccatatgttaggtcataaagcaagtatcaaaacaactcaaggagaattttaaaattagaataaacttataataattagagaggttaaattaataattaaaaatatttccacaaagaaaagctcaggaagagatggcttcactggtgaaattcaccaaatgtttaaagaagactcttttttaaaatgtcagtccttaacaaactcttaaaaataaaaaaagtggagactgcttcccagctcattctatgagggtagcattgccctgacaccaaaaccaattatatcacaagaaagctatagacccttataaatatagatgcaaaaattctcaaaaatactagtaaactaaatccagcaatatttaaaaaggtatgcacaccatgactgaatggcatttatcccaataatgtaagattggattatcatccaaaaatcaatatatataatatactattttaatagaataaaagacaaaaatcacatgattatctcaataggcaaaaagcatttgacaaaatccaacatgctttcatgccacttaacaaacattcaacaaactagaaatagaagggaacttcctcaaactaataaaaggacacttaacaaaaaatgcacagctaacacagtaatggtaaaagactgaatgttttacttttaacaccaggaatcagacaaggatattggctatttaaccacttctatttaacaatgtactggaggttctagacatgcaatcaggcaagagaaagaaataaaaaggcattcagactgtaaagaaaaaagtaaaattatccctatttgcaggtgataaaatctcatatacagataattttaaggaattcagaaaaaactattataataaacaagttcaacaaggttacaggacataagatcaatatacaaaactcagctgtatttctacacactaacattgaacaaatcaaatttaagaaaataatttcatttacaataatatcaaaaagaaaaaaacaggaataaatgtatcaaaataagtgtaagtcttttacacttaaaactacaaaacattgctgaaagaaattaaagaagatacaaataaaggaaagacaacttatatacaggagttggaatataatcttgttaagattgcaatactctccaaattgattgacagagtcaatgcaatccctaaaataaactcagctactaattttggagagattgacaagttgattctaaaattaatatggacatacaagagacctaaaatagtcaaaatgatcttcaagatgaaaaacaaaaagtcaaaggactcacacttttagattttaaaacttacttcaaagatacagtaaccaagacaatgtgatactggcatgaagacatacagattaatggagtagagttgagagtctcataaacctatatatctatggtcaattgactttccacatgggtggcaagacaaataaattgggaaggaatagtcttttcaacaaatggtgctggaatactggatgtccctgtacaaatgaatgatattggaccccttatctcacaccatgtacaaaaatttaacttaaagtggatcaagggcctagatgcaaaagctaaaataatcagctcttagaagaacacatgggcatatgtattcatgcgcttagattaaacaatcacttcttagatataataccaaaagcacaagtaacaaaaaaattataaattgaatatcaaaatctaaaacttttgtgcttcaatagacaccatcaagaaagtgagaagacaactcagaatgaaggcaaatatacataaatcataaatctgataagggacctgtatacaaagtataccaaaaactccaagactcagcaataaaaagaccattaacacaattgaaaatgataaaggacctgaatagacgtttcctaaataagacatacaaatggccaataatcacatgaaaagatgcataacattgttagccattaggaaaatgcaaatcaaaactacaatgagatgcctctccaaggaactgtaaagtatacttactgcaatgaagaagtacaattatctctatttgcagatgacataattctggaatctcctaagattccaccaaaaaactgttagacctaatatatgaattgagtaaaattgcaggatacaaaatcaacatacaaaaatcagtagcatttttatatacaaataatgacctaactgaagaagacatccagcaaacagtcccatttactatagcataaaatgatactgagaaataactttaaccatggaggtgaaagatctgtacactgaaaactataaatcactgatgaaagaaactgaagaaaatacaaataaatggaaagatatcctatgctcctggattggaagaagtaatattgttaaaatgtccatactacctaaagcatatccagattcagtacaatacctatcaaaattccactggcattcttacagaaacagaaaaaaccatcctaatatttgtataaaaccataaaagaccccaaatagccaaaacaatactgagaaagacaaacaaaattggaggcatcacacttcctgatttcaaattatattacaaagctatagtaataaaacagtaagatattgacataaaaactgacacacaagccagtggaacagaatatagagcccagaaataaatccaaaccatgtatggtcaactaatttatgatgaaagcaccaacaggacacaacaggaaaataatggtctcttaaattaatggttctgggaaaactggatttccaaatgcaaaagaaggatattggaccattatcttacaccatacacaaaaatcaactcaaaatgaaaaagacctaaatataagaccaaaaactataaaattcctagaggataacatagggagaaaagtcctggacaatgccttggtcatgattttttgaatatcacaccaaaagctcagtccacaaaagcaaaagtaaataaatgggactacatcaaatgaaaaagcttctgtacaccaaaggaaacaaccaacaaaatgaaatagcaaactatgtattgggaacaaatatttgcaaactatatatctgacaaggggttaaccattcaaaatttataaagaactcatacaactcaaaagtggaaaaacaaacagcccaatccaaaaatgggcaaaaaatcagaatagacatttctccaatgaagacattaaaatggccaacaggtacatcaaaaggtgctcaacattatcaacatcattaatcatcagggaaatgcaaattaaatccattgtgagatacacctcatacccattagggtggctactatcaaaaagtcaaaagatgacaaatgttggtgaggttgtggagaaaagagaactctttacactgttggtgggaatatagattggtacaactattatagaaaatagtatggggtttctaaaggggttaaaaatacaactaccctatgacccagcaacccctcttctggatacatacttacaagaaatgaaatcaccaccttataaagatatctactttctcatattcattgcagcattattcacaagagcaaacatatggaaacaagtaagtgtctattgattaatgaagggataaagatattgaatattatcaagtggtacatatatataatggaatgttattcattcctaaaaaagaatcagatgttgccatttgccatgacatggataagcctggaggacattacactaggtgctacaggacagacacagaaagaaaaatattgcataatctcatttatatgtggaatctgaaaaaaattcaaatatacagagagaacaaaacagtagttactaggggtagtagtcagtgggaagaaaatagggagatgtaggtcggaggatacaaagtagcagatatgtaggatgaacaagtctagagaaataatgtacatgaggaccctaggtaacacaattgtattgtatgtggaattcatgctaaaggagtacaatttagctgctcttgcaacaaaaacaaagaaatgggcaactgtgagatgacggctatgttaatttgcttcactaaagtaacatttttactatctatatgtattccataacatgttgtataccttaaatatacataataaaacttatttaaaaaagaatttagcaagtagaaaaagtggtagaggagagaaaaatgatggtccaaatatagaagtatttgatgtgaattgtggcagagtttcaaagaaaataaaattacataatacgtgaaaaacaaagagacaaattgcccagcaaggatatggacacatcatgtacttcagaaatggcataaagggagataatcaattatgagatagcactcttcaaaggataaatttttagatccaaaatgatcttaagtaacatgaactatgttttggggtgactaatggatgggataacctatagtgttcttttattatatgcttgttttgtacacacgagggatgccataaacaaaatgagttcccttttgcattactacttaaaagtaatcatacgggtcattttccagtggtcattcacttcttgctactacacaatgcttaggcttagaattctgagcctgaatagcaccctaattgcaaaaagcatggtcattaaaaacaaacaaatcggccaggcacagtagctcacacctgtaattcagcattttgggaggccaaggtgggtggaacacctgaggttaagagttcaagaccagcctggccaacatggcaaaacccaatctctactaaaagtacaaaaattagccaggcttggtggcaggcaccttaattccagctactcaggagggtgaggcaggagaaccacttgaacccaatagacagaggttgccgtgagccgagactgtgccactgtactctagcctgggcaacagagtgagactccatcccctgcatcccccaaaaaaacaaaaaccacaatgaaatgctgtgtcacatccactaaaatggctataactaaaagaaagaaataaaaataaggattgataagcatcaaaatggaaccctcattctttgctggtgcgaatgtaaaatggtatagctactgtagaaaacagtctgacagttggtccaaaagttagacacagagttaccacatgacctagcaaatccacttctaggcctatacccaaaagaaccgaaaatctatgtgtactcaaaaatttgtacatgaatgttctcagcagcattattcttaatagccaaaaaagtagaaacaacatcatcaactgatgaataagaaacatatgatatatccaaacaatggaatattattcatccataaaaaagaatgaaggaataaagtgcatgtacacatgaatgaatagtgaaaacattatgttaagtaaaagaaaccaaacacaaatggtcacatattatataattccatttataagaaatgtccaaaatagacaaatccattgaggcagaaagtagattagcagttgctagggccttggaggagggaagagaggggagtggctgctaatgggtagagtttcttttttggagtgatgaaaatgttctggaagcagacagcaatggtatggttgaacaaccttgtgaatatattaaaaaccactgaattgaacaccttaaaatgttgattttgtggtatatgaattacatctcaagaaaaaaaaacttaaagataagaataattagcataaatatgataattacgctgccaagtaagattaataaaaattgttttggatagttgaacaaatcaagtgatacttattgagtagcctaccaagtgctgtggccatggagatgccctattcacatctccctttaggagaacctcatcaggaagtatagctgattgacacctccatctccacgcctctgggtccaagcctcccctggagctgttccccgtcaatgactgagcgtgatgagggcaggaactgggtcactcccgtgaaagcatgatttctccaactggcaaattctgctcgggacttcccattggccaggcagtgattttttccaaaccacactgtgaccaaagactctttatattcactccttacttgtctctcttcttccacagagcactgtggtcaaatgctctccccatctactgctgatcctgctctctttagctttcacatttgtttctcctgaaaaaccttttgctcatctaatattggcatgtgttctttggagagcagaagtgactcatgaatgtatgtctaagaaggaatatagtacaagacttgaggaatgtagctgaaaggccttagtaggactgaatgtgtctgcatgtgtctctgggattccagggatatattgtattcgcttgtactaaacagatgtataaaagacttacataaacaaactactctccaaggtgcctaattcgaaggataatatatgtatttgagtgaagtagttcttgaaatgcttgggaaataccagtttcatacaatcatggtacttaataataaccaatataggtactgactgaggccacaaacactgcatgggcaaatcagacaaggcctgtaagtctaaagcagtgtttttcacactttgggacactgcaaagtgtaaatcatgaaatcagttttgtgggtcatgacagcagatgttttagttttgtttttctttccttaaaagaatagataagaatataggtgcatagtaaaggtaagtatagtttcataaaatatttgtcttagatgtgtgtgtgtatacttgtgtgtgtatttatatacactacctaggtttggatatttttgtcacggattgcattagaaaagatttgaaagtcatgatctaagggacacacaataaagttggcacagtcagaatttacataaagacatttagtaacattctttaaagtaggaacagaatttctgattcccaaaagcttcaccagggttgcatgcttttgagtgataatgtccaagtggagtgagtcacataaaaccttctggtgcatagaggtgctcctccaggcccagaatcatattcataatctgattaggtactggagatcacctcatgtaacccaggtacatctcagagttataaaatgtgcaatatgggctgggtgaggtggctgacgcctgtaattccagcactttgggaggccaaggtgggcgcatcacgaggtcaagagattgagaccatcctggccaaaatggtgaaaccccatctctactaaaaatacaaaaattagctgggtgtggtggcgggcctgtagtcctagctactcggcaggctgaggcaggagaatcacttaaactcaggaggcagaggttgcagtgagccgagatcaccccactgcactccagcctgggtgacagagcgagactccgtctcaaaaaaaagaaaaacaattgcaatatgattgcagggtacaatcatagtacactccggaataaacaaaatcctcactcatcatacttcgtctctccaggctaatacagtctcttccaagtttattcctgactgtatcattgctgctggacaaagacaaagggtggtaacccagacatctctcgagtcttgctaagagctccttggactaactatagagctcatccagtggtttgcctcactagagctacgtctcatgggagtcaattctccttaaaagaatgataggatttgggccatggtggctggaaatctaaaggaagagtcacagagaagtcaggaatggttgcaaaccattgctagaaggggtaatctgttttgcaaaactagattccacacagatgtgtaaaggaaaagaaaataaaagtcaataaggcattgaaacagaagattcactcttctaacctaaaaaatgcaatgcacaaaactaatgttgagaaaagtcacagggctgtctcatcttaaaatttaaagaaactctaaactctcgtaggtgcttctcaaagttgaggtatatgtactctctgggggaaatcatagatgagctaagggatggaaaagccacaggaaaaacaaagcggctctagggtcatattatgtcattgaatctatgagagcatcgattgtaagatggactgttgttgtcagcccactaaaagaaaaaaatgctatgaggcaatgcattatcacttaaaatattttaatcttattttaaaagatatttcagattcaatataaattctatcatataccattcttgaaggaaaatgtaaaactatacaagttgattatacacaagggaaaataaagaatgtcactcttctgaatcaattctcaattcagagtcgtcagtgttcacagatcttatcctctaagccatcaggatattaatgatgcagcatgtatctttaaaagtgctctgctatcatctccagaaatttcttccaagctgctgacactctcttgtaagttttgaggccgtcacttattgaacttagtagaagataccattggagggtttttagataaaaccaaactcatattccttcctaaagtgatctttccttggtttgttggctgcaattttaagggttgctaatgtccagtcttgccactagaaattttttcactgtgcagatacatgtctaaaaatgcaccaacagctaacatcactttgaaggttaagtaagactcctggccatctttccacatggctgtacaccactcattcatcagctcacctgtcattcatctctatgtgtgtgtatgtgcatgcatgcatgagtgcacacacaaaagataacagcattgagttcaatctcattttcatctgagaatgggttcaaactcacacactaaaattgcattcatttcccatttctgcataacaaattactatacatatagcagcttaaaacaacacctatttattatctcagagggctggaagtcacaagttcatcatgacgtgctggatttgctgctcaggctcttataagaccaaaatcaaggaattgacagagctatattcctctctgaaggctctggggaagaatggagctcattcaggttgttggcagaattcaactccttgcagttgtatgactgaggtccaggtttccttgacatttggccctgtctatatttaaaccagcaacatttgttgaatcctgctcgtgcataacatgtctccgacttttcccttctgttgagccttttcagcttccttttgtgtcctcaactgggagaaggctctgttttaagggttcacatgattacatcagactcacctagacaatccagaataatctccctattttaacatcaattgattagttatcttaattatctctgtaatctctttggcttgtaatgtaacgtgaatatatgacaagtggtgaggatcttgggggtcaacattctgcctcccacacttagtttgatattgttcaaaatgaaatatggtgacaagttttgaccacctgacaccatgcatgacatcacattgaaatgctgtacattttgtcatctatgttctcagtgttaattgttttagcactcttggcattggcaggtatgtcaaaggacacaggttttctcagcatttcctatttgactaaattcctagtttttcctaaatgaattacatgtcactggatgttaagcagtttccaatcagttgaaaatttttgacaaattgatgttccacaccttaataacagtcctgcatcatgcacgagtttagttatatcagcctcttgttttgaaatttatttcacttattataagagctttggcaatttctcctgccttcagttgcataacttgacatgtgttaggtgacccgtgtagatgtatttcagtaaccaaatatagcaccacttcatcttcttgagagtttcttccttcattgttgctttgaaagaacatacagaaatgggaccagttttccaaaaacaaatattttcatcactaatatcaaatttacactccacttcttatttctacgtttttctgcaaaacaataacttttcatttcaatgccagaccacactgtaatctcattggacacacatattaaccagcatttaagtccaatctatgtagtaccaacaacgtacaatacacaattgaacagataacacaaacagctctgaccaagtttgtacatgcacaggcaatagctgtgtcaccaactgtcactaagacatcactggtagtaagataccattctgactttcaacatgttaagtgtgagaaaaagtgccttaaaatcattgagcaactactatgtgccaggcattgtgctctttcagcaattctactgaattttcctggtaatctacttgcaagtaataaacgtaatggctgagaagattagtgccagggccaggctaactgggtttcaaatattgcctctgtaacttactgtgttaccctggacatatttcttaattcttatctgtaatataggaaaaaaacgggataattcatgtgcagtacttagcacatagtaaaactcaaaaatagtgtcatgttgtttctgttgtttttaactgagcttaagagctggctccttttcttcccatatgctcatgaagcaaatacctgtattctcccagttagtgaaaaagtattcattctggaaatagaacctcttttagttctaattccttattgttctaaaatataccagattatctcatcctgccttgagtgtactggttcactaaaggacaggagccatcaatactcatgaccagggaactcggagaaaatacggtgtttaaaaaaggaaaaatgtccacataaaaggtttaacattcaggctacttaacactctgtcctccaccttttcttttgtgcatccctttccctatatgcacttggatctctgtgggttaacatctaacaaaggtttaggaattaaaaggtctgtaaaaaatggggtacactcggggttgtttaggggctaggcaacagactatgacacctgggggagaaagtgagccttcttcccatttctgcacaaatgacccagcctgtcccaggttcgtgaaggtcaccagtgcacctaaggtagtgctggggagctgtggcacagcactggtgaggagtgcagttatgcccgtgggaattccggagtgggcaaggaagcccacatcatagaacgctgctctgtcatggccagagggagaggatttatgggtggtcacttggaagaaatgatgagtcagtagtaaattattattattattattattattattattattattattattattattttaaatcttaggcttggcatggtggttcacgccagcacttttgggaggccaaagcaggaggatcccttgaggccaggaatttgagaccagcctgggcaacacagtgagactcctgtctctacaaaataattttaaaattagccaggtgtggtggcatgcacttgcagtcctagctaattgggaggttgagatgggaggattgcttaagcccaggagttcaaggattacagtgaactatgattgcaccactgcactcttgcctgggcaacagagtgagaccctgtctctaaaaaaagaaatcttagaaactccaggaatacttcaaggatggcttttacaagggactagggttcttatgttacactacataggagaaatgcttaagcagccaaatatataaattataactattaatgtgactctatttatttaaagccatagtctggaggcctggtgaaatctggttatgtttgtattatatttttaacccactcccaccactgttcattgcccttgagatccttgaggacagagactgcttttaatttttaaaaaatctctgtagccctatcacctagcagagaactcagcacagagtaggtactcaatatatgactgttgaaggaaggaataactgcctccaaacaacaaatttagaataaacagatagaagttataggaatataattcaacataaaatgcctttctaactactagaatcccttataaatgcaagaagtctatcatgacatagtgagaatcctgtcactagaggtgttgccagtgataccctggaagaggagcacacttcatggagggagatggattgaatcatttccagctcttgaattgattggtactcattgcatggagaccaacaggagactagctatgacaaagcagtgaaagacactaagcagaagtgatgagtcagcaaaactggttattatttaaaaatggcttcaaggactatctataaaaatcagcaagcctcaaaccagagttcatcagaattgaaataataccctgaaacattgttacaaggagccatagaaattgtcttctaaaaactacactattataactctgactgatgttcagaggactaaagtatctaatagacatcatctatagtgatgatgttaaatgatgaaaggttaaaggaaagatcagactgtgagatcaagctgtgatttttagactcatagcccatttcaatgtcccttccatgtcactggtgaagtaaattctggagtcacttgtcttggttcctttaacttccaataaatgactgaaggaactcagatctacacgaggagaattactggacaatgatggaaaggtcttctgagataaatgaacattctacattaatttaaaagccataaatagaatgatgaataggactatctcataatgtcaaagttcaaaggcacttttcaaatgtctctttaaagaaaacctgacctttctttctgtcttttattatcagaaagtttgccaagagcagtctaggtcttgggtcatttcattttgacatggaagttctctcaggattaaaaataataaaaaaacagaagtatttaactctgaagtgaccatgagaacatgttcagcagtataaaaaataacaatattgaagcattaggacttcaaaagttgtgttttaataactacataaagcttcccctctcatatatgagagatataacttatatgaggtcatgaatagctaaagatatcagcatgaatagagatttttctatcgtatttcatgttgttttataacattctatttaggaaaattgctgagtatactactagtaactttctatgctaaatatcttggttaggtatagattagctggcattaaatatagatgtgaatataaatacatttttatgaatataaaacctcttaccaaagacctctttttcccatttcaatttccattttaaggtattattaacagtcagtaaaattcacccttttttaggtaaatttctccaagttttgacaaatacagttgtataatcaccactgcaagcaagacacagcgtggttccatcacaaccctctacccctttgaagtcaacccctctctccatctcctgtccctggaaatgaactgatttactttctcttcctataattttgatgttttaagaatgtcctgtaaatgaagttatatagtatgtagcaaaggccccttttaaacttcatgcatttgataaaaaataatttactttttatttttacttactggtttctatttcctgaatttaaaggcaataatggatataaaaatcaaattactcttgagtattacatcttgaaataggtaattacccagagggcctttagaacatatagacctttaggacttcacttctgcagtactgaatcagaatctctcagtgtatgttctgagaatttagtttctactaaactttctaagcctgattctgattgacccattagatttgggaaacattaacctgacaggtattcactagatgagatcaacaagcagattttaaatgacgtgtggttatggaatcaaagttcagaggttgggagagtcttatctaagtgaccttgtccttggtggctaccacttgctggttgcagggcctcaaacaagttacttaaacttgatgaaccttggctttctcctttataacatggggggaatgcctacttcaaaagattgtttgggggattaaatgcttataaatcatttagcatactacatggaacacataacagtcaaataatggaggttgctcatattttagtatcaatatcttcatcattgtcatcatcatcatactgccctgagtgctttacgattctttctccatgtctgcattttggttaatttcactattttttaacccttcctctagaggcaaccaaagagaatttttgtagcaacacagctattattcaaggcagtaaaaagctaagagaaattcactgattgcttgcaatcttcacttctaccctgttatagcctcaaagatgccaatgagaacaagaagtgaattactggaaactctctcagtcttttttccaagcggatgttattggccaattatggacaaacaagagggaggaagagaaacaaagagcaaaaataaagtaaaaaattaggctgtctgtacagctaagatacatctaaaattttactttttttattggaagatttagtcaaatatgtgatgtgaaaagaaactgaaactgttggcttaatgaaaacaggtttgctccagtactattccatattaacttacctaaataacttggattcaaagttcaggagtcagcagagtatcttaagatttatttcaaaacattacaaggtggccgggcacagtggttcgcacctgtaatgctagcactttgggaggccaagacgggcagatcacttgaggtcaggagttcgaaaccagcctggccaacatggtgaaacccagtctctactaaaaatacaaaaattagccaggtgtggtggcatgccctggtaatcccagctactcaggtggctgaggcaggagaatcgtttgaacctgggaggcagaggctgcagtgagccaagattgcagtgcttcactctagcctgggtgacagagcgagactccacgttaaaaaacaagacaaacaaacaaacaaaaatttacaaggttcagggaaaagaggaagctaaaggcaacattttaatcctattacaagtactaaaagttggccctaaaaactgattgcaagctagatgtatatgcatttatttatttatttatttatttttattttatttttttgaggcagagtctcgctctgtcacccaggctggagtgcagtggcacaatctcggctcactgcaagctccacctcccaggttcactccattctcctgcctcagcctcccaagtagctgggaccacaggcacccgccaccatgcccggctaatttttttttgtattttgtagtagagacggcatttcaccatgttagccaggatggtctcgatctcctgatctcatgattcgcccgcctcagcctcccaaagtgctgggattacaggctgagccaccgcgcctggccgtatatgcatttatttttaagatatagttttaatttaagccctgaaatacagaagagtcacgatatttggttgtgcttgctaatataaagaactactactatcttctaagaattatgcaatgctgctaacaccaaggacaaaagaacatcaaaagacccatgaaccccacaagccctacctgttctcagcatcagcactgcactttggggacatcaattcaaaggatttggtaaatttcaccacctgtcgcatagaaagataataaatccaggtcaattaaagctttattgccgtttaaaataatgtaataaacattttcatctttataatgattataatacttggagattatagagagatttttaagtggagaaatcccaagacagagtagaagaggagaatcccatcctacatcttgtatcttatttcttacaaagcatacattgtcaaagttttaatacatttcactaaacatgtacatatttttacaattaggtgtacaatgagctatggaggtcaggtaaaggaaaatctcatttgaatacttaaaaagaaaactgttcttttaacaacccaatcaacagcaataagagacccaggtagggacagaacacccctcaaagaagatgccctctgtcaaccccaggctcctgaagttagttcatctttaagcttggctcatcattgttctcaggtgagcttcgtggtaccaccacctaaagggtaaagaggaagccaccttattcaacaatcattcttgtgtggacacttcctctctcacctctccagtgaaagtagcataccagtgcgagagttgaccaaggcttatgttgagggggaatttatggaacagaaaatgtcaatgtagtttttcttattattagctaatattgagtttacactgtaaaccaggccctacagcagaagcttttttgattatttctttattataaatctaaagtagagaattttatactcagtctatagatgaggaaactaacccctaatttttaaaaagacttactcagtttcacacaattaaataaggcaactggcatgaaaggaattctctctgatgctagagtgctagctctttcaacactacaaatgttgagtgagaaatgcactatttctggcccttgtaggggtggacggaaacctttccttctaccctctgaaggtttgctgaaataaactgacaatagacagattaacaggagaacaagcatacaaatttactaatgtgcagaagcacagaagccatataaagtatgagactcaaaggagggccagatggttgaagcttaaatagcatcctctttataggggagacggacgggggatgtaggcaattttgaggggtagaaaaaaatttcagaggaattaaatgagcccaaagaacagacaatgaccagggacaaagtttctctgagctctggaggaggtggcagcaagttaggggtggaacttcactgcaaacaaaggttatctttttttttttttggacaggttctcactctgtcgcacaggctggagtgcagtggcccaatctcggctcattgcagcctccgcctcccgggttcaagtaattctcccacctcagcctcccaagtcgctgggattacaggggcgtgtcatcatgcccagctaatttttgcatttttagtagagacagggtttcaccatgttgaccagggtagtcttgaattcctcaccccagatgaggcacaagccttggcttcccaaagtgctgagattacaggcacgagccaccgcatctggccaaaggttatcttattatgcagataaagtctcccgggtaatctctcagagtgccctcagaagaacagatggaaagtctgtctgggcatggggacattcctcagtcttcctttctgtgatatgcgaataatattctctggttaataaaatttcagggaggggatggaagagagttccatcttgtacttgtgaggaggaacaagaaaaggttagaaagttcttggctctgaggggactcagttccaaggccttttaatttcctttagatcaacgtgctcagtatgccaaggcaccatgctttgaagtctccttttctgagccccaataccctcttttgacaagatataccacatgatagaaaaacaagcccctatagtgaaaggagtccatctgaatgtcatagaatgcttccaaggttgacatttagattttccttagccgtacgcagtcatgcttcaaaggccttttaaattaaccacttacaaggaattgatgagcacctgagaaaatgatttggaaaataggaatagattaaatatttaaaaaagctttatcagtgaggtaatgaactcaagctaggcaaatgcaacattagggaaaaaatagaaaagaagggctcatcacaaagaaaattctgtgtgaccagatgaatgtagggcaatgacaatagctcaactgcaaggaaatacccttgacaactatagaacatatttcatttcatattgtaatatgaattaagcctctacagaatcactcattgtggcaaattttattttccaaagatggtcacaacaatatcttctatcccatattcttctcttccatgtaaccctgccactttcctaccaagtggtaggatctacgtcctctctccttaaatccggtgggcttctgaaagcttcaacaaatagagcatatggaagacatgctacatgccttccaaggttgttgtaaaatgcaacacagcttctgccttgcctgatgaaatatgtgtgcttggagccctcggtcaccatgcaagaagtgcaactaccctcaggccactatgctgaaagggagccaaaccacatagagaggacattttcctgcaaatgagggatttttcacacattataaacaatcctttatgcatgtatcaatgcttacaacatcccagaaggtagattttatcctcattttattgacagcaaattaaggcttagggggttaagtggtttgctggaagccatgcaagcaggaaattgcagaaccgagatttgaaccatgttgttctgattccacagctccagtgatcccacttctcactgctttaataagcaagagcaagtgttattgcagcagcaaattatttggacatgactccttcaaaaccagaataaactctactttatttactaattctacaaatatttattgagtacctcctatatgcccaaatttgagtaaacacagactaaaaagtaacttgaagtaaaacacttggcttggtataagattaatcatattatcaataaactgttaattgtttctgcatttcaaaattgagcaggacatttttttaattcctgatctgataaatgagattaaattctccaatattaataagaatgcttcatttggcctacttcttactattgattagaataatttacagcgtggtaagagtagatgttaatttctgcaaatctgatagcaatacaaataaattttatccaagtaaagatgcaaatgatttctgtgcaggagaaaagaaaagctcaatggttacaattgtattatcctgactggtagtaaccattttaaaaagctaatctagcaatcttatgctggcattctttcagtgcctattttagaaccaactttgccactctgcggtttctctttttgatgagttaaacaaatctttgatacatgcttgctttagatttctgcaagagttaagtttttaactttttgaaaattatctttcaatacaacaaatacgtaccgtcttatgtgtcaggcagtgtagtgtacaatggaattacaaatgtgaaagtaaaagaaaataaaatctctgcagttatggagcttgctttatggtagggagcttaatttgccctggctcctcaaaactagtgctccctggaaaaaataagtgcacttctggtttcacatcttaagaaaacaaatgtgagaaatgtccagagaatgaaagaaaataaagatcttttaaaaatattttttccatctgaggaatagcaactgagggatataagaaatggaataggaaataatagcgtttcaaagccatagaacctgtagatctacagagaatggataagatatatacatctcttaatgaaatgacaggatgtttgaactcttgtaaaagaagttggagaaactactaaaaggaaaaaacacttttttctaaaatgttagaacatcttactccaacataaattacaagctgaaaagaaaaatagggacaaaacttttatttgttttgttttctaaattcatttttaatgtataaggggaaagtcaaggactatgtatcattcaacttcagcattccatagaatgcattagctgtgtcctccagtaaaatggcttatggtgccatgatcaaagtcagacactgtattcatgaaccacgattgaccttgtatgtaggaaagaactgaaccttccctaaagagaggtctggcctttgtccttggctcctgagagataatctctaaacccttgtaatgcctgattaatgtgcaaagagtaacagtgtgatttagaatgggggcttcaagccacaccaacaatatgatttgggtgggagctttgggacacatggtatcagttgaccactggaggaaaggagtcagaggtcagccgcatgggcaggtcaaccctatttttgtgatcaagccccaataaagactctagacactaaggctcaggccccggttggcaaaatttcatgcatcttgtcacacatgatagccaggagacattgacactatccatgactccatgagcagagtccacatgtggaattttcctagactctgccccatgctaatgttaatctgtatgatttcctgtagtaaactgtaactgtgagtgtaacagctttcaatgagttctttgagcccttctagcaaattactgaaacttagcatggtcttgggaactccaaaactcataaatggtgtcaggaatgaggaaagtattgtagactatgttccctaactttacacttatatcataattcttaggttcctgtgtctttagaagaaaaatgaagatactaatcttcattagtgtctttagaagaaaaatgaagatactgatgtttactgatctttggttaaatattgattatccagtgtgtataaagtactggatagcacagggagataccaaagaaataataaataaggtctctaaccttttaagacttaacatttgtgatggttaattggtatgtgtcaacttgactgggctaaggggtgcccagatagctggcaaaacattatttttgggtggtctgtgaagtgtttctggaagagattagcattcgaatcaataaattgagtaaagaagattgtcctgagcaatgtgggtgggcattgtccaatccactgagggctcagatagaaaggaagaggaagggcaaatgtggtctctttgtttgagctaggacatccatttttcccctgtcctcagacactgggactcctgattctctggtctttgaactcagactgaattacatcaccagctttcctggttctctagcttgcagacagtaaactgtgggacttcttagcttccataattatgtgagccaattcctagaataaatatctttatctctatctatctatcatctatctgtctatctatctatctatctatctatctatctatctatctatctatccatctatctatctagtctcctattggttctgtttctcaggagaaccacaactactgcaacattttaaagaagaaaaatttaaagtgcaaggtgagttgacctctgaggttagattcacagccaaattgaccctgagtcatcagattatttggcaaggcaatatacatgtggcattagtccgtgatgaggcagcaagatgaacagttgagaagtaacataattctggagatgtaaattcatctgccagcctctcagtcctcaaaagcaggagtgggcaaaggatggcccatgggccatatctggcctaccacctgtttttattaataaagtttcattgtaacaaagccatacttattaatttaagtattgtctgtgcctgctttctactataacagtagagtgaatagttgcaattgagatcgtgcaggccacaaagcctaaaatatttagtagacagacctttatttttaaaagtttgccaacttctctggtgtagagccatttctaggccagatcagttatttttgctaaattgttaatggctaatgataggttaatgtattaatattcccatgtaatatagctatattcagaaagaggattcttggagacataatcttttaatttgaaacagtattgcaatgatagaaattttaggcaccagggtaagtggtaagagatatactcgaggatatatccccagttggcaggggacagttccactccaattaagcctgttgtccagggacaattattaatagtgcccactttcacgctcacaagtgtctttgaatagcaaattctaggcaggcaggccattggctgctcctcaaagcatcagacaacttatatttttaaaaagaattgaaaatataatgcattcaaagagaaaattgtttatagtcagatacctgggttaaaaaataaaacagcaaaaacggcttaaatatttggatataatttaacgggatatatagaatgacattgcagaaattatgaccaataccaaataggtgaaggcataaataaaatagaatagaatttatgctttattcctgacttggaccaattatataattcttagttttattaattttaaaagtttactatctaaatccaactttgattttattatacatttactaaatgaacatggattaaataaattaatatacacacactaagtaaaaaagagaatcttataagggaaatatcagaagtggtttctaaatcaatgacacaaaacaactggtttcaagcttcctttgctgctgatcagccctgattattgcaccctggggaagggagtgtacctgccaagtgaagtaaacaaaacatctccctgcttgttctttggaaaagctccatggacagaagtctttttgatttggatatttatcaagtgctagttggtctggcttctctctgttcttttaacttaaaaacaagttaaaaaaataaaaactatactcaaatagatattccgggcaccaaaataaaaattatctactaagtaatcatgatttttgttttctaattttctgaatctctatttttctataagaggactactcaaaatggcaaaagaatgaattaaataggccaagtgtggtggctcacacctgtaatgccagcactttgggaagtcaaggtgggtagataactgagatcaggagttcgagaccagcatgaccaacatggtgaaaccccgtctctattaaaaatacaaaaattagccacgcatggtggcatgcacctgtaatcccagctactcagcaggctgaggcaggagaatcgtttgaatctgggaagtggaggctgcagtgagccgagatgcaccactgcactccagcctaagtgacacagcaagactctgtctcaaaaaaaaaaaaaagaaaaagaatgaattaaacaatcatctcttactatgcttcttaataaatctcttacttatgccaatttactctaatcatttattcatgcagtcagcatttatcaaatacttagtgcaccaagcactgctataggctctataaacaccaaggggcacaaaccatatcctatccttgagaaactcacaacacagtacagagaagcaaacagttcacaaatgtttcaccacaatgtatgtccaaaatgctaccagtgcacagaggaaggtgttaaggaagtcttcatgtgaactgtgtgacaagcaggaacgctctaggctgacaagtgggggaagtttcccaggctgagggaacaaatcagttcgttctgggagaaaatagagaactctcaaaagagtttaactgaacataattcaataaaggggcaagctatagaagtgtgggtagggtgaaaagaagcccataaggaatggtgaggcacccaggcactagcaactttggaaagcagttaatactcctaggtctgaggttacacaagagggagggaggggagaagggaagggtgattttgagatcctggaggtgattttgatatccatgtgaagagaagccatggaaagatctagccaccactagaactggtaaacaaggaatgaggaaaataactacacccaatgtctttcactcctctggcccttaaatcttctgctcataccttctatttgtcaaacccaactggcagccagaggacaagaaagcccaagtggtgtggtaagcaaagatcagccctcaagggcactgaggtaaagacagaaagaccaaccataggtagttggggagtggagaggttccagagagtagccagtagagttgacaatgttgaactttacctgagctctgtgctcccccaaaatagtaatgataaagaaatctccctatcactgttccagaattggctatcctcaacagaccactctgccctagcacatttcaaaataagacatttctccatccttcctcatgactcctgtaaggctcatgaatgatgtaggtaactcccttgtctatacgtttctgtgaaaccccatctttttctttgagatgttcaccattaatgagcattctccctattgcaatagccagatgaaatgatcttcattgtctggtgcattttgtctttcactgggactatttgcacaaagatatgcatcttttgtgttaataggctagtacatgcttaggctgaccatggggaggtggggtagaggtgaagtaaaggatagagcaaggctgaggaccagagaggagaaccgcaagttaagttagaagcagaagtgatgggccttgaatgttgggtagtgtgagcattattatacaagcaatagacaactaccaatgttttgaatcataggagaggccagtgcatgtttaaaaagaagcagtaattgaaaagaagagtgccctctttgcaagcaagaaatgagtcaggagaaaaatgtcctagtgagagatcagtaaagacacagtgaagaaggtggtagaaagagtgagaaggaagggctagaaatgatgtttcaaggtagaagcaacagatcatagacacaagtgaatgtagaatagtgagaacgacttagaaactactctacagtttttagcttgagttacttactaaatggtgatggttctattggctaaataggaaatatcagaggtggagaagatttgggatgggatgtaatggagatggacagtggggttaggggttcagtagttgaagattatataaatatatatatgcatacatatgtttatttaacatataaatgattaatgatgtgagttgatttactatattgatatacagttattaataaaatgagttaatatgtatgaacaagtaatatgatacattaatgatgtgagtgtgtgtgtgtgtgtgtgtgtatatatagtactatatatgcacattttttcagttaatataattggccctctttatccatgggttctgcatccacaaccaaatgcaggtcgaaaatacagcattcagggcaatgtgaaacctgcagatacagaaggctgacctttcatatctgtgggttctgcagggctgactgcaggacttgagtgtgcatagattttggtatccatgcgctgtcctggaaccaatacccaacagatactgagggatgactgtgtatataacaataatagtttgggtaatcatcagaggatttttttttaaatactctccactttgcacactagaaaaacacttggagcaaaaatcaaactgaatttaagtgggcttctttatagggagaaggaaaatcaaagaaggaaaggtagggaaatggaaagtaagtgatatagaaagcaaaggctgaggcaatttttgcaactcacttgagaaggagggcactgaattacggactgccccagaacaatcggaggatgctcgccccatctcttccccttgagtgtaggattcaggaagactgtctagttcattggcttaactgtatgtacatttacataaggaccaaggagctaaggaggatataagaaaacaagtgtgcctagctagcttatgcttcacagttttgtaaagaaactccagacactagccaggtatttataagcttagttagaaagtacttcgtagagttcttaacaacgaaatagctgccagccatcaagatgatacatgagaagagaacacttgtaaaaactaggacttgagacagtgccttaggacataagattaaaatgtctacattcactttccttgactacacacaaaaataaatagaaataatagtaaatgcatgagctggaaagaactaagagaagtgataggaattgcttagacaggttcataggatggaataacagtaagcagggaatattcagttcaaggagctaaatagttcctaatgttaacagcagcagccagctatggagcaatctttccttcttcccagtctaatggaaaatgccattgacaaaatcacttaaaatcaatggactgaaacacttaagagaagcaaaagggtgcaaaatattaattttgtcaggagaaagggctagaacagcattcctcatttctatttttggcatccattcagtaaactgaacagtttacacctgagtgcctagcttaaagaccacaaatgcagtttctaaacacagagttaagatcttggtgaatcaaagcttctacaaccagaattaattttttctcccttattcccttcaaatataaaggccataaaacataaatttgcaataagcagtttttttaagtattagaatcacaaaatacaaatagaacttttgttttcaggaattattctaataaaatagaaataaaacttacttttggagggagaaacttttattttcctgaatgatactgttttgttttctaattataaaagtagtgtacagaatgccagtagagatggtgctataagttcatgcttttacacatctgatcttttccaaaaacagagcaaagactgataaaacacagaggaaatcagaaagacatttagagattgaaaggaagagagaagaaaaggagagggaaagggaggagaagggaaaggagggaaaagatctctaaagtcacaagcctgaagacatgtaggcctgctgaactccaagtccagaaacaggctggcagtgatggtcggaatttcagctcctgctggggtgtgggaaacaggtgacccagcttcaccccaagaaactgaaccaagctgcctctagcttggtgtaatattactacatagcaggaaatctgagccaccagaataagtcttggtttttgattaggggtcaggaagctgggcaaactattagacaggtaggaaagagggcaagagagaaagaaagaaagcaatggcataagcaaacaaaaacactctcccatccaaatcagctgcaatcccaaattcaaaaacacataattaatacaaacaactaaatcaacaacctacataattggacaaaaaatactgaagaatctgttaagctaaaaatttgaacacacccataatcagagattgatagatgaagaatagaaaagtattaagaatatagatgacttggacaacatttcattcttgattaacggggtcttaggaaacgtcggctggacaagccgttaaaaaagaaaaaaaaaaaagattttcctcagctgggtgcggtggctcatgcttgtaatcccaacactttgggaggccaaagtggaaggattgcttgagcacagtggtttgagaccagcttgggcaactagtggaacctcatttccacaaaaattagctggatgtggtggtgtgcacctgaagtcctagctacttgagaggctgaggtgggaggatcacttgagcctgggacgtcaaggctgcagtgagctgtgatggtgccactgcactccagcgtaggtgacagagtgaaaccctgtctcaaacaaacaagcaaacaaacaaaaaggattttgctccctgagagaaaagagagggatgtgaaaagaagtttctctttcttctcctggacacagttatgtgtggacgtgctgcctagtgcactataaagggaaaagccagctggtgatggccaaccactgagacaaacagagggcaatggacagagcctgggtccctgatcacatcatctggctgctgcgtcatccccagaaccacctcctggagacttctagtcatgtaagttaataaatgttctcagtgtgaaagccacttgcccttgaatattctgttacctgcaggagtcacccaaattgatccataaattagatacatttcaatcaaaatctatacagagttttcatggaatttgctaagctgctattaaaattttatggaagaatgacaggtcaagaataagcaagccagttttaaaggggaacaacactgaggacttggcctatcagatatcaaaatgcattacaaaattacagaaattcagatagatactggtgcagaaataaacaaatagaccagcaggacaaaattgtgagctcagaaacagacccaggtatatatggaaactataattttgaagtgccactacaaagtggaggcaaaacagttctaagacaattggttatacacatactgctttataccccacacaaaaacattctagatggataaaaaagaccatgcataccaaatggatgtaaaaagatatacaataatgccattatagctaaaggtagataaagatttttataacaaaacccttaaagcaaaaatcaaaaaaggaggttaataaatttgacacattaaaattaaaatattccacaaatatacctgttgagagaggcaatccacaaaaccaagccatgcatgtcaggactttaaggccctagttcagttctcaggattgtatttgcagtgagcaaacctgggagatgaagtaacatctttccac

SEQ ID NO: 1360 - DNA, 485090 bp, Homo sapiens
ttaaactctaagtattttattaaaaacaaagatattcaggtctcttaaagcgggcttccaaaactatggattagttgcttgtgaaatggccaacctgtctataatgtaatattcttacaatgaaacatcagtctgggaaatctacacaaagtgaatgatttcaaacaactcaattgaaaacgtatttcctttctttcgtgtaaaacaataataattaggaaggaagtcagtaggagatcctttttaggttattgtacatgaaaataaaatggcaaaagcaatttccccccaagggaatgagactcaacaaaacttagcctcctatttccaatgttatttttaaaatttcatctaaatatgtcttaatctaaactagagtaaaagaaaaattgagattcgaatacacacgcatatacacacagaaaatgaacacagatataaacggtggcacaaataatacatttttcacagcaaatacttcattacttaataaaaaaacacatttgtgtactagcgtatacaaaaatgacattggtgtagttatgttatacagataaacaatttatctttagcagtgaggagagaggtaccaaacatgcaagaacattcaaaattaaatttaaaaaagtacaaccccaaattactagctgaagacaaggtcatgacaaacagtgtcagcatgacattgggcattgctaaatctaaatgctcatcatgaaattctccagatacacctcattttatttctgccctctatatgttttattctattattcttcacttaggaagctggtgcaattttggccttcttgtagtcagacttaacctttacatttcctgatacatttgagttttgggagttctttacagcatgtagcagaataacaatttcagagactgttactctgaagcagataatgaaacttcattacagtggcattgccagagtttttagggtcccaaattaggttttgttctgttgctttaatgaatcctttttgtgttttggtggtttttttttttttcagccaaggcatttttctttatatttaaatctttccctagtatgtctaggtttctgtcccactggaaggaaattgtttcacactattactggagatgaaactggtttttgtctttctgcaatttctaagagtcagcaggaaaaatagattttaaaataattttactgcagaataaattgggcagattctgtttaattacctagtgttaagtggaaaaagttatgataaattttgatacacagaaaaagcaactggattctggcagcattaatattagataatattgttattacactaacacaaaatgttaaagatgatttctaacccaatgtatttgcaaatatacaatacctggaaatgcatagacatctcagattttagaaacaaaatgcatgtgcaattttaacttctcttaactttataaattcacttctaaattaatgactaccatttatgggatatgtgtgatatcagataatctaaaattgttttttatgaaataaaaggacatataaggtgggtgtggtggttcatatctctaaccctaacactttgggaggccaaggcaggaggattgcttgagcccaggagttcgagaccagtgtggtcagcatagtgaggcctcgtctttacaaacaatacaaaatttagctgggtgtggtggtgcacacctgtggtcccagctactcatgaggctgaggcaggaaagatcacttaagttggagaggtcaaggctgcagtggctgtgattgtgccactgccctccagcctgggtgacagagcaagaccctgtctcaaaaaaaggacatatctttttttaaattgtattgatgactacatctttcatcataattagagacaggctcaagatacatctgtagtatgattgtgcttacatctaccccatatatgtaagttttattatgtctttattaagaagatgactgctttaggtttgttgctattttatttgagaagaataaaaaagaaaattatctggaaaatttctttaaagctaaacacgtcttggtcctttggtgtggggactgaataaaagtcagtgcttttatgtaatagatggagattctaagacttggagagtcctaagattacaggttcagctggtggccaagctaggagggagttccagtctgctatgcactgaatggcaccctttgcagtatgtgaagctgtccctacccaccaggattgccactacattgtagattgtgcacataatagctacatagtgactagtaagaataaatatgtctgaaaaaaatacatctcatcgaaaaagtaggatgaagttatttcaacaattaatgccaagagacctgaggaagcaaacataatctggtcagtttgagtttttacaagaaggctcatatttcaaatgtctttctccaataggaaataaacattaataataaggactgggaaacttcctttctcttttttggaaaagcagattatatggataactgcatatgcctcacattcttgcaaaattataaattgtttagaaaagggattaaaaacgcctgaaacccgcaagagttcaacctctaacctctggggttgttggcaccaggaagctgctaccttcctgtccactgcttcatagtcatggagacacagacccatggcattagtcagcagtttctaaatcttgacccacaataggaaagatacctcaagacaggagaaatagatggaggcaattacaaacagctactagattgatggttgacattgtcagggctccactgtatggcagattgcaatggtgttgaactccccttgctaccagtggatgttgctattggcaaccatgcagtgaagccaataaaacggcaagaaaatgagaggaaaactcaaccttagtggaagcttgtagggtttatgctataaattatgttccccttagcaatatgtagcatcaatgttcaggatagctacagtgctcacggcagcctgcagtctctgtcagaccctgggtccagttttgtcataaagcacatgctttaaaatgttgctgtagatggactggcatccatttgtctgggctatttatttatttattgttggggaggataacagatgtgggctcatctctgcctcacacagactgattttcaattcccgttcgtgatataaacatgatgtggcacattacccagaaacacctgcagtgcttcggagctgcagacacgtcacgatctcgcagaccagactctgtccctgactccacccaccctttgttccccacctgaaggaggagagacagccctgcagaagctattttcctttatagcagagtgatacagaaaactggcttaataaaatccataaatctgaacaacctcctcttacctgctctgcagaggcagtttcttcctgcattcatttccccctctactttctccagtcttccctgcagagacagctgtaaagggtagctaggaacattattttttagggctctcactccttccttctcccctttctcaaacccctccctgctcaagtgtctctcttttctgagcaattgatgacagggttctacaccttcattttttttggttggaagtgccatttttctttgtttggattgactttcaccttttttttttttttttcatttcccttaaccacctgtctcggtccctgtctttcctttactggtgttcttacgtttctttttcttcttgcttttattcccctcttagtctggtttatactttttttttttttttttttttttttttttttttttgagacggagtctcgctggtcgcccaggctggagggcagtgacgtgatctcgactcactgcaagctccgcctcgcgggttcccgccattctcttgcctcagcctccccagtagctgggactacagacgcctgccaccgcgcctggctaatttgttttgtgttttttagtagagacagggtttcaccgtgttagccaggacggtctcgatctcctgacctcgtgatccgcccgcctcggccttccaaattgctgggattacaggcgtgagccaccgcgcccggtctatacatttcttttactttgtttcttgccataaagagtctttttctctacaattacctgctctcccctcaattccattttggtatcttaattttacccattccttcttcagacatttcctgaattgtctactgtgtgccaggaaaacaatgtcgcatgtagaacatggcccctatttctttaatatctgtaaagttaatgattgataatgattaataacaataacaagggccgggtacggtggctcacgcctgtaatcccagcactttcggaggcagaggtgggtggctcacctgaggtcaggagtttgagatcagcctggcaaacatggtgaaaccctgtgtctactaaaagtacaaaaattagccaggcgtggtggcaggcacctgtaatcccagcttctcaggaggttgaggctggagaattgcttgaacccaggaagcagaggttgcagtaagccgagatcacgccattgcactccagcctgggcaacaagagtgaaaactcagtctcaaaaaacaaacaaacaaagaaacaaaaacaataacaagaaaaatggtttgtaaatttcagatttttttaagagctagaatggctctcaggtttaatctaggccagggattttcaaactcttcagagtccctgtggacccccatgtacgtaatcaaagagatgaaggtttgtaggtgctctggatgtccaaaccctgcttataattcacataggaattcagctttttgacgttttatatgttggggattcattgaaagatttatttgaacaaagagttgtaaggttaaaacatgttcgagaatcgtttcctagtgtaatctaatttgacaaataaggaaacaagcttgtagaagttaagtgacttgttcaagtcaatccagtcaataatgccaaagctaaggatagaaatctatcttctagcccaatgttctttggataacacataccatgtccacaatttctcaatatagggagcaaagcagctttctagtcattacatctacttaatacagtttattcttacctattgtaaacctggcttcctatagaatatgcgttctttgcccagactgttatttcttaacatttgaagcattgtttcttacacttaaggaaaaatccaaaattagggacccctatagtttgctttaagttggttactggtagtaatcttaaattttataccagaactcctcactaggagaactcaaggtagtcaatgcttagtctccatggctctgctctgtcctgtgaactatagtttctagatgtcacttgtggtaaatccagctacagatttccttccacccttactttaatcaaaatctatcaatccattccttctgggagaaaactttgtctgtaatgaaggttgaattttaaaactctggaaaagggtaccatagtcccagtctagaattacccatcaaacacatttgctatagtcctactatgtattcatttttagggggagaactgggattgatcagtatttataaggatagtatagtttaccttttaggtaggcaattctaaaggatccatcaataagaagctctaggattaaaaataaaatacctctatggaatacaaattaggattcttgggacagtctggcacaaaaaggcattcagggacaggaagcaaagacaggcagtgtttggcttgtaacaaacagaaaagccctatacaaaacgaagcagcgctaatgacgcttttactgttcagtgttccctcagctcagagtaagtaggccgactgtccacaggtccttggatccaaaacagtcccctacccagagccttcatttcagcccatgcgtgttcattagggaaaagtgagggtcctggggtgtgctccctgccccacctctttctttgtccttcccgttgctctctctgctgctgaccatgcttcaaggtgaaagcccaggcatgcttcccagtgcatccttgagatgttaggtctttctgagctaaaagaacaaaaggatgacattgctggactgaaaatggcccttcaggctgtagtcattttgcagctgcagctgacctggaggtttagttcctgtcttccttggctaccataacactggcaggggaggatgaggcagttgaggccagcagtcgtttttggtgtagctcttcccacttacttctgtttgtagctactgaatctagcatcggcttcagtttcacgttgaccttcaccagtgcctaaaacaaaacaaaacaaaacacaggtggaggagagaggaaacagagtaactgacatgattttccacctttcacttatgaggagaatggaaactggctataggaaatgaaagtgatgattattttggtaaacaagagctatttacaagaagtaaatatgcatttaacaccaatatgttgtattaatagagcctacttagagaatgaaaaaataagacatcaccagcatagctgtgtacaactctaggggacaccagccatgtagactcaaatcctgttttacaactacatcaagcaagacaggaaacaaaatatccagctcacatatgcctacttacgtgtgcatctttgcctgccacagagggctccagatctcaattgactatgcacttaaatttttacaaaataatcctacaattgctttaccatagatgactctgggtggacttacttgaataggaaaggtcaggtaaaatcctgaaatgaggaggtgctcatttttaaagctaaagatctgggagttgtgctaaatatacaaagcatggaaacatgcatggaaatagacatggcagaaagggaagcagtgtggaagagagtgacagagggatgaaagggggatgagggaagaggaaatgtagggtgtggccaggggcagatggacgaccaggctgatgaaagtcaggcttcagcatcctcacttgtgccagacccttctaagtatattcttttgtgcttaattttgtgtgtgtgtgtttttaagagtcctcctgttcccaaatggtataagcttgtctcaccgctcctgggttgcccctggtagtggaatgagagccctaaaagtaagatggcttactttaatttaatgcaaatgagtccatcttcagctttcatatcagagggcttctccaagatagggggtaacatgggggcagggccgaggattttgtttctgaactgggactagaacaaattcaaggagctcagattaaagagcaataggtaaatattttacaggtcagaggagcatggaatttactctgcccaacaggaaaattccactattctctactttactgattattttctttcttttaaatgcatgaatatctacattttccttattttaatttttttttacttttcataatgaaaggcttctaacatattcaaccagtaaaatatgatcagcaaaaatctctattatgtatctatatgcctgtaaagatgaataataagtaaagccacccatgtaaaacatatgtaacaaaggatctaggagccttttaattttctggacagctcaatgaaaagggaaataagattttgatgacatttaacttttagaaacatggtctttgtccttttaaaccatgaggttttggggggttgttttaaaaataataccttttcttcccttcacagttattttatatattttaagtaacatgttagtgttagaaaatatagaaacaataggtttaaaaagtaggaaatggagataatttataatctcataactcaagagatagacactactaacttttgggttttgccttgaatggaatctttctattatgtttctaactggtgaaatgatcagaacatctaaaatatggctcatgcctgtaatcccagcactttaggaggctgaggtgagtggatcatttgaggtcaggagtttgagaccagcctggccaacatggtgaaacctcatctctactaaaaatgcaaaaaaaaaaaaaaaaaaacaaaaaaaaaaacaacctaggcgtggtggcacatgcctcacatgcctgtaatcctagctacttgggaggctgaggcaggagaatcgcttgaacccaggaggcagaagttgcagtgggctgagatcacaccactgcactccagcctgggcaacagagtgagactctatctcaaaaaaaaaaaaaaaaaaaaaaaaaaaaaaaaatatatatatatatatatatatatatatatatatacacatgtatatatatatatatacatgtatatatatatacacacacatatatatgtgtgtatatatatacatatatgtgtgtgtatatatatacatatatatgtgtgtgtatatatatacacatatatatatggtattttataatctcagtttaaaaatggacagaatcaatgagaatgtatggatttttaagcattcatacttcttgggcctgttttccatctccagggtctgaaagaagtataaaaagctggcatcccacgtggatgagggggagcttctgttaacacctaacacctcctatgtgttaaacacattgccagctgctctgcatacttcatctcagctattcctcacaatgactgtgcatcttacagatgataaaacatgtcccccacatgttaggatcataaatgatccttagcctttccatcacaggaggaaggtaagaatccatataggaagttagggcttccttttgtaatctttccatttgttttggaagctatggagaaaaccattgtttttctcaagtaaaagtcagggataggacactagcctgccatatagaatgaagatatagagaaatctgctgaggatgtaacataaaagggaagctcttaaagagtcaagaagaaaaaccaaggaataataagatacacgtcttgaaattgtatggcttcaacctttgtcaatgcacaattccaaccagctagtaattgtatcattcctgtttttagagactgtgatgatgatgaggagactgaagacatgaacttctgaggacacattgaatgtgattgctgttgtcatcaatttggggtaagggttgacaccaggacctttcttctgacttattcatacccatctctcctttcttctctcctcttatccattaattctatcacccatcatcttgcatatgtatacaactctcatgaattctgacattgttctttgaatgtaatcttatgtcacttgaggcctccccaaccctttagacttgagattagacctcaaatctatttcatgctctgggggacctttcagactcctgccagtgatttccaagtcttacttccttgtactctctgacttcttcttgagtctatttggccctcttgactccattctgcatcattcctaatgcagtatttcactttatttccccttttcacaggaaatcccatcaccctcaacattttggatgcctactaactgtaccgaactttagaggttgtcataggggaagtgacttacccactgacttactcttacatactccttttcatctcaaagggcacagtcttttaccccatggagagtaatccagttttctccccagccctagctcactgcttttatacagatctggactgccagccagccagttttttcccaggctccccagaattctgacaaattaaagtttccctttcttgttgcactaaggcctataaggtagtttttattttccttataaagaaataaaagaaagaacacagaagttgtgagattattagcctatggaaaggtgatttcccactttatgctttgggttagttagctattttttgttctgtggacagggttatatccctggtcccgtgtaaacaccttgcaggtgcatcccattcatcacaagggggacaaaaggtgaacatatcattaaaccactatgatttcagcacaccttgtgaaaagccttctccaagcatgactgtggttagggagtagtcaatagtaagtcctccaacaggaagaatagctctttttctgttagaatgccagagtgtatgactccaagcacaactgcaaaccacctgttagtaaacctaatttatctgctcaaataatcctctgctccagggagttatatgaatatgagtaaaatgtaactagatgtaagttaacggagtgggggtgggggttgaaagcccgatgtccttaagacagagtatgttctgtctctctcttaacagtgatatttatcacactaaacagaaacatctaattttaaatcaaatttactagttatttcatatgataataaaacaaagcaacattgtaactccagcagcgatcaaaatcccctttatttccatgagaaaaatacaggtgcttgttttccactcaatgcatagtgtttttatttagacaatagtgtgagggagccacaactgccatggttttatttagtatagcttggcaccagctcctctttactctgatcaagccttttaattaaactgactactataattcctatggaaattagtgtttatgttattttcctgctacaaaagcatttctccagaacttattttttttaatcccaggagcataaattagaatttttttctgcttgatatgtaattaaaaactcatttgattacaatatttctggctctgttttacttattaaattcctgtaatcagttttcttttatgaagctgctgggaaatgatcttaaaagcaacacatttttttcttccctggcaggtacccaagcatttactaaattacattcatagcacctgcccatgattcgaatcattccaccaatttattccttaagccatttaagtttatttggcatagccccaaacagctttcttccctttatccttgctctttgttctccttcttgcttcctttgtatggaataaagaaattggggagggaggaggaatacatatttctcagaattcctttctctttgttttatattctcctgaaacacagaattgccatactagaatatcgttttcctgtggccaggtgctggttctaggcaaaggtaacaaaactcctatcttgaaaacttactttttctctctctcttttttttttttttgtgagaaggagtctcgctctgacgcccaggctggagtgcagtggggcgatctcggctcactccaagctccgcctccctggttcaagcgattctcttgctcagcttcccgagcagctcggactacaggcgcccgccaccacgcctggctaatttttttgtatttttagtagggacggggtttcaccgtgttagccagggtggtctccgtctcctgacctcgtgatccccccgcctccgcctcccaaagtgctgggattacaggcgtgagccaccgcgcccggccgacttattcttacactcttaatttgttacagaaatgcagttagctgagagaatatggaactattaaaatactagtaaagcaagggtttatccacgaacctaaattccaaggcttatggtgattatgtgtagtgagtcatcagcaagagaattgcttctagtatttaaaagtttcttatcaagtgatacgggatgggttctgtgagaatgctattgtctagtttgacttgctcctcagtgaaagagaaggggggaaacttagcacccatctgatcactctccatatacacacggaggaactctaaaggttatgtatgcggctgcatcagcctcaagacacctgactctcctctgtggcatccctgctgcgtgaccacacagctaccgttgaaaccctttcagaggcagtgcgtgcacaacctcccaggggagtccatttagtttttgattgttctgtttttaaaatgttgttcctttatgttggactgaaatctatacccctgtaacttctacctaatggttctaatccttagggtgctctttctttaaaccagaattttctttagtagtgtaggactgataactcaggttttgtttcaagtgtaggttagagttgatgctgacctaaaaaccctatttgggatgcagtgcttctcccttggggcaacctttttgacatcactggggccccatgttccttccagttccctcctggcccatcgcagacaggacctcggatacttgccccactatgggacacagcctgggcatctggtcatctaggtggccaagggaccccacttatttcctgatttcattcacactccactgttgagttctcttgtgaccagcatatacagtttattccgtattttatttatgttttgaataaggaacacattcacatagttccatggatacaaaacggtacaaaggtgcaatataaaatctccgttctactatttcccagacactcagtttcctcccctagaggcaacagatgttttcagtgtcttgagtagataatcaagaaaaattttctgaatgtgtaagaacataaatatatttgcccctttttacaaatggtagtacaccatacagagggatctgcactttgccttttattcttaatatatcttgggaaaaactcatatcactacaaaattagatttcctcattttttatggctatctagtattccactgctgtcaaaatttgtttaaccagttcctttttgatggaacccaaacattgtttatatttggccattacaaataatgctgtaatggatatccctgtacatagcctctccataggtgtgaagtttatcagagagtcaaattctagaatgggtattgctgggtgaaagggaatgtgtatttgcgttttggtagatattactgaatcaacaaatataattttacttaagatatatagcaggatttttataatagccatactaacaaaagagagggaacagaaaccatagctactgtttagattaaggccttggaaagatagtgtgagggtgggtagagctaagaaggatacacaaatctagaatttgatccctctcttctctgtatactccagatgctaatttctacacagtacacttggtatcactgaagcatcataatcatgttgtccagaaggttttgattttactccctctctgaaagaaactccccaaatggtacttgaatctactgaaatctcttacagcatatcaatcatttttgaccagttacaggtgttttcagtgtgtttcatggactcttactgtcattagcaaacttttactgaatgcttagttggagtcagactgtaataagtgcttaacactgtcatataattttctcaggaactttatgaaatggttactattattatcctctttatatatatataattaagaaaaaccaaggcctggatgaagaactcactcgtggtcattcacttggtaagtgaagaactgaaactgcagggtttctctacctcagtactattgatgttttgggttagataattctttatggtgggggctgtcttttgcattatagaatgctctagaagccagtagcatccctccccaaagttgtgaccaccaaaaatgtctccagatattgccagatgtcctctggggagcagcatcttcccagttaagaaccactgctctgctgcctctaagcattatctcgtctccatcaggtcttcaatgaactcagcttcccctcaaatagaaggaggaataaaagtaactagctacagtctgaaccccagcagcatctctggtagcagagaaggaaagacttcttcttgggccaaatacatactcttcctcacctcctttttctgaagacatttaggaaggagaaataagaggagtttctatatattgaatgttcactgtgctgggctagggccggggcctaaaggccattatctcataaaatctccacagcagtcccacgaagtaggtacttttatcatcttcactttatagataaggaaattgaggttcacttaggttaagtgccttgtccatggtcatataatgagagatggagccaggatgtttacctaagtctttctgactctaatgcattgtgtaaaaaattccttccctagagaactaatccttcgccactcagctcacattctgtcttctctgtgaagtcttctctggtcttctggtatggaaccagaactctccttccttaggcatgcctgtagcacactctccatctctccaattctatctatcgcactgaaaaggtatttgcatttttttgcagttcttcaaagatcctgttctggattgtgtttttgtctctttgtacttgtcttttttcccccttctgggtccttttaagccaagttttaaaagtgctggttttcagcaatttgattctcatgtgcattgctgtagtgtccttcatgtgtcttctgcttggcttcattgagaatcttggttctgtacatttatttccaccatcctgtcttcagctatgttttacatctgtcttttccctctgggactctaatcatacatatttagccattggcattgtctcacagctcaaatgatgctctgctcatttctcttccatcttttctatatcattttggatagtttctgttgcgtcactgagtttttcttttgcagggcttaatctgctatggatctcatctactatacatatatatatatacatatatacatatatacacatacatatatacatatatacatatatacacatacatatatacgtatatatatacacgtgtatatatatatatatatattttttttttttttttttttgagatggagtctcgctctgtcacccaggctggagtgcagtggcgcgatctccgctcactgcaagctccgcctcccaggttcacgccattctcctgcctcagcctcctgagtagctggaactacaggtgcccgccaccgtgcccggctaattttttgtgtttttagtagagacagggtttcaccgtgttagccaggatggtctcgatctcctgaccttgtgatccacctgcctcgccctcccaaagtgctgggattataggcgtgagccaccgcgcccagcctactatattttttttacctcaaaaattagcgttttcttttctagaagtttgatttgggtctttttaatatcttccatgaccccttaatcatgctcaatctttcctctaccctctgaaatatctaagtataataactatcttaatgtctttttctaccaagtctatgatctatataatctctgaatttgtattgattgatttttctaattattatgggtcagatgtttttgcttctttgcatgcttgataattcttgatgaatatcagacattgtaaagtttatattgttgggtgatggattttttttcctttgctttaagccttcttcagttttgttctggaatatagtcaggttatttggaaataattcaatccctttgaggcttgcttttcagctgcgcaagctgggtccaaagcagcctttttttttgtggagggctaatttgctcccactactgatgcaatacccttctgagaactgcatccaatgcctcatgtatttcaaggcttttcttgggtactctagctggcaggagcatggactattttccccaggctgtgtgacctctgtggatcactttacttgctcctttttgcttcagcctcagtagtttcctcacatggatatgatgaacatcactaacctgaagactcaaagtggccctctgcagatctctgggctttttctgtgcagtcctctcttctctcttactcttccctgggaactgtaacctctttggcctccctagactcctagctctgcctccttaactcagcaagatcactgggctctgcctggattccccctgcctgtgccgtggcctagaaattctatccaggccacaagctggaacagttgtaggactcacttcattcattccccttactcaggaaccactgtattatgttgtctgttgcccattgtctgaaaagtgttgtttcatatatttttcaggttttggggttttgttgttgttgttgttttgttttgttttggcccgttactcaaccatggctagtagtagaggtcccttatcactggttttaaaaactctgtcttgcttagtatcccacaagctcagagagacagtggaaacaaggccttttatctttgtatcttcaacatctggcacagtgaccccaggaagcagcagcctctcctccattcttccccatagaacagtggcaggaagaagggttaaggctaggacagctgccagtggctgagagtggggttaggatgttctgacctgctacaaaatcctgctgtaaaaacacatctagaatgagccacttgggaaatggatatattttctcttattaccattattcctgggcctttgtttttatcagtttgccaacctgctaggagccagatcctggcctttgtgtttctctgccatcgtggtccacatctgttatcatctggctcagtttgtgcttattagttgaccacagttacctcttggaacccagctgctggatagatagggcagatgtgggacaagggaggagcagagagaagtcatgctcttagaaaatgtgagtactcctatactctgttgttggaaaggggcatagaggaaccccatcaaattaaaaccagattagtgtttgaacctgaaaatgtccaacggtgtcattaatatattttttaaaactttgaggaaattgtctgactattcatttattaagaaaaaaagacatttattaagaaaaaaaaggacaaagagagaagatggttttggccccctattgttgaaatctatttccagagttgctagtgacatcacttagtattttttgccttctctcacccccaccttacccaagagaatcagaaactaagtgacacaatataccatagaggagaaagaacttagagtattttttaatgttgatttttaaaactataaagttagacttggaacttatcttacgtatctgtttgaggcagcgtattcctgttatgaggtcatgatcactttactaccatgattattccctttctggaggaaaatatcaaaaaaatcattggaagttggtattttgaaatggaaaaccactgatgatatgaccaactgttatcatctctgctcagattcttcagcaggagggacaagagaacatgcaaatggtggcaggccctgaaattctcatgaattcgtgtgcctgtccagcagttacagatgcaaagagcatcttcaagaaacagcttcctgttcaaggtgtatgacttcagagacaggtagccaattgtgggagcagagcctaagttataaattagtgaattgttgaactgctaatccctcttaggtccaaaggttaagattattcatgatttaatctgagatactcccagattttacatgccacacctcagtgctgcagttggctggaaatcactttggctttccagccttctacttttttatgggttgtagaggccagaaactcagtggacggactgtttacaactgaattcctcaccttccctcaagccttcctcttacgtttactctgtcagggaactgggcattatcatctatctagctgtcctacccagaaatccatgggtcatccatgacatcttcctcttccccttacatccaatctgtcacaaaagtcctgtcaatcccacttccaaagtttctttgaacatgattctgttgccatttccacaaccctggtttaggctaccatcatccccctgactgttttaaatctgctgcagcctcctaaccagtctcccagccttcctctgccactgtccaatcggtactccatatggaagccaccatggagcagtcaatcagaaacagaaacctgagcttgccattcacttctctgagactttcagtggctcctatttgatatgaatatgctcatcatcgcaagtccaaatccctcaatgtggcctataagaccctatcagaaaagagtattgtggtagtaagagagaatgaaatccagaaacaaaacaaaacagaaacaaaaccataaagactgatggaaaacttgggttatggtacaaaaacagaactttgaaatgccaaaataatcccactaagttttctagaaatcctgaagtacacatctttatatgcattttcacgttttactgagtcaaaaaaaaaaaaaaagctagactccacatggtgcgtttggcaggagagagctaaaatgttagttactatatgtgagagcagatggagctggctgtggagtccagatgggaggcagcaaacagactcctcctaaacctcactccttccctccccagttcaatggcttttgaaactcaaggttgtgtaaaaattaatttgtattaaattgcttaagataatgtattaactaccatagaaggcttccagcagtttttaaaacttgctttgaaaaacaaataatcaacctataatggtgaacacagaaggaagcccagacttccttggctgtttttaagcattcacattaaagataccagccttaaaaacatatcttttttgtgttatttgcagaagttggaaaattaataataattatttatgtaggttacacatgtaactgtgtaagacactgtggtatatttgtgcttcatatagtttatctcattaaattctcaaaactaccaggtatgtgcattatcaacccgttttagagaggagaaaatcaggctcagaaaggctacataatttgcctggggccacagagccagggtttggtcccaggtctctgactccagagcccaagttagtaaccacctaccatatgtgtaatgctggcatgtgagtttgaataggtcagcctgctggttagaattatgaatgaaaagtgcatttctagataggaattgcctgtttatcttcaggaatatctcattagctaataaatgttttccttaacagactcaagtgctgctgtggtctcagacatgttcatatgacataggtctatggaggtcaagattggtcagaaggcaagtaagaggcagagtcaccctggaaaagagtgaacagggttcaaggttacctacatacaaggctgaagtttggcaacacgaccaagggtgaaataataagaaaagacttaggcagaggcaaggacttaaatagctgattcagtgggttcataacagctgagttcttctcagactagaaaacaatggagtttaaagggctctagctttataattcctgccctgtttaaggacatggtcatttattctgccagaactgtggtatccctagcagagtttgttagttgcctacccaatacacgttttaatttaccttgagcttaggagtggccagggagatgtaagcagaattcataaaggctcagagaaaactctttaaatggggcttattctgctgggaggtgcattctcttgctcttgtccctatctgtttcttgctgttggaatattgatatggtttggctgtctccccaaccaaatcacatcttggattgtaactcccacaattgtaacctccgcctaggttttagacgtgacatgtcatgggaggaacccagtgggaggcaattaaattatgggggcaggtctttcccatgctattctcgtgatagtgaataagtctcacgagatctgatagttttcaaaatgggagtttccctgtacaagctctctctctttgcctgctgccatccatgtaagatgtgacttcctcctccttgtcttccaccatgactgtgaggcctccccagccgcatggaactgtaagtcccttaaacctctctttcttttgtaaatcacccagtcttgggtatgtctttatcagcagtgtgaaaacggaccaatacagtaaattggtaccagtagagtggggcattgctgaaaagacacccgaatatgtggaagcaactttggaactgggtaacaggcagattttggaacaatttggagggctcagaagaagataggaaaatgtgggaaagtttggaactccctaaaggcttgttgagtggctctgaccaaaatgctgataatgatatggacaatgaaatccaggctgaggtggtctcagatggagatgaggaacttgttgggaagtggagcaatggtgactcttgttatgttttagcaaagagactggcagcattttgtccctgccctagagatttgtggaactttgaacttgagagagatgattaagggtacctggcggaagaaatttctaagcagcaaagcattctagaggtgacttggctgctgttaaagggcatatgaaacacagcataaaagtttggaaaatttgtaggctgacaatgcaatagaaaagaaaatatcattttctgaggagaaattcaagccagctgcagaaacttgcataagtaatgaggagctgaaagttaatccccaagacaatggggaaaatgtctccaggccatgtcagtggtcttcaaagcagcccctcccatcacaggcccagagtcctaggaagaaaaaatggcttcgtgggccaagcccagtgtccccctgctgtgtgcagtctaggacttggtgccctgcatcccagccactctagccatggctaaaaggggccaaggtacagcttggacagtggcttcagagggtgcaagccccaaaccttggcagctttcatgtggtattgagcttgcaagtccacagaagtcaagaattgaggtttgggaatctctgcctaggttttagaggatgtacggaaatgcctgtatatccagaaggaagtcttctgcaggggtggggccctcatggagaacctctgctagggcagtgtgggagggaatgtgggggggagcccccacacagagtccccacctgggcattgcctagtggagctgtgagaagatggccaccatcctccagaccccagaatggtagatccactgacagcttgcattgtgcacccggaaaagctgcagattctcaatgccagcccatgaaaatagctgggagggaggctgtaccctacaaagccacaggggcagagcttcccaagaccacaggaacctacctcttgcattagcataacctggatgctaaaactcttgttttaacacggagtcaaaggagataatttcggaacttgaagatttgactgccccactggatttcagacttgcatggggcctttagcccctttgttttggccaatttctcccatttggaatgggtgtatttatcaaatgcctatactcccattttatctaggaagtaactaacttgcttttgattttactggctcataggcagaagggatttgccttatctcagatgagactttggactgtgaacttttgagttaatgctgaaatgagctaaggctttgggggaccgttgggaaaacatgattggttttgaaatgtggggacatgagatttgggtggggccagtggtggaatgatacagtttgggtgtgtccccaccaaaatctcatcttgaattgtaactcccacaactcccacatgtcgtaggaggaacccagtgggaggtgattgaattatgtgggcaggtctttcccatgctgttctcataatattgaataagtcttagaaagtctgacagttttaaaaatgtgagtttccctgcacaagctctccctctttgcctgctgccatccatgtaaaatgtgatgctccaccttgccttccaccatgattgtgaggcttccccagcaacgtggaactgtaagtccattaaacctttctttcttttgtaaatcaaccagtcttgggtatgtctttattagcagtgtgaaaacggactaatacaaatatgcacatgatagttggaaccagagtggccatcttgtgactatgaggcaaacttgactacggcagccatgtgctaaggaaagataaaggagaactaggtttctttatctttttctttctttttttgtttttacatagagtctcactctgtcacccaggctggagtgcagtggcacaaacttggctcactgcaacctccacctcctgggttcaagtgattctcttgcctcagcctctctagtagctggaatttcaggtgtgtgtcaccaggcctggttagtttttgtatatatataatctttttagtagagacggggtttcaccacgttggccaggctggccatgaactcctgacctgaagtgatccaccactttggcttcccaaagtgctgggattacaggcatgagcaaccatgcctggccaagaactaggtttctgatggctatggaactgccatataatagcagtatagcattggcttttctagattatttttattttttactaggagctaaatataattcctaaatgagaaaattgatttcatattgtaggtctctattttctgactatctgtgcaggtggcacagtgttttgggcatcttgatactcaaagataatgcttagtatgaaggcatattagctcattagaatccaacacaagaataattcagatttgcagttggaatattaagggcatagtctacccaagttataacaaaagatgatgtttgtagcatcaatgtctaatatcctgtaagctaattatactattagtaataagttaggaagagaccattttttccccaagatttgaagcagattagtcgtgcatgtaaaagtgaaaatgcaacaatgcattacagcagttttatctccttctttcttttctctttccagttccttcctgacctctcaagttacttgttttgcttatttatatgcacaagagattcttttgtggaaaataatattcacaaatgacattaacattctgaattaatgaggcaggaatgttagtctttttggattaactgcattgttatttccataatatagggcaagagtctgaaactaaaatgtttacagggccaggccactaaagttaatgactgaaataggctgcatgatagagttgggagtggtggggactatggcaaactggacattttacaattttaaaaactgtattcaactgaatgaaacaagtctgtgagctgaatctattctgtgggccacctgtttgcttgctgtgatagaaagtaaagcacatcttgctaacatgaattaactactgagtattcatgtgccctatgttccaggagccatacttggagttcttcatatgtgacctgattacaactcagaatggtgctgtgagatagctattattggctctgttttggcagatatggaacctggaattggaaaaactaagttaaagagccaaagtttacatggttaagtacacagcagagctgaaatgtcagtccaggcttggctgagtaccaggctcatggtgtctttacatcaggggtctcaactggcacactagtaacaatgggtatctcacaccttactgcagtgttgaggacaatggtgcaactttttttgttctatgtctctgatgctggttcagaacagattcacaggaaagtggaggtcttgctgagtaaagaagaaacaccacttcccaaacgttagatgtagtctgtgcatcttttatctttgactcatctactctaccctgccctgggaaaataaaacaagagttctaagttgtaaaggacaggcaagcctaaagacagctcatgtaaatgggagcaagaacagtttcttgtgttataatgagcccctccagaatgctgtccttggttatcctgttagttggattttcagagcagactggtagctaatcaatcatgttcattgtgtaggcaacttctgacttggaaggaatggctgctgacccagaagccacagcctttgatgaatggggcttcttacaagaggtggttggaacatgtaactaaaaagcagtcacgtggtaataatccattttccatatactggaatgttttctgctaataccatcacctgaaatttcatagaaatatataaaactattattttttcaaagttcaatgtgtaaaaaggatcacttaaaacttttagtttgttgagctgcaaacattcattcactgtacattttttgtatatttcccacatgcctcaagttctaggatttcctaaaataatggatagggtgtctgtgtgggaatgggtttacaaatacagaattgccaatatctgtccttggtgtgaatggtgctcggtgtaagtcactataggacctcaaagaatgtattctagaatattctattagcattggttctaaatttttagcttatatttgagggtgccaaaagagtcccaaaagagagtcctaactatacacactactgaactgcttagtgtgcaccatgcaaatatgatgactactgagcatttcttgcaagagtttaaaggtggcttcctgcctagcaccagacatgcttagttctgagacggggaggaaccatcaagtccatgaatcccaatgtcccggatctacagaggaccagacccaaagcatcgaggagaaatgctttgtctttaggtaaagatccttgggggataaaaatcctttattatgttggtggtctctctccctatggcaagggaaacttctttttcttaattttacagcctgataaagacagtgggccaacctcagtagctcatgcctgatctttggggggctgaggtgggaggatcgcttgagaccaggagttcgagaccagcctggacaacacattgaaaccctgtctctacagaaaaatttaaaaattagcttggtgtggtggtgtgcacctgcaatcctagctactcaggaggctgaggcaggaggatttattgaactcaggagttcaaggtcacagtgagctatgatagcaccactgtactctagcctgggtgacagagtgagaccctgtctccaaaaaagagtgacaattttgagataataaaaagatagaaagggaatatgttacatataccactaggtatatgtctgaggaggatattgtatcattagctggccttctctttgtcctagaaaggggccagtctgtctactggaagacccggtagaaggtatgttattgtggctcttctttaactacattgctaactccccaaaagccaaagatatgggaaaagtttgtttgtgtaggcacagagggaccaatattttcagtagttttatttcatttttagagtgcagtttaagagggaatataataactttataaattaaacttcctaatgggcaacattttctatcttttaaatgttggaaagtttcatattaatttaactctcgaacattcaccatgtaaaattaaataagcagccagtaaaaagacaaaccagatttccttttgaactaaattttaaagcttatgtgaaaaaataagaatacctagaaaatattgaaaaagaataataaggaaggtgaaactaggattatgagacattaaaatatattataaagtgatattaattaaaatagtataactaggcagatagatcagtagaactgatagaaagactaaaaatagaaacaaagttaagggaatcagtatatgataacagtgaccattcaaataataaggaaagagttcagtcaaaaactgatgtgaagaaaactaggtaagataaataacaaacttggaaacatatttgtcacctttgcaaataataagggtttatttctttaatagatagtgagctcctatggatcagtaagaaaatagccctagttcaatagaaaaataggcaaaaatataaagcatttacagaagaaatacaaatggcttctaagtaaataaatctatactaaaaatatgatcatacttatttataatatggaaaatgctaattgaaactataatgagatagattttatagctatcgtattagcaaaattgaaatttggtaatacattgtgttggtaagggcatagagaaataggcatctcagacattactgataggaatgtaaattggttcaaactccacagagagaaatttggtgatatctatcacgatctcaaatgcttatatgccaaatgcccagttatcttatttcttggtatttctcctaaaaataaagtatgaaaattgtgtatttacaagaatatttattgcacattgtttacaacagcaaacaattagacacaacatcaatgtccataaataaataattaattgttgtttaaataatttatttttcatctttaaaatctaatactatgcagccatcaaaaagaatgagacatcttctgcatggagactgaaaaagaataatctaaaaaataaattaagtgtaaagaagcaagatatggagcaggatatacactatgctcatatatgttcatagatacatatgcacttacacatagatacatatgtgtgagcatagtatatatagatgcatgcatatgcactatatttacatagaaaacaatgtagaagcattatgtattaaaaacagtgtaaaaacacactgtatataaactatctttagaagcatacgcaggaattggttaacagtggttgccccagtgaaaggaactgggtgacttgcaaaaaggagtatgagggaggatctcttttctctgataatttgtgccttttgtactttgtgaattgtgttcactgagggtgtctaaactatttagcaataaaaaatttaaaagtctatcatgaacagataaaggaaatagcaatctttggtcatgtgttagaaatattaaatcacctgattggttaattgttaaaaaaggcttacaagtacaggggcacaaagtagaaatgcttatttccacaaagatcaaaaaaatttagtgctttaccaccataattcaaaaataattttaataccttaatgtatgttgcaataacatcgtatataaataaacacctccctcctcccactcccccatccatatcacaaataaaggctgactacctcattgctcctcagcatttcctctgaaaagcgatcgatgtctcctgcctggccattaaatagattttgaaaaactcttcaatccctatcagtctcatatccttatttagttcctcaaatttgccctcagctgggaattctgcaggcaactgtgattctgttgtgttcaccactcatttgaagggtcccatccatcatcatttctagtccttttctgatgcaatgtagcttgttatttgtctttcttataaactgaatggctgttaaattatccatttatcttccttcagattttctgttcagtttctcaggccctatcagggctgtcttttctaccttgtttgctgacttttcattccattgcccctgttcttggaggcatcttggttcaccatgctgcccttcaaaacaaactctctggttcagtctgctttttgcttgtttgaaagcaagcagaacttgctacttcagtagatttccttttaaaatttttttccttagaatagttttgaaaactttgaggtaatatatttcaaattttatacatagatagtaggatatattggaacaaaccttaaacaaaaagtccaaagtctagggttctaaacccagctctgccattatcaagtcaggtcacttaatagtgacctttcagggttttgctttcccctcctacagatggtctgcaggtatgcacctagttaattattctagtataaaaatagcatgtttcttctgttaaaggtgacccaataaatgatctgaggtttgtataatactaacacctgcacatacattatctcaggcagcactaggtcatactggttaggagtcacagatttgaaagcagaaagaatctatgccctgtcacttactatatattcttaggtaagttacagaagctctatagcttcagttttcacatctgaaataaaaagatcctcatagcatctaacttggtattgtgaagagaattaaatcagatcatgcttggaaagttagtcttgagcacatactaagtgctcaaaagtgttgttatggactcactacatctttgtgagacaggaagcttggctattattatccaaatttacagcagagatactgaggttgagagatgatattaatgataacaatagtgactcacatgctggagggctttaactataataggtgtactcttcccaaagcttttccacatacttcacctccctttgttcagactcttggaaaggttgatattgcctatcatcaattccatttgctccaagaagaaagtcactttgtgaggcccaaaacctttaaaaagtgcagagtgaagctgctttcagccaaacctacgagccagtggtgatcaccataaaaagaaagctgaggatggcgagtcctcagtttatgagtgtagagggcaggtttgaaagaggacagttagaaaaacactcagcccttactgcctcctcttaggccctcttcttaggtctttttttttctccctcctgctgtctctctttctgtatgtctctgtttctctatttctcttttcttctttagatttttcagctgttcagatcacctgtaacactaaaacctaaattcgatgatgatatattgaatcaaagacttggagaataatttgtccttttttgttattttatggttctgtagctcatccctctgcttgtaggagttattggttcagatgctgaaactcccctaattcactggggcgattgtgagcagcaagtataccctccctagtttctcatccgtgaaataaaggcaggaatgttaacaccgccacagggcaattcaagagtgataggttatttcagggcatcctgaaagcataagatgctgaggaaatgcaagcgcttactagtaacaatgtgataacccgatctttcccgttcctgtcactctcttgcgcttgctttgttgctgaggcagccctgtggggtctcccagtggctgataacaacacacacacactgctgctgcagcttggatgagggaagaggttggtagattcagctgtgctgggcatcctggctgagtaacagagacagtgaatgtaaacaattaagatgttctaataaaggaacccaaagagggtcccagaggctagaatatctacctcctgggggcaaacagaggtttcctaagaacatgtcatctgagcagagtcctcaagtaagactaggagttgcatggggagaggaggggaaggtaggcctgcagacggctaggtgagcacaggcacggggtgtggaacatttagcttatggcaagagcagagggtacaaaggaaggagagagaggaggtgggatgggaaggtcaattgtgccaactaagatttttttcctgtagtaagggggagggagggcctgaaggactttaaacaggtgagccatgcaatcagctgtgctttgggaggatagctctggtggtgacatggagccttgaggatgggactatacgcatgagactgggatcagagtggaggcagctggcaaggaggcagtcaggagaccctactaatatagggaatccaaatgaaggagaaaaatcatgatggcacagctagaaactaatagagaagaaaaaataccccaggcattttggccttgttttacaacatatttcttagctttttgatggcaatggaagcttttttgaagttgtcttttgtttcctgcctttactgtatgctctgaattcccttctctttcatgctttttggtttgcatctattctttcatattggaggctttgctcaaacattctgtggaccttatctgtttgcatatatttaaatgcaaggcactgaaagacaaaagacctattcaaggcagagtacaaagtggaccagggcaggtaagtgggagagctgtgattgtcaaatggtggctccattttaagggcatcctgcagggaattggttcatcgagagaatatgaagtgcaagtccatgcagatcttttctctgaggctgttctgtttccctagagaagattcccacttttctgcttctggggatatctggctgctggcactccaggtgcagagtcgtagggcatctgagagtccagcaaatcattccatgggctttagatttcagccatggattctctccatgagtgctctgagagaactctccagtctcctgacttggcagtggctacacaggctgttgacctggctgtgtgggttgtgggagattcctgagatcccatttaccaacttctaacctttctttccctcttgtttccaggctgatttctcaacctctctgtcgtgagttgactcgtgtactcccaaaagctatgttgaagttctaaccccggtacctgtgaatgtggccatgtttggaaatagggtctttgcagatgttagttatcaaggtaaggtgagatcatattggattagaatgggccctaaatccaatggtttgtgtctttataagaaggtcatgtgaaaacacagacacaaaagaacgttatgtgaaggcagaggcagaggatgtcaagaactgctagcagccatcagcaacgaggagagatgcatggaacggactctccctcagagccttcacaaggaaccacccctgctgacacctgaattctagcttctagaactgtgagcaaatacatttctgttattttaagccacccagtttgctgtactttgttacagcagccctcggaaactaacatatccacccttggctgttcctaactcctgagcctctcaggcattccttctgaaaggcagatcggctggctccctgttgctctccccttgtgcagacattctgggagattacttccttcttagcttccaatatttgaggatagcttatctccacttattttctgtttccttcagagtgtatatctttctttgaaaaaaagaaatgcaactttattatttctaatcatgcttaatactattaaataagtcaataaaatgaggcaccaaagtgctcatttcagaattatctctattaggaaaaaagtgtgggacaattaaataaattacaacaagtcaattgatcggaatactaggctgccatttcaaaggataatgtgaaagttggatgcggtggctcatgcctgtaatcccagcactttgggaggccaaggtgggcagatcactttagctcaggggttggagaccagcttgggcaatgtggtgaaaccttgtctctatgaaaatacagaaaaattagtcaggtgtggtggcgtgtgcctatagtcccagctactcaggaggctgaggtgggaggattgcttgtgcctgggaggcagaggttgcagtgggccgagattgcaccactgcacttcagcctgggtaacagtgagactctgtctcataaagaaagaaagaaaaaaggacaatgtaaaaattatgtagaaacatggaaacatattaagaactttatgttgtgaccaaagcagaatacactcatgtaccctggtaaaaatgtgtttggatgtggacagtagtatgaaggggtatcaggaataagagaatgtgaggttcttatttctcccaacagtcactcttgacaatttaggtattctctaaggtgatgtatattttctttactgttctcatttgcttttgatacctcaacagcagagtttttaacattcacatatatttctccttttttccttcctccctcctttcctcccacccttcctgcttctttcctacttcttccgaagagagacgaagaagagaggctcatgaagaaaaggcaaataagcttttaaaatatgctctctaaaaaaactataaagttacttaagggaagagaacattccaagccttgtaaggacttggggttaagacatttagcttcattattccaaagcagaaatcctttaaaaaagagttacgtatgttggtcagctggataagaagaatttaagataagaattaagatcttatcttaaatctgtcctcaaaaaccttattgtgggtatatcctatttttttccattggattccagcattttaatatggattcatggcactgtttgagctcataaaatacatatgaataggaatatattaatactaacatacaaagaatgggtatttttttcaaagttttatgaaataaaacaaattatagtccattttatttaccaaaaaatatgcatagagatggttgtttatcaggtcaaaagactttttggaggtgaaaaacatcaggtatgctggaagaactctgagatgtagcgaagggtatgagatgccttcacctgccaattatcatgcataatgttggaaggaacaggaactaatccattcttctattaatgagtcctcactgctactcagaacttcttcctgcccagcacgttcttttttacttttcctttctttcttttttttaaagagatggggtcttgctctgtcacccaggctggagtgcagtgttgcaatcatagctcacttcagcctcgaactcctgggctcaagcaatcctcccaccacagactcccaagtagctgagactacaggtacacaccaccatgcctggctaagaacagagcatattcttagttgatgtttgtactgattacttttagacactacaggatcctaaaagttttctaagtcaaagaaagattaaattttaatcatgataaatttagtgtattttattgtattataatttctcgaaatcatatgtatgcaatatacaatatacatttcttgaaatctatctgtgacatatgctagctccatctcttaacctgaatattaaaataactagaggactacattttctggcaatgctggataaaagaaaatttaatgtatttcctagctgaaaaagtcaaagctctgaattcatggctattaactggccctttacagtagaattcaactatgatgagaactaaaccactttataaaaagatatcataggccatatactccagattatgggcaggaatataacagtgcatactctgatgaaaggttttatacatagtcatgcaccttataatggcatttcagtccatgatggaccatatctacaaccatggccccataagattataatatcatatttctactgtaccttttctatatgtttagatgcacaaatatttaccattgtgatacaattgcttacagtattcagtgcagtaaaatgctgtacaggtttgtagcctgggagcaataggctatcccatatagcctaggtgtgtattaggctgtacaatataggtttgtgtaagtacactctacgatgtttgcatgacgaaattgtcaaagatgcatttctcagaatgtatccctgttgttaagcaacacatgactgtatttataggtgataactaaatgacattataagcttacttcatacattccactgcttatactgcatcccatcattcacttttctgtttcttcattcctttgttcaacaaacattggctgagcagctctaatgtgctagcactgtgctaggtgccaggaatatggtggctccaggaaacccgtctaatggggaagagacagaaagataatcacatacagagtgtgtggttataaagagatggagacagtgctgtggaatgttgtggggaagtagaggttttacagaagtcacagcttgggctggtgtcttccaggcacatatgagagcgaggaggcataggcagaggccagggaagatggaccaaagggctagtgagtcctgagcttgggcaaagggtgtctggtaaggaagtgggcagggtgaaaggagatgaggccaaggaatagatgtgagcttcagaatgaatgagggggtttccgaatgctataccgaggacttcggaaggtaccttatagatggtgatagtaacctgaggtctttaaagcagggagatgctgtgatcagatttctttttaaaaaaacatcattttgtcaaaaatttggaagatagactgtagtggaggggcctataaattacataaaaccaacacttttgaatattaatgtttctcttccattcatatttgactaataacacatagaatattttctgagataaacaggctttactatctatcagcactcagatttgggtacattattatgtaacaaggacaatattttgagaatggtaaaccagtgcattttccattctgtttgaatggtgatgcctggggctcctctcccgtcatctcagtaggcttccctccttcaggcaaatggcggttcccagctagaaacaagctgccatcattcagctttgaaaaagaatagccctacttgtagctttgcaaggtgaagtggctttctacatttcagaactctcctttctctattaagaaccaaacctggctaagttagatcttcaagttttactacaaagctctagcaggaagaacacagaggagaccatgtaaggatagttcccatcaggaaaagcaaagcaaatggaaatattaggggaagagggggagtggggagaggggcagggagagagaagagaggagaaagagagaggggagagaaagcagaaagaggcgggtgagagagagggagagtagtcctggcttcacattccttgggggtcaaacctttaaggggagggcttttatttcaaatttcagagcctaattcaggaaaataatagaatcttcctaaagcaagttggtatcgcccaggcagcatattagaaaagacttaggaagttatgtggacagcagggtgaagagaaagtagctgggagttcatgggtgccccagggggactgaggaaatgccaagagaaccaatcagctagaactggccaggaagctgctgggggtggtgaagggggcttgccaagaggctgccacaaggaccacagacttaagtagccagagctggtggccagggctggcacaaagtactcatcacacccacaccatagtcacacggggctggcacagcatcacagccagagttgcgaccagccacctctcagttaacccagaaagacccaacaggcaagatgtgtaccaggggtccttctcttgaaggtcacaaaatcatcacaaccataggtgagttccctggtacctagatgtcagctggggaggagaaagagctctgattaggagtactttaaccagaagagattgagatactttaatagtcaagtttaaataatagtccctgaatgcagccaccaccctactccccatcaccaggaaaaagtggagccagatagatcagttatagagaaaataagaagttgttttccttcctttcttccttccttgcttctgtctttccttctctcctccccttccctcctctgcctctcctcccttcccctctcctctcctcttcttttttccctccctctctctctccttccctacattcctcccttcctccctccttctttcttcctgtattttttgagttatgtatgatgccattccatatatataccccctttgtaaggacaagtaagaaactagacccaactatctcttcctttcatccacaagaatactaaaagtcatagagaaacacttataggaaactaactgatttgagtggtgtctttttttttttttttaatatctgatgaagttgtttttagggaacactggattgcttttaaagtactttcatcagtatccagagaaagtgtcctggagtagcaccttatatcctcttttctagtttgtcagtttctaactcccattctactatttcaactatattttaaagttttttctcccttttttccagagaacctattaatattgcatcatgtggaatgtatttttcaaaatgaccattaaaagtgaaggcagaggctgggcatggtggctcacacctataatcccagcactttgggaggctgaggcctgtggatcacttgaggtcaggagttcaagaccagcctggccaacatggtgaaaccccatctctacgaaaaatacaaaaaaattagccaggtgtggtggtgcatgcctgtaatctctgctactcaggaggctaaggcaggagaatcgcttgaacctgggaggtggaagttgcagtgaggcgagatcaagccattgcactccagcctgggcaacaagagcaaaattctatctcagggggaaaaaaaaaaaaaaaaaaaaagtgaaggcagagaaaaaaatcaaagtttactgtaaatcttaacattagcagccctgcctgcttcagaaacctcatgacattttaatagagaggcactacccttaccaaaattttcctactcttaatggaaagagaaaattattctggctagatgctggccaggtcacatccttttgcattatctgtgagaaaatatccactccaaaatcaaaagccagtttgggatgagctaaaaatcagattacattcataataaaaatggaatctctcagttcttaacaaacaaaagatttataatgactctgcaccactgacattctaggtacactgagatttggttaagttgagaatgaaaataaggagccagaacttagcttgctattgcagacaaaagctcaaaatgatactgtgacatgagggtttctgtttatccctaaggctggtgtggcaatttcaaagtttgattgtgtctttttttcttccttcttcttctttttttttttccccctccaaagacgttgagcagcagggctaatggatccccagcagggtgcaaagacagcagaaagtgcaggaatcagatgtcaatgtattccttcgagataccctgctaggacacagctaactaaccagggcttgagtcttctcttggggaatgtgctttgatggttccctgcccactcttggcttcctgattaaaaggctgtcacccataaatcacgacttcatcctgttacaatcattttctttctttctttctttctttctttctttctttctttctttctttctttctttctttctttctttctctctctctctctttctttctttctttctttcattccttctctctctttctttcttctctctctctctctccttctctgtctctctctctttaaggaaaagtctgaagattaaaaagagagcaagttccagagaactctatgctcacatataaacatatggatataagcctggcctacatccttattagatagctattcatcgatttgggactgttctgtgcatgtgtcctacccacctggcatgttgggagagctaaatcaataccacaatgacatgctgtctttctccacttgagatagaaccagtcagcctctctcgttgacaatatatatggtaaagagggcctgcacatcgtttttttctgttttatttaaatatttttatatattttctgtctgtcgctttctgtcaatctcaagattacttagataacttcctagtgaatagattttggaggaggaggagttcctcattgttttccctcaatgtagtaaaaaattgagtggaacttgaagctatcagagataagagtttcgattttaaatgcactgggcatccaaaatataccggtgcaggtgccaattaggcacataaataagtagcccttcaggcactgagagtagtgataatcttcccctttgcttggagaagagctaaactcagcaaacaggaacacaaacagaaagtgctttatctatttgatatttgacaagcacaacccttttaaaaccatgaagtaaaactgaactacccagtgaaagtcaatgaagtcaaaaagctgtaccaaaaccatatgcatatgtactgcccagcagcctggccacccgcccctgccaaactcgctgttctgtcccactgctgtactcaagagcctccagccgtggggtgccctgggtcaactcccaccctctgtagactccaactctccaacctcctccacctgcaggaagatcccagctctctctatgagagtgcttgccttgggctctacatgaaggttcttgccacccaaccttgccctaccttggggtcaggccttagctgttagaggggacatgctttgtctcatgtgtactcctcggtattcttttgccatatgcctagaccaacatggtaaagcaaagctgaattcttatgctgtatttcagaccaatcacatcagggattcctgccacctgcacacttcccacttgccttcgatcctctcagactccttatgattgcatttttatgttcaaaaccccaaacttgactttcactgagttatctcagtgaatggtgtcacatcagtgaccttcctggctcgtcacttcctcaaggtgttgtgtcttcctacaaatggtgattcctgcccactgactgattcaatttcatttcggaagcaccaacagttaatgtgagattatccagttaaatagtggagggaagggagaacactgcatgagatcaaataaaataaaataggaccctcagagaggatacttaaactcaccctacaaagtttcagttgagggctcttaaaatgattggtttcaaagccttgtataaaacttacaaatgaaataatgagatctttttttacttagtgatgacaaggaatcaaaaagagcaagattttcaccccctgttaaatgaaaagatacagcagcaagtatgaatatgagcttctgtaaatagctccttccatattccctttcagcatgacacatctctccccagttagttaaataataaaaaaatggtgcaagaaatttccatcagaggtgaagtagggcattagaaaggtcactacaccaaaacaaaggtcaggggtgagcaggacacaactctaatttggtgggagcatcacttaatctttctatatgttaatttcctgaagctgaaaatagcagatgtatctaaccgacagataagtagtaaagtaaaacagatgtgaaaaatcaggacgatatataatgtgaagggataatattactccctaaattctagaaactgctatttccacttaaattcaagtaacttcctttgtaacctaaagatttcaaagcatttaataggaagcataagataagccctaaaggattgtcaatcagtaataaaacaaattaacatggaaaaccatatgaggatcctttacagcctttcctataaccaacacataggaagagtgtgtagactttgagttcactccaaaatagctttgcaaactagtaccaaaacttaatcagcttcccaccccaatacatatcttcatcctcctaagctttacccaaagtaaaaggaatgtagtaattgcatgaataatttcttcatcccatttattgcctaagtgtgcacacaaaactgaataacattaaaaagtaattcaacatgtatagtcaaggtcagttttgcaaagcaagatacacctgacccaaaagttgttgagctttgcacatgggggactgcttattcggagacactgaggatgggaggagcagacaggaagaaaaaagagttgaggatccccttaaaataaagtatacatcattttctattttgtttgcccaatcttccattattaaataaaagaacattatgttccttttataactaaaataagcagttgtagattattttaaaactttacctgattttatggtatcatgtatttaatggctaatataaaacaaaaatgaatttatttttgttatagttatcaaaaattacatatccatcttcaagacagtattctaagtttgtttgttttcagagttctgtgacagggctcagcagttcctaaaagtgctgaaaacaaagtggtagatgatcttgaacttgatggttgtgaggtccttaaaaaacaatactgcgtttttaatggggttacatagggtgaggaactaaagagcttttgctttccctgcatgtttctcactttgaagttaggaaagcagctcagtctgactgagctaggttgtgggtaaagaacttgccaggtttttacaaatgaaagcaaatgcttagaagtagaattaaaagccaatgtacaataaactgttagtgttaactgatgccagccctgatccgcactcaaaaagtgcagtgtgaaccattcaaagcgacacttttctcctttcagaaggagaggcctacacaccaagtagcagagctggaaacattagcacatctcgctcagaattcactggttgggatttgtctcatgcatctcagagacaggcagattttgaagctggaaggtgcgtcacaaaaccccctgtatcagaccatggggtcagagccgaacaccatgtttcatggaatcctcattcccacattatattaataaagaaaatttgtaaaaaaaaaaaatttccatggtcaaatatgtttgagaaattgagctgatcaagtttaaacgtttcttgggcctgtgagctttttttgaacagatagctattagatgatggctggatgttcatgttctatgggacacagtttgagagatagtaaataaaatattagtatccctggtttacagatgagggagtagaggcccatggagattatatcctagaaagtggagaacgcaggtctgcagcctcctagaaccaactcttcccagccagggcacagtcagaaatccaagaaagacaaactgcagccagagctctccgcaatgtgcataccctggaaatgtctcctcaaatgagtgcttttgagaaatacacacttttccttttctgattcagtcagaacatgtaggccctcccaaatcaaagtacctgatacaaaggcatgcagatgctatcaatccactccagttgcaaccgaggcagttcatccttccggttccgatcaaaaattgcctagaatggggggcaggaagaacctcgctttattacaccaaagtattttacagggtgctttgtcaaacactttgctagaatgatccattttttttacaaactgaacccttcgcaaatcacaatcaatctttacacatactttcttttcctttatctatgatgagaaataaaatgtttttacctctttttatgagatttgtaagcaaatttacttgaactttctagcgtgcaacttcttggggcaaaaacctgtcttcaaatataagtaactgctactaaatcaagtcatcaggtcactgcgaattgggtacaggtcaaggggaaaggaatatgttttactgccacaaaaataatgcaggcttttatttctgcattatgagaggttgggatagaataggacaaatcggaaaatatccttaaaagcaattttattgtaaatagaaaccatttatactaatttttctgggtaggggttgatttggcaattgcatatgtttttcagtaaggttctgtcattaataaatttttaaatatttatttatcattgtatggatgatggtgggtggactcattatctcttcattcccagcccttaagctttatgatgatataatgtttgagataatttaggtatatttttgggaaaaataaatgacatttttctgttgggcagacttaagggaaacaatcaattggaattttagtgttaaaattaattcactgaacaaacactgccaattctgtgccagtgagactgtctctccctttgttcttaaggagtcaggcccagaccagagaagctcccttgtgcccttacttatctagaagactgggctatctagttataacttgccctcccttaatgttatatagtaagttttatctttcctttacataaaatgtggcattcacattattttggtgtccttataggccatgagggtggagccaagcaatccctttggtccagagatgtaggaaaatcctgcatcgttcagatgtatgaacaagagtgggagtgggtggggcagaaatcactagctgccaaatctgaggaaaatatctccaaattggggagaaggtcactgattccaccaggcttttctcatccttgtcttgcaatggaagatgggaaatagcaggaaagaagactggaatttggagaaaattgtgaaaatgtgctggagagagggatagttcttgtgaataatatgagtcttgatccaaaatgtttctttagagctggctgcggtggctcatgcatgtaatcctagcactttgagaggttggggcaggaggatcacttgagcccaagagttcaagaccagcctggacaacagagtgaagcccctgtccctacaaaaaaaaaaaaaaaaaaaaattagccaactgtggtggcacacacttgtcgtctcagctactcaggaggctgaggtgaaaggattgcttaagcccaagatgtcgaggctgtattgagctacaatcatgtcgttgcattccagcctaggtgacagagtgagactcagtctcaaaaaaaaaataataataataaataaataaaataaaataaaataaaaataaagaaataaatacacaaaatgtttctttaaaaaatattattctgggctgggtgtggtggcttatgtctgtaattccagcactttttgaagccaaggagggaggatcacttgagatcaggagtttgagaccagcctggccaacatggcgaaaccctgtttctactaaaaatgcaaaaaattagctgggtgtggtggtgggcacctgtaatctcagctacctgggaggctaaggcaggagaataacttgaacctgggaggcagaggttgcagtgagccaaaattgtgccactgcactccagcctcggcgacagagcaagactccatctcaaaaaaaaaaaaaaaaaaattatgttttcttttctctatagttctgtctaaaattttcatatttatttaattattccatttctagtggatattataaagttacttttttaaaaaatgcagtggtttttagtatatttacaaagttgagcaactatcactacaattatagaacattattatcatcctcaaagaaaccccatactattagcagtcattctcgctttttttccgcactcccagccttaggcaaccactaatctactttctctatctatggatttgcttatcttgcacatttcatataaatgcaatcttatgatatgtggtcttttgtgacttggcctctttcactgttttcaaggtttacccatgtagcatgcatcagcacttcattcatttttattgccaaataatatttcattgtatagatgtcttatttatttgttcatcagttgattgacatttgagttgcttccaggatattatgaataatagctgtgaacattcacatacagtttttatgtggatgtatgttttcatttctcttggggatatacctagaggtagaatttctaagtcatatggtaactctgtttaactttttgaggaattgacaaactgtttttcaaaacagctgcaccattttacattcctgctaacaatgtatgagcttccaatttttccacagcctcacccaacacttgttattgtctgtcttttttgctatagctatcttagtggctgtgaagtgatatctcattgtggtttcagtttgcatttccctgatgactaatgattttgagcatcttttcatgtgctttgtggccatttacatattttctttggagatatgtctgttcagatcctttgcctatcttttaaattgagttatctttctattgttcagttataatagttctttttatcttccagatacttggcccataaaagatatatgatttgcaaatattttcccataatatgggaaaatttactttcttgatagtgtcctttgatccatgaaagtttttaattttgataaagttcaatttatttatttatttatttatttatttattttgagagagtcttgctctgtcacctgggctggagtgcagtggcacaacctgggctcactgcaacctctgcctcctgggttcaaacggttttcctgcctcagcctcccaagtagctggggttacaggtgcttgccaccacacctaatttttgtatttttagtagagtagaagtttcaccatgttggccaggctggtctcgaactcctgacctcaagtgatcaggccgcctcagcatcccaaagcgctgggattaaaggcgtgagccaccactcctggctgttcaatttaattttaatgaagctcaattcaacatctctggaccaacatctctgggtcattttgtcttttgtctcctgtgcttttggtttcatatttaagacaccatggctaacccctatccagaagatttatacctatattttcttctaagaattttatagttttagcccttacatttaggtgtatgatccattttgagtttatttcagggtatgctgagaggtagggagccaacttcattcttttgcctgtggatatgcagttgtccttgaaccattgttgaaaagacattatcttggcacccatgctgcagattagttgaccataattttaggggatttattattgtactagtcacttcttaatcaatgcttgatgagaaaaaaaatgagtgtgaggccccacacagtcctgtgcttcacagcattttgcatctcataaaataagtattagtaatcatttatttcatgtctatatttcccaccagttgacaagatccttgagggcagggaagatggtgtcttactcattgctggaaacaaggtgccttgcttcatgcccgacacatggaggcactcaggcaggctttcctaactgactcactgcttccaatcctgaccctctggctgtgggccagattagcctttgtctccatgaagtgactcccatgactcctgggaccatgatacctgagggggctccaggacagttttcctcctaaatatcaagggataatgggcacagcagctgtcagctctgggtgcatgcatttacagatatttctggaaaagaactgagggctaaccctgccacatcagccaggcctcccctgaggagatggtcatcagtggtgctccgtagtctttgtgagaagacaggagcatttagagctatgtttctaccgcaaaattaatttcatttatgtctacagaaaatgccttacctgagcctacagataaaggctccttagtgctgcgctactgcacccaccagctcaccagtgctggcaatttactcatatttttttcatttaattaaatgacctgtggtattgctgcattgtaaacccttcagagtatgcctctgaaacagtttttaaagggggaaaagcttttatttgaaagtagatatgacagaatttgggtcatactaggttttatacattaactgtatgtatcccaagctaatatttttatttttataaccaaatttgatgacaccaccaaaaaagggatgttttgagaaactaagtcaatgttgctttgaaaactcaaataattgttgtgtgtgtttcaacctatgtagcctcctgatcttttgtacataagcaaccaattaagaatattcaaaattagcaagactgtgcgttctgacttcaagcagatgaaactattcaaactaggagctagttctcttgcttttccttgtttttaaatgtcagcaaagaaggatgtcttaaaacttgaagaccttataaatacctccaaatgttcaagctcagttaatttgggttctcataaacagacattcttgacaattgataccttccttgagtatcactaaatctactgtgctatgctaggctttaaaatgctttgcaccactctcagagtcattgggttatatgtttttagctaatcattggttagtaataaagaggctgcccctcttgaggtggtgactgacgcagttatgtcttctgcatccttatgcttaaaaacagcatcatcttgagcgtaaagtaaacattcttaagtaataactgagcagataagtccaatataaatagcgttcaaatcaccagaacctagttccccaggtgaaactttttcattttacagacaaaagaaacagagatttgaaatgatttgcttttgggattttgaaagttggaaattggaaaataaaatctagcttctcaaagctagaaagccttcctttaatttttgatgcacagtgtttctattctaaagtaggcatacatgaaatgccagcactgggctttgaattattcaaactccactttgctcatcctccctcgtgcctacttgtcccactgtgggtgcgcaggaaatgcttgttaagtagctcaccactcttaatcagaaacttgggaataagagtgtttagcatttgagtttaattaaggttttaaactttcaggagtgcttccttaaacccattttcagtctttcccatttccaacttgtaatttggagttctttttgaaaatgtcattcaaaagggtaaatacgttataattaaaggatgaactcactgaaggagtgagtttgagctctaatctctcccgatctccttgttcgaagaactcactggttacaagttctgccacctgaaacatataaatattttaatctgtgattatgtgtagtttatcacgagactcagaagttctttcttgcttatgtatttggtgatcctcatcaacacaatcatttaaaaagcttatgaggaagtaagtatattaacctttcatgtttgaaggtgttatagaacttaatgaaactgatttccttttaatcaggacaacttgtgcaatgtaattttagatgcatgccaacaggcaatctgccacagtacggcttccatatttgggatgaggcaacaggttgccagcttcaaagcaggaaaagttcttatacagaaaagtgaagcaaatattcatttaataataatgtgtaattattattatattatgtaatgatagtttagccactttttattatttctatgtagattatttattttgttgcatacttttatgttagcccagcttcaatttgccacatgaaaactcctcaactccctccctaccaatatttgtatgcactctgggagggataaccccagggcacatcctctgcttcctactgttgcaatcaatcaagaggcaggactaatgccagattcactgttcatagcagacttttacagtaggtcacggtatagtttgaagagcatgacttggtcttcaggctgtctggatctacgcactaaaagtgttaatttatggtaggctctacttggtacaaggacaatgggatgcttgttctacctgaaaccttaaatagagacttatatttttctacttttaatccattagcttggatggtcagcagctactgattattgccaagctaaacagatttttttttttcttttccacaccttcacttctcaggatagtgtgtgggaagcaaattgatatgacagattaaatgttgaatggctattttcaacgctactacagtgtgcatctaggacatttctgagatgaactagctggatttaaaaaaatattggaagagtagaataaatcccagacaacttcatggtaagagggcatggataccaaacaaatttttctctattccaagttcttatgaagataaggttcttaaatctggcaaagatgagacagtttaattttggtcaagtgcacagtatcaagataatttaactccgttgatctctcaagagatttgctcaatcacagattatagataaaactgaaacacaatgctaaactcacacacacacatctgagagtagcatgtgtgcagtcacatataaagaaatcaaatatccagtaagttcagatttctatatttctgttaagaaacatgggcccctttcaagatcaaccacaaaaaactagttggaactgactgaaaaatccccttcaccccagcctcttgtatatgtgcctgttttctaggactcaattcacttgtctcctctccagtctctcctgctaccctgcatttcagcacaccaggcttctctcttctttctctggccttcctttgaagaggaaatggtcccctaagggtatgacctcatttattcagttcccagaactctccctcagattgctctaagctaggtcttttgcattaaagaatgtaaatgtgcacatcaggcgcctcaaggtgggagtcctgcataggtctgtagcccctggaaagaaaagaaattaaaacaaaattctgtcgttgctctttctcaagtacttgttggtatctcccctgtgctcctttcacagcttaacttgcacaactgctttgttggtacttaaaaacccaatcaggaacattaagtggttactgattgaattttttattaaagaaggaaattgagatgctaatcaggccttgggggaatcactggggaaacccacatgcttagagtcttgttgcaggaagggaaagtggaatagaccccagcagaaaacattctgaaagggaattttaaaaaatcaacatccaggaagttagagaaatattttttaaagaagggcctattgttttctccaaatgtttcctaaaattttgaagtgagcattaaaaaaaaaaaaatttaacccatcaatttggagacaaacaagaatgagattgctagcttagaactgtgacaagctttccgatggaaacattaggaaaaacacggttttgtgttttatttccctgagctcttatgtttctgcacttttcaacagaaactcacatccagaaaataaaataatatttacactagtgaccgagaagaccacctacaagcagctactgggcctcccaagtcggcctaaaatatcaaggcagaaatttttttccttgcaagtactttgccctgtcactttcctgttccctggggctactgctccttgagtccttgacatgcgtttcactgtggtttctgaaggtgctggcacatcatacctcaccccattccctttctgctcttctctagttttctctcagtcctcctaacttcctcacactctccacctccttccatccctattacaggagcctcccccagtactacactttttcccaatacctggaagagcctcctacctcttccctgcagtctactcaccaactctcccagaagggaggccttcccacatgggaaaggggagggggtaagatgaacagtgggcagagatgtggaaagaagctagtcaaccacacaaattcttcacaattatcctgctttatgtgactttttgtaacttcaaatatgtcacactgaaatttaaaccaaagcacaattggtgaaatactctattggaaaactgcctgatgtacattggacagtgtgagcaagaaataaacctttatttgtgttgaacaactggaatttaagaatatacttgttactgaaccaaggcctagcctagccttgactaatacaaaaattggtacggaagtgaggtgctgctgttagaaaagaagagaaagacagaaaaagaccctaaaatatgtgtcatcagcttgggggccaggtatcaagatagtgaggaggctataaggatgagaatccatggcaaaataatttgtacaattataactaaaagctaacaatgttctgaataaacttacagtcttcggagatgagattagaaaacaaaatgttagtagcatgtgatgattgccattgactgttttgcgaggaattacaggaagtgagttagaaaaggaggaacaggcttataaccaggaatgaaaggaaatggaaatagtcgcaaattcagggacttgtagggatggaagataaaattgcttctcaattccaaactatgaaaatgaaaattgcgatacactttgacgaagtttgattaggactcagctttgtaacaagaatcaaataaaagacatctagagttagaatctgaatgaattaggtagtttgcagcatatccttctagctggacaaaaatggctcgattaaatgatttacctatatggttctctcactgaagcctgttaggcccaaggcactaggaattaagtcagaagagagaaagaaataaatatatttgccacatttctttattcctaaatgtaaagaagcaaataaatacagaaaatctaagatgtttgtatggaatgtggatgtggttatgggcaaatggaaaggacttgaatcaaaaacataaaaagctgactaaacgtacaagagagttttggtgccaaagaaacgctaagcccatgattacacaaaacaagtgttgggacttcaaccttctttaggtgagaagaaggcagtttgaccttcagataaagctaagaagggtgatgggaaaggaataatttcccagggaggattgaaaggtcaagggaaaaaggaaccagagaacatctcccagagaatcagggtcccctgcatggtagaacacctcacagtgagtacccagtgggattttggagttgccatggaccactcaccactccacattgctatgaatatcgctcatctcttccctttccgaatgggagtctttgggtgcatgttggactctgtattttgggtgtgtgtaggtctttaatctgcatccagatctgttgtagagactagcatgtatctcccagagatcctggacttaagagtttgatgccgtgactgatgggacatttgggttgtctttcttggaggaaggatgggtatattttgtctgctggagggagaatgaatcacatttttggtgatgagaagggtaaactctggtagtcatgcattcactatttctggctttctcctttctgagcaaatagaaggatggtacttcctggttgggtggggtcatgtgacaagttctggctgatgaattgttgcgggaagcatttaattgccagtgcaagaccttccagggcctctgtcagaatgatctaggtagtggctgttccttcagccccaatacagaataaggacaaagtggcgcctgccaaccctaggtgcccatgttcgtgagcaatttgttgtttaaagccactaagatcttgggtaaaatgataacatagcctattctgtggatacgcttgcatcatttaaaaatgctgactgatgcatcatgtgaaggaacccataacacactgctaagaatgaaagctttggagcctaatctgctagaatctatacctagctctgccacctacaagctgtttaaactcaggctgcttatcctttctaagcctcatttttcccatttgtgaaatggggataataaccatattagtttcctaaggctgctgtaaattaccataaagttagtggccaaaacgacaggagtgtattctgtcatagttctggaggccgggagttctacatcagttcactgggcagaaattgaggtgtcagcagggatgtgctccctctggaggctcttggacagaattcgttccttgcctcttccagttttcctttgctcacggctgcatcactgcaatctctgccttgtcttcacattgccttcttctgagtgtgtaatttccccctgctccctcttataaggacatttgttattggatttagggcacacctggataatctaggatcagtctgcagctgagatgcttaatcacatttgcaaagatactctttcctttcacggtaatgtttacaggttccagagattaggacctgatatctttgggtggccattattcagctgactacaattttaaggattaaatgagatagtatatataaagcagtcaataaatattagttatttattgatatggaaatgcatcttattttccctaaaacgtcaagtctttagatgccaagttactgttctggaccccacacagtaggtgcatcataaaacgcacataacgattaacctctaaataccatcagtaatccctggtcttcagttgggtagttacttaaattgaaaactattcttatagaactaatgctttatggcagagaaatcagataggtggtaaaggcatggtttgtttttctgcaagttaaattggatactgcatattttgaccacagaggtttctgatatctaaataatatttaaaaagaaaaatataatttcctttttgcctccttttattttcagatattaaaaaaaaagaaaacaagactttgtactgagatgtgattatcttgccaaaaatcctatctttgaaactcttgccttaatggtcaatgtattattcagatttcgcacattaaaaatatcttacagagtcagaaatactattgcttagtgaaagcacgataaaaaaaaaaaaaaagggctgtgcaataaactgtgtcgtgcctaagcctcctgctattttttacaccatgttaatactgatgcaaattgactagggtttcagtgcctggtagtcagggctctgggaatattgtgtcccccttacgccccccagtccctcctctgctgagccctgccattaatcaccacttgcctgtctggagatctcccacggtttggtcacggctccaaggtcacaggctgtcattaacattgatctgaaaaacagaaccaaacaaaacagcctgaataatcttttgttgcattcctaaacaaacccgtcctagatacataaataaataaaataaaatggaaacgaggccagctcacatcttcctttcctcaacaaggggcagcactgtttatagtccctgtgttcagcatctccatcatgtggccacgctgcttaggaagacaaagctctcacacatcctctggtggcccttttgttttgtctgcagcaaatcaaggaaagcaaagcactactttctgtacacctgagctaagcaagctctgcttaaaataatttataatggacaatgttgttgggtttttttaaactataagcaagagaatcagtatataacactatatacatggctgatgaaactacttaccaacttatcattgattgatgggaacaaaagaaaacccacaccaaagaggcaaggcacatgccacataaggggctccttcattttcatctgctctacagagctaagatttatgggcaagagctgtatcatttcactccagtttactacctggctccaacaatggtttataagcattatgaagaagaaacatactcagctccagctctcattaatttgggcacataagaaagcacaggaatggtctgaatcagagttttgaggggcagggttaaccataattcatacggaaccatggaaacactgggaacaattcaaattgtagatagctctggtgcttatatataatttaatgtggtgggaggaggaaaaataaggcacactctgtcccaaatctgctttctttgtgctgataaccagcagaatgtgatgaaaagtaacataggatttgagctggggaaccacatcttggctaactgcttttggaagaaaggggtatgcaaccaaaggtcagagggctgtcctgatgtcggtgttaacatttcataccctgccagatctaatgccttggaaacatgtctgctgcccagatggcagagcatgcttagatggcaggggggtccccccacaggaaacccctccagggaacaaggcagggtcacagataacaataggtcattcaaggcacaaccaggtggcaccggcatcagcagccctctcaactcgagcagcattgatgaaacctctaattccaaacatccctgtgttaagaactacgcaaagggagacacatcagtctattcatttttgaccttctgtatcaggcatttctacactgcttactgtgtgtctgcttctgtactaagtgctttactaaccaactgctaactaaactactaactaaatgaatcgtcatcaccaccccagaggtagttgctattatccttattttacagataagtaaacagaagcacacagagattaagtcattttcccttcccaaggtgagtaaatgattcaggattctgtgcctatcacaaagctaccagatgccctcttactacacatggatgctgacagtactggagggggacaagactggctaaagcattggatttctcagcatctctcctgcatagcaaataatctctatgaggttgcctatttgtatcataatgtggataattacttaggttctgtccagttgataatttgaaactttctcttcaaatgcatattgccattaatcagttgatcaacaagtttattgagtatctgctaggtcctcagatgataattctaatagctaccacttattgggaagtctccacagggtgactgactcagtctctatatgtggtagtgatactattattatctcttattaaagttaaaaaaataaggctcagaaacgttaggtaacttgcacaaggttgtacagttattaagtgtcaaagctgggattggaatcctttgtctgacagaagaatctctacttcaatgaatacagtggagcaagaagtccatgcagagaagggagacaggacaggctgagaggtaggacgggtagagtggctgcaacctttgtccatctggcactggggagtcaactaagcctggggactcaggagggacctggatagacctttagggaggaaactttaggtggtggatgtgaggatggtttgaagaaggagagggtggaaggaaggagactcattggagatgtaaattgataggagcctaaaacaaggaagggagagtgggaagggaggcacagggatggaagattgcaaaggaagaactgaagaaaacaaatgagcagttctatgttattttttagattaaggctcttcaagaagtgaaagatctttttgagagtaaaagaccagggagagagtttttactaactgttttagactgaggtccctataattctagttcagtttatagtgagttaacatacctctcctctatatgccaaaattatttcaataataatcttgtgacaatcattatcttcttgatttgttctgtagttgtaaaacaatttaaaatgaacaaattttaatgttaaagatatattcaaattgagtacaaagattttgtgtagactgaaatctgcacttgcctaacaaaaatatgacactttgcagtttgcacttatttcagttttaaattttaaccatgaataaaacccacgaatgatcacataaaatgacagaatgaaagtatctcaagttgtatgtcttcatctttaccatcaccgtgctatcattgtttgttctgaatatagtctttaaaagcaggaatatgagttctgcaaggttagaaacacaaacgacacccagagagtttgagaggttctaaatggttaggaacttactattgaaagtgtatagctgcatctacctatgtcaagagccagctgtatgcctgggcattcttagaattaacttacattacgtgtgcaaagaaaggataaataataaacatgtgcttatttgaagctttcatatcaattatttttatcttaacagtaacctcagcaattgtttggaatttataccaataaaagacatttcttaggaggtatatctcaccattgactatttagaattgctggcacatggtggtaataaaaagcagactgacttttagttggttttattactattttaaaattctctacagatggtgctcccttagagcaccacccttggtgcaaggtggtcagagtgtaaccatgaaatgggggagggagggcagatgaggggagaggggagaacccagagcacctccattttatgtaacatgcttccaaataagatatttcttccatatggggttccttgtcaaaacagtttgaaaatctctgtaggaaaatatctaggcagagaaactcagaaatggcatttcaggaaaagagctcagaagagaggcaagcccaagaaaagggctgggagtcatttgagaagagatagtagtgacactagaaggatgctgaggaaaaagagaagagaataaaaaatacatccttgggggacagttctgtttagtggatggtggggggaagaagggctagaaaagactaagaaggaaagagtcagaaataaaggagagaatccagaagcgtatatggctttgcagaatccaaggctgtagagggttttaagaaaagagaggccaacacaattaggggctataaagagatcaggaagctgaagagaacaaaggttgtagcttttaatacttggaaggtgactgtggttcaacagaagcagaaatcacatagtacagacttaattcctcagtaaggaatgggtaaatactctgtggtatatctgtattttggaatactgtgcaacgataaaagatgatgaggtaaaaacatgtaaagaattccaaagcatgtagttgagtggaaaaccatgttcacattggtatgtaaatatacaatttatgttaaaatagacaatcaaaatacacactaaacagtatttttcctaagggtgcatgtgtatgtaaatgctttggaaatggtctggaaaaacacaatacactaataacaaaatacagctgtgcaaccagtatgggaattgggggttgagctcaaaggagatctgggggcttattagcaatgtttgatttgttacagaaaatatatattcatataattactcatggcattaaaaattatacaaaaagaaagaaattgccttgcaagaaattaggaagtgtgggagtaaagggaaggagaaaactatgatggggtctggagaaaaggcagcctgtagggatgactttttgattggggaggcagaagtgtgtttttaggtctagaaaggtcatgattaataaaacagattttgaaaatggaagctgaaggagcatgattgatagagccaggttggggtaaggggcgaggaggtggaaggaatggaattagggcaccagtggaggggctggtcttgaagatgaaaaatgaagaaaaaggcctgtaaagataatacagaggaatattaaagcatagaggaaaaaaactagagccctctggggagagggctgcaggaaggtgacatgaggacagctacagagggtggggcaggcagtggcctgtgttcagaagatggtgccagagattttatatagcagatacggcaggactatgtcaaggtttccgcttggggtaatccagtagttgcctggttgtggagcagacccagtgtgccctaaccctggcctcacgagctctcccagcaaaacttagcaatgttagaacagggataagacagcagaaggtctggttgaggtggagagagtagaaggatggggtatgagagaaagaggaatagtgcccactctctggagtggctgcaagagaggctaaaatttgccccataaacagagtgggttgctactgtcctttctaaacaacttggaagacgtcccaggcaaaggctagaacagactccttatctccacctccaatattgttctgactggttttctatccgcaatgcctattgtctctaaagaaaagcaaaagttactccccacttcctttgtgctatgtaactctgatttctaggatgcaaaaatcccttctccacccaacttgcacccccacttccccaggaaacagaagaaatcatggcttgccaaaactgaactaatttgaacttcattttctaattttgatggcagatttttgagacaaaaataaattataagatgaaaagacattctcagtaatttctttaattattcaactgatctctgaatgttttgaatgtaagctaagatttgttactttaaaaatcacttctatgctcttagtactgtcagaaaatttatgtggactaaatgtccaaataatgaagaaacacataaacaagagctttttcttaccgaaatatatcacgatggtttttgatgttccaatcgtattctcctttactgacaagttcaaagaattcagttctcctcctgcaggaaaatcaaatgaagaaagaaagaaaaaaaaaactggaatgagatttcccagtctgtggggtgacataaacacatctatgggaaaaacataagaccacttgaaccaagtaacttaatatttgaaatcatgaggctaaagcactatcaaaataaatcactttctaaaaaatgttgaggcttcaaggaaaagccacaatcatttctgaatgtatttacaacagaggagattatagagccataaaacagaaaacaatgtggtgcggcatttaggattatgtgctgtgaagccctagtgatacttactgaaagtcagagaaaggaggcaaggacaaataaaaagtggggacaattctagaatgttcttttatcatccaacaaagaattgagctgcatgatgatccaagataagataaactccctggtagtaaattcaagataaatatatttttttccaggttagaaaataactatttcaccatttcagtgcttaaacgcataggctatgaagtctgaaagtaacggtgtttaaacactcgctcagcaactcgctttggaaagttaattaaatcctctgagtctcaatttcttaatctctaacacgggggtttcagttgctaactcacagagttactgtgaggattaaatgaatgacatgtggaaagcatgtagcatagtgtctcaacattttaagtgcttgacactataaaccaaaaataaaattctaagcccccaaccaaataaatggccttctgctcttggccaagggcattcctaaattaacctgaaatgctagtacaggccatgatgggaagtgggagttggacatgtctcattattccttcctcccttttggaattcaggtacagctgaccagcattaacattaaaacagagaccttaagactgacaaagcagacactttgtagcaataagatatcaacatgacagacagcaggccctaaaagaaatcaaagtattttatcccaaaatatatttatttgacatattttgaaatggccttgcaaagctgtctcttttggagaaaatctacattctgtagagaatccccttccctttccaggtccttttcctaatccaggggagaattaagtaagagcttggcaccttttaaagtctgataagaaacatttacaatttattctggaaggctgctacctggaggcttcatctgcataacaaaaacattggtctccacaaccccttatcttaacccagacactcccttctattgattccaggtctttagatagaccctttcaactaactgccaatcaggaaatctttgaatccacctatgacctggaagccactccccacttcaagatgttccgcctttcctgactgaaccagtacatcatacatgtattgattgatgtcttatgtctccctaaaacatataaaaccaagctgtagcccagccgccttgggcctatgttctcaggacttgctgagtctatgtcacaggcatgtccttaacctcagcaaaataaacttctaaattgattaagtcctgtcacagacactttttggtttacaactcacacatacacccatggaaatccatttggagatgcgtagatacggaaaagacaagcaaggaatattttagttagatgattttcagttttagtgagaaaaggaaaaaaagaggacatcaccattttgatttaagaatcacttcccaagttttcatcctcttggcacttgctaatgagagaatatttaagagatcctaacacaccatttcccaaaacgcatctctcaaaatgctagacttaagaggtgctccatgtgaagatgttcctgccaagtaggtttgagaaatgctgcccttaatatacctctcttggagacaccatctatattagcctttgaagtctctgagaaatatggacgtagaaaagcctgtttaaccttatttcatcacaaaattccacatagtactgatgtttcaaaaactacactttggaaaataccatcatgacatataatttatggtagaaatcagacatatttggaaaataccatcatgacatataatttatggtagaaatcagactaggatctcagaaacttagtgctgaccctctgtactgggggacaaaggacaagaggttgagaacaactggctcctctgtgtctggcctggggtgcttatcaccaactgaccaactgtgtggatttcttgccaatgggtcagactaactactaaaattacttgaaaggagacaggtcaggaagacaaatgtatagttcacttctgtattagagacacaaagacaggtcctggatctatcctttcaagatgatgcaggtcaaggccatactacatacagcatggaagaatctccaagacaaccttacggcaactggcgagatggcataacccaattacacagaagggcccaggaactccttctactttgggtgggcaggtgtatacagttcttttcttcatataactttcttatcttcttcacttgacccattcccttcttcatgaccaatggtcgtgcctttttcatattactgagatagccaagtaaaacgagctccccggagaatctccaacccgcctgcgcattgggaggatgggtgaggcctccggaagtttgcgctgtttgcagtagggaggagcctggccccttctgttcctgtgtgggaacctgggattcagtctgtgagatgggggcctgttaacaggaacctctcttgctttgctgagtctttttcctttttgcccaataaattccataacctctcacccttcaaagtgtctgcttgcctaatcttttctggtcgtgtgacaagaacccagtttattctacaacattacagtcactgactgtgaagtgaaatagaaagggaagtggtggagtggaaagagcccaggtttggacccacaccgacctggcttaatgctgactgtcacttattagctgtgtgatcttgggtgagtaatttcacattgctgagccttagtttccagctttgtagtgagaaattgagataaggtgcactaaacatttggccctgttagatactcaatacctgaagctatggttaatttgtaaacaatattaatactattactgccaacaataatacaaattggactaactggactaatggagatctaacagtttgcccagttttctcctctcactacatagaaattcatctttttttcaaattattatgaagtccaacaagtatttattgaacatctactctgtaacaagtctttattaggctttacggtcacatgataattgggtgttacttttaaatgtctctgagtttagccagggctaccaacaaataaataggtaattccctctttaaatgtaatattaatgagaataataatattgggactagagtgatgtgagagaggcactcacctggggcacaaaactgaagtgggtgccaaaaaacttagttatcaagataaatattttaatgtgatatttaacaaaataaaaataaatgtaaaacatccataatgaacacaacaacaaaattctaaataaagacaagatctgaacttgtacttgaaccactcacctcacttgcttcaccctagttccagccctgatgaggatgatattcactgggtctttactgtgttcctggcagacttaatggggtctggcactcactacttacatgactgaccttgagtaggttacttaaccttgctggacttcagttttcttattagtaaaagagttatagtaatgggatctgccttgtagggttgatgggaggatcaaaggaaatgatttatgtaaaacatttagcagattgcctggcaaaattaggttatcagtaaggattagttactgtgattaagctcagaagggtgagtacctggctcaaggtttcacagatggtgagtggcagagctgggatacaaacacagtaggttaaaataacagctgccccaagcagctaagatacatccagggtgtccttggagcacagaggaaggcactttgcttggctgggaggatcctggaggattgtgaaagactttctgaaagtttgtcagccatcctccttgtcatatgttcctgggtggccatttcaattctatgagttattccaagaaatcgctagaattaagcttcatgaggacaaaggcttggcccacttttgttcacttctgccccttaatacctacaacaatgcctgacatgtagtagaagctcaataaatatttgttgatgaatgaatgagaatgattatcttagaaagctaatcattaaacaaacaaactctttaaacactggtttcacctagatcctaatttttctaggggcttcacagttgccatttggagagagagattgaggtaagtaaacaacacaaaatctattcaggaaaagccctgtcagattcttgcagagtagattctaacatgaaccaaatgggcaacataacaagttgtagaaagtaagaacaccatttccatccaatatctgactcaccttccactaacgattgttatatctgcccatagtatgttcactatagggaacataacatctttgatgcagagtgaaagcatgttccctgtgtgactaactcattgcagaaaacaaatcctttttttctcttttttttgtttttttgagacggagtttcgctcttgttgagtaggctggagtgcaatgtcgcgatcttggctcactggttctgaggcgcaatctgcctcctgggttctcctgggttcaagcgattctctgcctcagcctcccaagtagctgggattacaggcatgcaccaccaggcctggctaattttgtatttttagtagagatggggtttctccatgttggtcaggccagtctcgaactccagacctcaggtcatccacctgcctcggcctcccatagtgctgggattacaggtgtgagccatcgtgctggcccaaattcctttctataaaaaatgcaaatctatgatatgaaaatcaaacagcatcataagaataaattccccaatgatagaaattttaacagctagagttgctggtgtgaaggtcttaaatcaacagaatcaaaatcagtcatagacttcacatcacattagcaacactaggacaaaagggaacatccagtattcctagggaacagtgagaggagccttttcattgggtatatcaaaacgtagcatgctaatttgattcttccttcacagacaaaaggatggctacttcgtgataagttctatttactctgtcgtcccaaggtttgattatgttcttaagagagattaggaatctttctggataataggaatcatgaggaactcatcaacttgtataattttgtcaagaaaaacatgagaggccaggtatagtgggtcacgcctgtaatcccagtgctttggggggccaagggaggaggattgctcaatcccagtagttggagaccagccttagcaacaaagtgggattccgtctctagaaaaaatacaaaaattagctacatgtggaggcacacgcctgtagtcccagctgctagggaggctgaggtgggaggatagattgagcctgggaagtcaaggctgcagtgagctgtgatcacaccactgcactccagcctgggcgacagagtgagacgttgtttcaaaaaagaaaaaaaaggaaaagaaaggtgtagtcactggtggaaccatgtataacacatctggtaatgtatttggtcacatataaaatagccaaagagatattttaaagtttaaaccaaagtacatgtaaattttttttttttttttttttttttttttggagatggagtttcattcttgttgcccaggctggaatgcaatggtgcgatcttggcttactgcaacctctgcctcctgggttcaagtgattctcctgcctcagcctcagcctcctgagtaattgggattacaggtgcctgccaccatgctcagctaatttttttaatttttagtagagatggtgttttgctatgttggccaggctgatcttgaactcctgacctcaggtaatccactcacctcggcctcccagagtgctgggattacaggcatgagccattgtgcctggccacatttaaatttttttaaagttcctgaaaaaaatccttcttgaaagctcaggagatagagttaatcattttcacaaggctacaaaaaggattttgaagtgatgatatggcaagatcatgtaataaatttattgtgcatatttaataaacgtaaaaggtataaaaattacacagtggacatacatagagtttccatctacctccctgcctagaagtaagtctctgccagtcctgttgaggccctgtgcacctcccaactgttgcttctgtcttcttcccactcaccatacaatgaccattttctaaattgtgtataaagcatcatcacatatatccttataattttactaggcaaattttgtataatattgctctatgtgttttaaaagtttatacaaatacggtcatcatagtgtatgtattctctggcaacttgctttttccattcaatgcttgcgagagttacccatgttgttatatataattctaggccattccttcatactgatgtatgctatttccatctattattataccactgtctatttacccatttcctggaagatgaaaatttatatttttctaatatttcttgctattacatacaatgcagctatgaaccaccttgtacatgtttccttgtgaatttgtgtgagttctctctctctgtgtatatgaatatgtacatgtatatgtaaaattgctgggtcatagaatgacttcttttctatgtttgaattttcattatagttatagactggtagggctgtatggaacttttgagaaaaatctcctattaattctctcattttataggtgaggaaactcaaggtgaaggaaggtgaagtgacttgttcaaggtcccagggcagttacagaaagatttattgttgccaataaaaattactaccgtggtatttgccagctgatgatttttccatttccacctttccatgtgtgttaattgaaatcttctataaggaagaacttttccttctgggtagattataagtccccagcctcccggttctgccctctgagataatctttgtaaactatgtgtagcataaacctttgggccagatagcttttcatgttgtaagtgtatggacagtggggccagcagccctcatgctatgtaacagcatcacaggctgctgtaccaaggcaataccaagtatcaaggcagacacagacagggttctttccatcatcaataagggggtgctccaaagaagagctgcagattgcttgtgccaggttggtggttcacagctccaggtgatgtatttctgaccttctccctagtaataatcattacaaagtaacaatgtgaaattcactgtgcttttgggaacaagtttgcctatacagctgttctgttagcatctaaatgtacatgtgtatatagattaaacagagtaaacagcatgaacatatgtgaaactgttagaaacaggggcatttttagaagcatgaggctgctaaaaagaatatttgaaaatccacaaaaatacccaatacccgctggatccagacttctttgtcatgaggaactgtatcattaacttctcacgcagatcatggggaaccttggttttcaaggacaatggcaagtacctcagctagtgaaaagcaacttactggaaaatctcatttataatcagatatgtttttattaggctttcatcctgctcgcctgacatatgtcccactcagaaaaatagcagtctttaaaaaagcatcatttgaacagaacggctaaaattaccttcaaaaataattctaaagattggttaccagtcacccatcaccacattgaaaaactttctggtttgtaatttatctgcaaggcatcttttatttgtaaagtgagaaatcaccatttctgtgaacattttaatcatgaaattttttgcaaatttatgtatctatacatgtacttaggaatatatattctttatctattcatctaactcctttgaatctactgaaagtccataaacattaggaaggttttactgctgaggtggcaaatcatcactgtaactctcctcaatttctttctttttgtttttttatttgagatggagtttcactcttgttgcccaggctggagtgcaatggcgtgatctcggctcaccgcaacctcctcctctcgggttcaagagattctcctgcctcagcctcctgagtagctgggattacaggcatgcaccaccacgcccagctaattttgtatttttagtagagacggggtttctccatgttggtcaggctagtctcgaactcctgacctcaggtgatccacctgccttgttctcccaaagtgctgggattacaggcgtgagccactgtccccggcctgtaactctcctcaattttaactccagagttgtcaggcaggggttgcagggtgcacagatgtgtggatgcggtgagtgggtgcttttggtcttcttacagcttgctcaacaggcaaatcatacatctgcaattaattgttacatgcagattctagagagatttctggactttctttgcatacaaacattgaagaggaatagaaaattaatatacagatgttaactccagttattatgactaaagaaaaaaagtgttctatttaattttgaagtgaactttctccctgcttcagactagcactgataatacaagggcctgccaagaacctgagtgaatgacttgtttgatgctgtgcttttgttgatggcacaaataaaaccggcaaaatgcaggaagtagagataagaattactctagatgttgaaaatggcagaagattagagaccacaaggccccagcagtcagttcattcaaaccacaatcaccaggcaaagaagctgtgtaagccatggctagaaggagcgcactccagctgctcctgcattcacttccacacagcccttcgctgctagatgttgctgccttctctcttccccactgggctctgagtccctgaaggtaagaaccgtgtcctatctgcttgtacattaccagcaactagcacagtgcctggcacaaagaaaccattaagaagtgctatttggctacatttctcattttttagtcagttttgatatcatatggatggggatatggaatgagtatatggaaaaattctttgaaatatgtcaagaattaccaaaatatttcctccatcaacctactacaggggctgctgacctaatgttataataatatataatttcaatgagttaagtcatcaggctctgttaaaatataataatgtttgggatagagtaatggcttaagttttgtcagtcattaacaccttattactaatcagtttactttcatcctttccagtatggggttggttgagcgcaggcaactgtggaagttgaggacactgaacatagctggcttttaataaacttttgttgaatgatgaatgaatgtttgcctagcagtagaaacatttgttgagttcccactgtaatttttttaaatgaattgtctagatattaatctaatttttaaaagaattggtcaaactatcacattgaacaatttaaaatagtttagtgcatttttctgtcatcatcagatgctttcgagaaatgctatttactgcatccctttcgagagacaaatacaaagaaaccatcagactgggcattttccataattgctgatgagtgtagatcacaaagagaggtggcaaattttcaatttgaagataagtctgattaatttaggaagccgatcttaaaagcattgagcacccaagtggatttatctgaattattggaaaattatttgcttaaatcatgctctgaggcattgtgtcatggagaactgatcacagacaacttagtgactttggacaaattactcaacctctataagcccagttttccctatttatcagatggggctaacaatatctaccttgcacattgatatgataattcagtatcaaaaagttattttgagaactcattatgtcaggcagtgtgtcaggttttgtgggttccaagagtgagctaaagagtaaggtgtctgcattcatagagcttccatttcagtgctgatacaggaagatactgtaatgcctagaatggtgctgggcatggagcaggcacctagaggatgagatatagcgttatgtaatcacaacctgttgaggatcagtgctaaactgtttattgctacccaatagcaacaacccctgtgactgtattaaagctacagaattttcaacccctggtgcaccaacttagctcaacttcacacaagaagcctctaattgcagtcttagccccaccagactgggtccgagtatcactgacttggagcctccacatccaccctgcactcccagtggtggggcctggcattagctgaattgctaacacttagcatgctaacacaaagtgtgtttggaactagctttagacatttgcatcctcaaatttctgctgtttctaatgcccaaatgtttcctggattggccccagtttccccttgagtactcttggactgctatataactgcagagtaactaagaacattttggagtccaactacttggttcaaattccagatatactatttaatattgtgagcaatttactgaatcactccaaacctcagtttcctcatgtgtactgtggggttaatgagaaaagaaaaaacagctcagagcagtctgagctccttgaaggcccagagagtaatgagtatgggacttcagtcacgctccccactcccctaacccatgcttgggggccactgttgaaagtcattttgtttctgactagctacctcacccactatcttcatgttcctagaatttgtgatacaagagacaatgtaacaaagccaatcaatagcttatgttatgttaatgtaaattcttggtaaacaatgtagaaaatacctttcctttccttttgaaaatccacttgtaactgctgctaattggactgtatatttaaggcaacttgaatccatgctccggggttgcagtcctcaatcttggctcaaataaactctctacttatattaattttgccacagtttctttcttttaggttgacattaataatagtacctattttaataggactgctttcactgttgaatggcataatgtatatataaaggtcctaagtaagcactcaaaaagtattagttgttgtttttattactaatagtggaaggtgcataggtcatctttgttgatttacatgcagataaatagtacagggcatttgtatcatccctttgaagttataacatttgtaattttagatctctctgcccactccaacaagcatcatcttttatggtgcatgttttattaagttttctggctgagtgattcctttttttataaggtactttacattgtcaaagctctttcataaaattaatctcttttcactgccacaaggatcctaggagattagaatgggtgatatgcctatacccctgttgctgacaaggaaactgaggcaaagagagatccgactctcaaagctggtgaaattactacttaattatcaaatccttattcactgcagggactcagaaacaggcacagaaatcatttcagaaagttgctcagcagtaactggaaaacgttttcagtgagttggaaaatcagagtgaatcattaacccccaggctcaggttgtgaaacttagaaattcacattaaggattttgtttgtttttgtattttaatcttgtgaattctgctttcatatgccatttgaatgacatagaatcccaaggacacacaaggtctttagaaattaaagtcataagtttttgtggatgttttgaaagcctttccacatttccatgaatctcatatatttttttccttttagagcatggcaagaaatcttgcctctaggaatgagtcagaaacctgtctccaaaaggcagggctctaccctgcccagcctggccctttcctagagtgactttctccctctaggggaggaaagcagtgagcttcctttttggtttcttcaactgtatcatgacttttaggttgagtagtcagggcagaagaaccaacaataatccagacttccagaaactaattgtacggggagcctaatatcctcttggctcacccacccctctcctgccattgctgctacacgcagtgcctcagcggtcctgcggatcacatactttctgccctggcacttcacacatgacttcatgtgtgagaacagggatgagacagctgcaggaatgcccagtcatcaggcacacacaacatggaagtacatgagagttaacatcccacagatcaacatttggttgatgaggatggtgggtggcggacaattttgaagtgcgatatatgagacttctcagatggtccctgcaggatcaagactggctgaccatagtggagaacaacaaagaaatgtgtccttcctttcactggcttccctccttccccatttcactgtcccagcccctcactcttattcttggtgtcatttccaaaactaaactacctgaatgcaagcctttatctccaactttgctttgggagaggacacaggggcctcaagctagtgtttaaactgattacagaacacctggaaagagtcaacattatcacataatatatccccaattaaaatgacaatgatttcttgattcttccattagagagggaagcatggtgattgaagaaaaagccctgaaagaggaggtgtgggttccagttttaccaataatgagttatgtgacctaagctacgctatttaaccatttggacctctgtgcctgatcagcaaaaaaggagatgaattggattgcatcatttctaagatccttccgattccacaattgcacatttattaaataaaaacatcggggcgacagtttgtagtagctgctttccctctcattataactctagggattgttctggctaaaaatatggcaatattttaatgcaactttagacaggcaagtgaatcaatcctctgaaagtctagattagagaatgggcagctattcagaacctcaaaaaacaataatgctgatgaaaagagaacaagccagcttctttgggagtcagcaaacattagcaggggctgcagcattaagataagaacagagtaatgagaaaacgagttgcaaccaacttcgttgactgcatgccagtggtcactcagtgattcgtcaaatccctaacagagcttgataaatggactctgagtgttgatatttttttttctctctttagaagttacttggaaagatggcttgggaaaattcttctactttgaggaaaataacacaagatcctgcaagtgtcagggacaggcaataaaacattaaaaggatacagactttccataaatcccaaatcaaggagcattaatccagaaaatagatgaaagatcatgatatttaagtcaaccaaagggccacaaaacatgcaaaataaataggttataaagcaaatgaggttgtagatgtcaccatttctaagacatgacataggtactgttatctccattttatacttgaaagaaaggctcagagaagtaaataatttatctgatgacacacagctaattagtggcagagctgggattttaatttttaagtatatattttaaactaattaaaattatatttatcaaagtaatacatgaacatagttaacaaatcaaatagtactaaaagagatacaatgaaatatagcagtgttttctattttgctggcttttgtccttggcctgtgtttcctaatgctttcatttgattttttttattttggctatcatgttcttaatttttgaaagtgccttctttttcatagttgctcctactactatttttaaaaagcatcctgttcttgtttcatggatgcaatatcttagctctctgagaattctaacaacagtttttagttttgttttcttcctctccctgttttctctgaatttcattttttttttctgtttgtttggcctctgtctttcctatcggatgctgaaaaaatgttctgtgattcttggttttctgcatgtaatagtaaggtattaaaaagctaaatgggagttgtgtgtggggggggaggggtataattgctagataaaataatttgtttccgttaaaaataattattttaaaaatattttattgatacataatatttatacatatttattgggtacatatgacattttgttacatgcacagaatgtgccatgatcaagtaagggtatttaggatatctgtcaccttgaatatttatcatttctatttgttaggaacatttcaagtcctctcttgtagctattctgaaatatacaaaaaataatttttagtataaatatgtcccaaatgtttcatgggacatctaactatctattctaaaaaagtatttattgtttatctgaaatttaaatgtaactggactttctgtacttctacttgctaaatctgacaaccctgggtgtatggcttatagactcctagcttctaagtgcttggctatggcctacaggttttcaatccagagactggttccacttaacttaatctcttcttctgagcactgtatctcattcccaccctgtgcctctcctcagttcagagctcttcattttatttctccagaggatacatttctggccttctaaaggtagaataaggggagtgacctggctgtgttagtagaggacttcctgggtgctaagcattctatatactgattttctagcaatctctttgagcttttcgtgtcttaagctttgaacatcccttacaattgaacctaattctaactgatgcaatgccacagtgcttttcaaagggagtcatttcaaagcgaatggcacaagacttcctagaaaaagtgacagaagagacagatcttaaaggatggtcagtcaggaagatggcgagtggaggaacaggattcgatgtgggaatggtgatacatcagggcacagggggcattacacagggtgttccaaagggtaatgcgtagactagtctggttgacgtagaccaatcatgtaggggagaagtggaaggtaagaatgaaaaaaggttgggggcagattatagagggccttgaaagtcaaaccaagtttagaacttcctttgaaagcaatgtggacactgaaggtttttgagatggaagctggaggtctacagtgtgaggaagtttggagtgaagaatttcagagtcttctacacacaggtcataacataaatataggtaacatagaaatgaggccaggggagtggtctgagtagagaaagaagaacatgtttcaagagcttatacacaggagcaaggagaaaagaaacctgccaaggatctagaaaagaagagagaaaggcagctggagattgggcaagcaaggagagtagaaattaataataactaactaaaccttcagatatctcagagaagatggaaactatcaaaaatgagtacaggccattgaatttgaggaaagaaatgtctctggtgacctctgagtgtacaattttgatagagtgcggagatggactctgctcttcacggtgtaaatgggtgttaggaaaatagaggtactaaatgtgctctgtttatttaaaaaggtagacagtaaaagaaaggtaaataaaaaagcaattaaagatctccatggggtcaaatgaaaaatttttttaagggagtgacaggctttggtctttaagataggagaaaattgtgcaaatgagtggtggaagaaatttccaggctgctaagagagatggcgcctgatagagcaggtcccactggaaatgggagggtgcaatttccagcttagagaaaggcctgaactttggtgaaaaggagagaaagcccttctaagaaagagatagaaaagaatcaaggaatgaactgttgcattgctagttaattttccatcactgaatatttttcatcttcgttatcaatgccattatacagctgaccagaagttaacagtcttaaatagcaatattagctaggatctaagataaaaatggccatcacttagtttcagagttgtgtgtcaaacaagctcataaaacagaagaaaaatagaaatcttgtgactgtagtcctgactctcttggcttatacacaccactttaatggacttcatttatatcagagagaaacaacaacaaaaaaagtttagctggtttacacattgatatcaatgctagaataacaggtaacctccagtgtagacctggagattagttacaggatggaacttccatttgtcaaacagatcaaatgccaatacctactcaaagtacagcgtgaggtctgttgccaatattgactgcttcaaaagctgcataaggtcactatattccttggaggacaggttagcaaagatattgtgaccctgtaatgagaaagtaaaaagtcacaaaagacattaaatctgtggttgttgattacatgtttttcctctatttaaaaaaaagtctgggaacattaaaaaaatcactttttaaaaagcatagtgaaattttgtataaatataaacagattctctggcaaacctagcaaagccagaatgcagtcatttttgacaaagtctaacaagggacactttgttacatgcttagtctcaaagggaaaatctgaaattgttggaacttatcttactatgaatatgttgtgcccacaattccatctgactacccatttcctatggaattacttagaggagaagtttgtgaaacatttgggaacatttctccccctaaaataaatgctattttcactaccagtgaaggtttaagctggcattttggaaacacttgctatggcaacaaatgactttaagaagaataaaaagccattagaacagtggttctcagctgggggccgttttgacaatggggaactttagcaaggtctagtgacatttttgattgtcacaaatggctaaggtgctactggcatctagcagtggaggccagggatgctgctacacatcccatgatgcacaggagacccccacaacaaagatttactggcccaacacgtcactgctgctgaagcggaggaaccgtgcctcccaccattaaggtgcactttgatgaagtgtgtggcaggctaaattcagtatggtgaatatgaataattctgaatagctaggatgcataagacatcgttcttggcacagtgggactctaaaatgacgtttacctaagtaaagttaggatgacatctttatcctcatacctttgacaggtacccttgttttcatcaaaatttgtgttagctacacttaggctaaaatatttgtctttagtaaagtgaaaaatccttctgtaaagtgaccaacaattcacttagtttgtttttaaagtcaggacttttcattttttaggttttcttagtgtgaaatatgaactcatgagcatctggcctgggaactggaccagttttaaatctcgtgttgagagccggaagatgctggagaaggaatgtggtggaatgactgcctgagaatgaaccattctccagtgagaggtaaattaattatttcagggaactaggatatcaactagcaaattacgtcttaccaggcaccagatgattatctgtttccccaagttaatttatttcattgggtgaacccgccactccttaaagactagagtatattggttctacctgggaccaggtccaatattaataataattttcaaatgagctcttcagacccttaattcagctgttaagaagaagacaaataacgaaaggaatgctgcaccataattctgcccaggtttttttgcctgtgcattacccaatgatcaatcacaggcaggtgttctggggccagagaaaaagtggtaggaagctatggaaaagcagtcacctgggtccagcgatgcacccagaatctcccaaagaaacacagcatttaagagcaagttacagtaaaagttaacattgagatatgaagaaatctggtctgaatttgaggatgtggattattttatgaggatgtgtgttttattacagtcatgcatcacataacaggagggtacattccaagaaatacattgttaggtgatctcctcattgtgtgaacatcacagaaagcacttacacaaaactagatgatacagcctactgcatacctaggctatatgggatagcctattgcttctaggctatacatccatacatcatattactgtctgtaacactgtgagcaactgtaacgcaatggttggtatttgtatatctaaacctatttaaacatagaaaaggtacagtaaaaatatggcattataatcttatgggaccaccgtcgcaccaatgtggtctcttgttgatcaaaacatgttgcatgtgactgtactttgaaggatatataatcactaatgctatttacagctaagagtgacagtgctagccagaaaaagttaatttgcaatcagtttattgtttatatgcaaattagtcttctattttcacgttatgtgccttaacgttttggtccctgaagtagatttgagtctccctgaaatactgcatctactctttgtttagggaggtggtgagtgtggtgttaatggaaagacatgcagatctggaggaagaaaggtctgggcaaacttcctcaagctatctaacttctctgcaccagagctcatttggaaagtggaacaataatagcacctgcatttctgcctttctgatgggcaggaccacaggggactggaggcagtgctgggacagtgcatggttccgtcattgatagtctctgttcttcatagggaaccccagagtgaaggacggccaatgtgttttgtttgcatgaacacaaattctgagtgagtggggtttgtttccctgaggaaacctgacatcctgtttataatacttgttattacaaaggtggtggtttgtcagaggtgtatactcatcacctttaccaacacagaaaagatagtttgaaccaaagttcttccatagttctcagctaagacactgtttttggagggcaattccacagccacagaggccaggatgctggcttctgccagttactgagagcctaactcttggtgtttaattcccaactgaaaatacatcattcccagcaggttttccctttcgcagtctgcattcaggttctggagtgccaactctcctttatggggtcgaaggcctccatgatattgcaaaagacatgctttctcaagataggctggaggtaaaaaacctccatatttaatgatgctattctagtgaagcagggccttaatgatgataataataataataattaatggcacagctagagaactgacaaataatggggaacagatgatcccttcctggcctcaaaaaaaaaaaaaaaagtctgtacgcttgcagaaaatgaaacagatcctttcctggcaatttaaaactcagatgccgcagccagactcagttagtggtttctgtttttctctgtggagagctaaaagtataaaattccaactacttctaactcctgcattgccacatgaagcaaaatcaggcatatggcattagctctgggtcttaagtttagctgcagttctcacttcctaactggtcccaccagcaattttaagttcttttaagttgtatagtttctcaattgtgctaatgaagtgtaactttctcactctgtttttgcttctaccatcttttaaaatgactgagagttttaccaaatgggaatgttgggccgctcattatttggatcaagttgttcccttagtgctctgtatcctttgaggaaggtcaggtcatgctctggtgacaagcagtctatatctgttaccctgctaagtgaatctgaaaagcctcctaaccaataatgaaatccaagtaaatcagctcaggaagactctgcaaggtcctgctcaggcatctataggaacagaaaaagctactaaggcccattaagttgacttagaaatggttttcccactgctttgtgtctacctgtggcaccacaaaggaagagagggaggaaacaaagagttgttttggtttctgttaaggggagaagcagaacatcaggcctgtacctcactttgaaggatcatcacggcgtggttgaaatggtgatgctccaaggtagcagaggttccatagagttgggccagggcagagccactcctgaaagaggacagagggtgagtgagcagggcctatcgatggttcccccacaccagctttttggatcaaactgcttttcttgcttttggcaaaggaccatgagcagacacatccttaggtaactgcttttgtagtccattcatctatgaaataaatcgttcaggaactttctatatataagaaagttcctaatacatagaactttctatgtattaggctagatgctgcaaatgatatttgatgaatttgacacagtctctgcccctaagaaatttacagactagtaagaaagatgagatgagataacaaggaaaaataatgcacataaaaacaatgcaaatactaatcactgtagaaatgtgttccaggtccaatcgaagtgctatggacgttctgaggaaaaaaagacataatttctggctccggggatcagggaagcttcatgaactaaaccttctgtgacttctgagtgttcagaacaactgtcttatacaaaacgtatttgaccttccataggagaagaccttgtgaatattctgcagagtgcattttatctactctacatgaaaggctgacagccttctactacagctttccagtccatagtcacactgtgatatctcagtgtggaactctgaaaagttctctggatttggagggaaatctcagctcttcctccaagtagtagctttggacggttacttggcctttttaagactcagtttctttgtctctaagattatattatctacctaacctgttatttatgagaacaataaaatatttgaaaatgcctattacagttcccagcatgtagtagattgtagtctgtattaattattaatcaataattgaaacacatatgactatttccattttaaattagttaaatactcattgatacttaaagggattactttgagttatctgtaaatttcatttatgtagaacaacccattccttaacaatgtcagttctgcaaagcgttcattacttgggagtctgaggcaggagaatcactcgaaactgggaagcagaggttgcagtgagctgagaccatgccattgcaccccagcctgggcgacagagtgagactccgtctcaaaaaaaaaaaaaaagttcaaaaaggttcgtgtccaactctgtttaagaaatgggagttagagcatcttaagaatcaagagacatcccagagaagcccacagtgtaaacggcagccatgggactcaggataaggatccatctagatcattttgttctttcttgcttattgcagggggcttcgatattgaaagggcaatttggccttaacttggaaatgctggagattgattgcatacaatctgtcctgctagtgagagaagcaaggactgcatctaagtgcaacatgaagacttttggtcccaagctttcctccaacttcagtgggaggcagcccaaaaccaccgtcggttcaagaatacaagtgacctgcaattcttggaaagactcccccaattcttctcccaatatgtggtcagcttttccagcaggattaggttcggtaggaattattgaatataatataatataatgtaaaatatcggaattatttttcttaggtgcttagtaaggagggtattagattttaatcatatatgtgttatttctttaaatcttgccttaatttatattatttaataagtgaagatttgctaggcgaatcttagtgataaattaatacttaatgttagttactatttgtcttacatagagttcatttctatgaagacacgtgtttcaaaacgtatactatatgcctttgtcttggctgttgaaattctgtgatgctttatatgcatatcacatcctagagcctggcatagagtaagtgctttaaaaaatattggttgcttgtctaataagcttacagtagttactatgtcgagagattacagttcaagttgggaggttgataataagtgtgttagcatattttataatactaatattattattaataaagctaccattagtatctaccatgcggtagtctatatattaacaacttaatacattatagcatttagtcctgacaatgaccatgatataagtattattttctcatttacacatgaggaaaacagggctcagagaagttaagtaacttttccaaggtcacacagctagcttgtaccagttccagatttgaatccaagtttttaagcttcttgttacataatgaaaatgataattataacatacatttctgacatttgattctccatttttactaagctgattgttatcaatgaaagaagatttcaaaatctaattcagaattctattagtatcattgctaaccacaggctgattcctgtgatcattcctatgaatcagccatgctcacatgcacctcacttactagtgtgaatcttttgtatctagtcaagatacaaaatgttatctcttcccttattcatgttgggttaacagactccacaaaagctgcatcagctagatgatcagaagtcactctgtatcttctttgttttggtgaataaggaatgttttctcctttaagggagtggggatggggacgataacaacagcttttaacaaatacaccatggcttctgaggcactgctccttcctgtgcgtaggatggaggcctctctcccatatccatatgtctccgatctggtgtgttctatctcccagtatttgtgcaaaggcagccactgtctatggtttgaccatcttcctcgtcagattccctctttgttctcttttgtaattccatcttactttctgcccagcctcacacaatactgattcaatcacagaaaataggtagattttgccactgaaccagactaatgccatgaaagtgtggggagactttgttattcattcattcatctatcattcattcaaccaataagcattgataactattatgtcaggccccaggcatgtggaatacaaagagaaataagacatgttctgaccttcaggaagctcacaatcccctataattgtgtcaggaatttttctctgatcaaccttgcactaaaaatgctcacttttctgcaaacaaggtgccatcttagccctcagagaatggagcatggtactaactcaactttgaggggtttttttaaagtaaaaccatctaagcaagaatacttccatttccaaatggatcccttatttacactattagatttggcccctggcagattttctagactgccaaagccctcagtgccttttgtctcaggccaaggcccattaggaatgctgcctgtatctgctgttacacactgggaacttcctgggaccaccaagagccaagtctacagtcttgatataagtggcaaaaaaaataaataaataaaacatatctgtgaagataagctttatcaaaaagtattctacagaatactagttcttctgaatgttaaatggcattaagagaagaagtaaaaagggttccgtggccaaataagtttggaaaatgctggctttaaaaagtgaatctgtttatttatggtaaggattttccagaggcggcaatatgtgaaaatgcattgtgattttgtgggaggggaacataacaagcagcattatctacttttaattgattgtgaaacctctttttttttgagacggaatctcgcctgtcacccaggctggagtgcaatggcgcgatgttggcttactgcaacctccacctcctgggttcaagcgactctcttgcctcagcctcccaagtagctgggattacagacatgcaccaccacgcttagctaattttttgtatctttagtaaaggcaaagtttcaccatgttggccaggctggtctcgaactcctgaccttgtgatctgcccgcctcggcctcccaaagtgatgggattataggcatgagccactgtgcctggctgattgtaaaaccatttttaaagaggtcatgtctctcacataatacacttccacttataaaggtatgcttctactttctcacataaaatatgaaaaaaaaaccctgagatcaatcacatatggaaaaaattgactttaacagcacacctcattttaattgtttgtgctaagtatatccatcatataagtgtctttggggcacacatcctttagttgtgaaaatatgattatatatacatagggtgtatggagagaggaagagaagagaatccaaattccataagtacaaatacctttatacatgtaagtattcatgatgtgcattattgatggtaggtcatcttaacatactaaagcttttcattttggataggcagctcaatgaggagaaacttattaaaaagaaaagtcaaggtggaaatttccctataggcatttggcactttgcacaggcaccaaaaatgtgtgcaaatgtaaatgtaccttcataacttccctagatatgcatattctttgaaaaagagactgaatggcagtgtgcagctgtgacttaaaggaaactttaaaaaggaaaactatgaaaggtaattaggaaattgagagttgttgggagatggtgaggaatgggattaggctgtcatggcagattaatgtgccccagtatttcacttctgggacctggccgaaagcgacaagatgggttttcattcccaagaaatgagtataagagattatgctagaaatgaatagaagaagtctcctaggagaatatactacaaagctgcttggtactgatatttaatcatcaggggcagctgtaatagagagaaggatgagtggggaacgctgtccctagagaaaacaggggagaggtgtgaacagagcaatttcaaagcactgtggtattgctgccctctctacctattgatcattcattgtatgcactccaatacttaaaaattaagaacaaaatatgaaaatgcgaaggatcacttgtcagaaaggctaagagaataaatcaaattgtgctctaacgaaagccacactttttattgtagaggcattttgcattttatatagtaatttgtcccttgctaaatgtctcctgtttttttatagccttatatatgaaaaaaaggtagcatatactttgctgcataataattggtgcatttaaatcccattttcaaatcacttcaaagactagaattcgactgggagcactttaagagaagggatgtttgctatatctctttatttctcccacaattcctagcacagcatcttgaatatagaaaatactcacttactgggaaataaaaaacaagaaaagaagataggtttcttgcaagggattttctcaacaatggcacactcactgaataaatctcattctaatcaataaaaaggtagttccttgaccatgatgctaaaaagcctctttcagcattcatcgtcaagggaaatcttaacggaggttgggtaatggtggcattaagtgtcctaagtgcaaaaatgactccataaggtaggtgcagtgcccctgacatcccatgagctgataaactgcgtacaaagttaattgtcttgagaaaaacgcatcacactaccttggaataggcagatttgatcatgtgatgtgaggatgcaaaaaaactctctgaaatctagtactagtgactcaatacctacctcatatgtgtgaatgttgttcagtcttatacaagcaacctgagatttggggacctcggtttttgtttttttttgtaaaattgaggaagtgtaaaacatagctagtaaggtttactttggttttataatttttatggcttcatgtctttgaactgttggatgtcaaaatatattttagttcaagagctcacatatctggaaaggcagccaataaactggaagctcaacaactcaaaatagatgtcacaaagtcatggaccagagtgtgatacagtggttaaagaatggcttctgaaaacagacagccctggtccaggctccagtctaccacatgaatggatttgggcaagtttacttaccttcctgaggctcagttcctcctgtaaaatggagacaagaatatcaactctaaagagttgatgttggtaagggcttaagacacagtaaacaataaataaactgtagttcttctcattgtctcaggaagtgttagttgcaaagaacagaagtggagtacaaccagcttcactaaaaggaaggctgattgaatgataccaggaactctgaagtagcccaattttcacaagcatggctgggtctcctagaaataggaacaaggatggagagagccaggcatcaagcctgtcttttttctgtctttctctcaggttacacagtctctccgttctgcttctctttgaatatcagctccatccttctctcctctttgtagactggttttcttgtttttttcatccgcttggtatgtggtcatcatagcttttcccaaatggcagcctcagctcccaaatctgcatgagcctgcagcttggatccctgcagctaactgtcttaatatcacggtaatccaactccaaattcctgtgagataaaatccgatcggtccagctttgattaggtgtgcactgttggtcccaacagctgagggatcaactagcaagaagagcagcctctgtcagcgccatacaccagctctctctctggggaggggccattggtatctgagtataagtattgggcacttcactcttgaaagtactgaaaaggctctgactcttgttttacagacacaattctaacacagttatcccatctttctgcataagtggtagagtggtagggggctggagagagcatgctagagggagatacagtgatgatgataccattggcctgggggagagaggaatcctaaaaaagtaatgcagtgcagacacaagaactccaaacaaggagcaatcggaccctacaatgaaagcatacacaacgtacacaatgggctccagctgtttagtgcagcatcaagacaatgtataaaacaatgtttcattgcagctctattcacaatagcaaagacatggaatcctaaatgcccatcaatgacatttgattgaattttaaaaaatgtggtatatatacaccctggaacactatggaacactatgcacccataaaaaagaatgaggtcatgtcttttgcaggaacatggacagaactgaaggctattatccttagcaaactaatgcaggaacagaaaaccaaacgctacatgttctcaattacaagtgggagctaaatgatgagaacttatgaacacaaagaagaaaacaatagatactggggtctgtttgaggcaggagggagaagagcagaaaaggtaactatcaggtactgggcttaatacctgggtaatgaaataatatatatttaacaaacccccgttacacatggttacctatgtaacaaaccttcacatgtacccccaaacctaaaataaaagttaaaaacaaacaagcaatgttttataataatttataagaggttgcatctgttaaagaaatcaggaaactttgttaaagtgctgtagttaaagatatctcatccactcatgcagttatcctttgttcattcaccaaacatttattgtttattatgctcccccaagtactgtccatgcactgttgtacatgccaaataagaagggaagacacatctgcaagtcagcaattaaaatggcatgaagtgcacactttggaaaaggcacaaccagggcataggaaattgaccatgggggtacattagggtggatagaaacacgaaggtgatgctttcagaggagttttggggaaagaaggagagaagggcatgccaggcaggggaaacagcatattgggcagcagagagatgtgactgagcaggaccccaccagtgcttcttggagtccctgtgtctggaacatagatgcatgagtagggtgagctgcggcgagtgggcactgggccagggaaatgggcaggagtccgaatgaaaagggcccgaaggggctaagctaaggaactggaacactattctaaaagccacaggagatgtggatggcttttaagcaggggagtgacctggtcagctttgtgaattagaaagattattctggagtgccaagcagcctcgggaggagagtcgtgctgttcgttgtagcaaaccaggagtcatgccaagaagcagtccttgctgtaagcatgcagaggaggcactggctttgaggggagctgcagggtaggctgggtgactggcgcatttttggtggggccattccttggggtagagaatacaagaaagaggcatggagggaaagactgaggttgaggggactgtaggactttgaagaggaggtcttcctcaagcaatggaataagtgcctggagataagctgggaattatggttcaaagaaatgtattcagggctcatcagcagatggctggtggccctgcctgaaggatcgtgaagagtgagagaggaagagggagggcatcatcagtgaaggctggggcagagggacagaggcctgaaaccaacggagattcaaggttgtacaggtggatgaaaaccctttgtctgtgagataaaggaagagagagtttcaggaaggagggagcgacaaagtatatctcatggcaagaggtattatgaaagaaggacaacgaaaaggtccgacagctttgagaaaagggggccacgggtgtcattcctgaggtggtttctccaatgattggaaccggaagccatgtgggaggacaggggttgggagaagggaaggaagtgaacccagacagctttccatgaagcttgactgggaaggaaagaaggaaatagaactgaagctggagagtgaagtggggattagggtaggcttttttcaagatgcgggggagctgtttctattaataggatgcagacagccagcagaaagggacagcagatacaggagggagaggaagattgatggcacaaagtcccagaggagaagcaaggaagggtccaaggcagaggtggagggattagcctcggacgagggaaggacagccctcttaccgagataggagggaaggagggaaggatggggatggacagataagtttgtaggtggcaggggaggaaattgagagaattctcgattgatggcctcaattttctccgtgaagtaggaggcaaggtgatctgctgagtggtgcgggggaggcgggggagcaggaggtggttttggaagacacaagtttggtatatgaaactgctaagagcaatggggaatggggctggctagggacacagaaagactggcagcgagttctagcgtccagccaagtgggaggaatatatatttggtatgtctctaactctcacaactgtgacattttctcctaaagcttttataagtctaggcagagtagcaagagactgaattgttagactgaaccaggactgagtttctgcagagtggatgtcacagagacttggtcaggaaatgataggatattgagaagagagcactgaagtgatgggctataggatacagattggacagagggcacaaaattgaaattcatctgctagatcaggagtaaatacaagagtccaagactcctgaagtcttagtgggtagatgtttggaggaaaaaagagaatgatgagctgaaaagaacctgttgacaaagagcagactgtgaaagtttcagataatagaggctgacttgttctagaggctgtgaaatcagtcatctgaagttaatcttacctcttcgttgaggccttctctactttccctaccccaaaacttttctctccagcctctgaaagcctctgtcttttgtttgcaggcagacagtgaaagaaacattaacggcagactctcaatatacaagtcaggagacctgggttttggtcttatttctagcacccataagttctgtggccttggccacagtatgagccacaaagcaacagctatcttgaccaggaaaacctgcttagggacagattattctatctatacacatcatgtgtgtggcaaatagttgcccagacatccctgtatttctgtaattcctttgtttcttccacctttctatgggagtagggaatgggaggagcaaaaactatattccttgaacgtggctttattttactatagtttatataatacccaacatcaaaagaatcctggaagagactctgttggagaaggaaaactatattttgcttcatcaaatttcctaagactgcttttattttaacagtctcacaccagagtttgagagtagcaagtccaagaagcttataacgccataaaggcaaatattctgggaggaaaaaagtagaccctttaaaatccaagctttgttatctgagtaaggtcaacagagaccgaccaaatcaacaagcatgacatgaagggcaaatctgcaattaaaagaagaatagggaattataaagatggatgggccccatgacatgcacgcccaagcctgcatggccttggcctcggatgccagaaattaatgctttactctttagcattcgtcacctttggctctgaacagaaaggcaaatgcattaaaataacaacagtttagaacacttacttagcttggaaggcattgttggttcccctgtggtcgaggtcatgacacaggcatcccacaatcaccgctaaaatttccacctcggtcagaatgtcttgaaacccagcagtctgggaagaaggggaaaatggcaacagtcactactggggtacggaggatggataaggttaggtgctgagcaacagtcaactctgttttcatacccacatcatttaaggagatgattaactgccactccctcagacaacagtaagttgggtggtcagttgcacagcctaaggtccccacagtgatgaattagcttgctgtcacagcagcccacgctgccacactgggacatagttcagactattttgttccctttttagagagaaggttggactatccagagacagtgacagtttagcaaaggcccagggcaaaatgtgttttgttattatacattttaatgatgagcatagggtttggaggttggaggttggggaataggaaggggcagtgaattgcaaagtgaacactacacctgccagatcccacccaaatgagagcaggcagaaggagaacacaacccttctttttttttttttttttaacattaaaaggagacactttaacatactcaaattgttatacaatgacatcctagaggttatcttgtaaataccctaattcatattaggttggtagacagatgaaattcatacagataataaggcagtgcatgtcatggacaccagaatttgtcagaggattgtcaacccagactgaggattgagtggggtatccattactgggaattcttttttcttatcttgtggtagcttgctggtgaaatgcacagctgtgatgtgatttcttttagaagcaggttgacataattatgtaatcaacagcagcaatgcttcttgggttgctgctggccctttcattagtttagaagaggaagtggacctctgggaatgcaggtctatgcattttcttgatcgaaggcctttatatctccccctcttttactttgtaagtctcccatttcattacttattaaaatctttatcagagagtgggaggagggggaggattagggtacaaattgcttcacttttcatgtgtttttttccaccaaatctaggatcactggcccacacctgtaagacacttctcttagtaaaatgaaaattttgtttttaaattggttatgtttgtgttgcagaaataactgaataacaggtttctgtgttgacaattttattttttttttaggagacagtcttgttctatcacccaggctggagtgcaatggcaccatctcggcttactgcaacctctgcctcctgggttcaagtgattctcctgcctcagcttccccagtagctgggattacaggcacccaccaccacgcccagctaatttttgcatttttagtagagatggggtttcaccatattagtgaggctgggctcgaactcctgacatcaggtgatccacccatctcggcctctcaaaatgctgggattataggtgtgagcctccacgcctggctgacaattttattttaataaatagacttgggtccactgctacatttagaaatacatataacttcatttgtatagcaaatgggaatgttaataaattgggagtatgaaatagtccatgtcaaagcttgcatatgccggccaggcacggtggctcaaaattgtaatcccagcactttgggaggccgaggtgggtagatcaactgaggtcaggaattcgagaccagcctgatgaacatggcaaaaccccatctttactgaaaatacaaaaattagcctcgcttggtggcacgcgcctgtaatcccagctattcgtgaggctgaggcaggagaatcgcttgaaccgggagacagaggttgcagtgagcctgtatggcaccactgcactccagtctgagcgacagagcaagactccatctcaaacaaacaaacaaacaaacaaaaaagcttgtatatgcccttcattttaaaatctgcagttggctgttagtttttctaagttaattttattttacttaaattattacctgcagtaactaaaaaaattcaaattatactgagacttagaactaaaaatcagtagtccctcattattctcctttcttgattcctgaaggcaactactttctattttctttttcacctaaattcgtagttttcccaccatatttcttttcttttttcttttttttttttttttttttttttgagacggagtctctctctgtcgcccaggctggagtgcagtggcgcgatcttggctaactgcaagctccgcttcccaggttcatgccattctcctgcctcagcctcctgagtagctgggactacaggtgcccgccaccacgcccagctaattttttgtatttttagtagagatggggtttcactgtgttagccaggatggtctcgatctactgaccttgtgatccacctgcctcagcctcccaaagtgctgggattacaggcgtgagccactacgcccagccccccactatatttctatatagcatgcacatattattagcacttggttattcaccaagtactcatattgtcctttctatgtaccatacattgttctaagagctttacagccatttaacttatggagttctcataacagtcctgttaggtagaaactattactgtccccagttatagatgagaaaactgagtcacagagaggctaagtcatatgcccagggtctcccagctagtgcatagcagaagggagcaagctcctagcatcctttcaccagaatctgcccttgaacactggcgacgtctagcagcgggtgagtttatggtcaccctcccctcacactcccaatgtgatccacagagctttcctatattaccatcctataaatatcattcaccgctgagccaaccagtatacaatgattgtttccttaataatgtacattttcttgtttcctggagttaggatttctgtgaaacatctaagtcttctcacaccctacacaattctgcaaaatgcttctcaaagcaattttgaagtgggtcagaacggtcacagcttgtttctagatccttcctgtcctggggactccttcctgcagcctgaccctggggtctggtctggattctctcctctgctgccagcagccctcggagcttcctccaccgtcattcagggggttcctccttcccctcctgtgtctggttccccacctcctgcagcccatgcctttctttttcctcatttactccctcattttacaggagcacatctgcaggggcttcatgagaaaaggtcttactgtttttaaacactggaggagttggttgttttcgaggatttgcatgactgaaaaaacatctttattctattctcgtactcagtgtgcctcacaattctaggctgaaacattttcactcagaattttgaaggcctgctctattgtgttctagcttccaaagttgctttcgagaagaacataccattctcaatcctaatactttgaatgttatttgattttctttcttttagaatttcctctttatttctggtgttcagcaatttcacagagatatgctttgggttggaacttttttccccgttcaatttgtgtgttaagcctaatctggagaatcaatttcttcagcacaatgaagaaatttactaatctttttttcttttcttttttttttaaaataattttctcttcaggagtttttttctgccctatttgaatgaaactccaattagttggatactggacttctggtactgattttcttatctcctcttttctgtttcctatataggtctttcctcttactttccaggcataataatatgtttagtttataaaaattttcttgtttgctgctccttgtcttataatagcatgctattcttctcccatggatgcatgatcttttcttgtctttctgaagatattgattataattcttctgaaaatttcttctgttccccgtattgccttttttctctgaactccttcttttctctgtgtttggtggtttctctcaagtgtctgtctggtaacctttggtggtcttttcattcttaagagtaaagcatcacaaaactcactgtgcaccagtgtatgtgggtggtgcctggagattgctgtgtcttatcacggggtgactgtgtggccagctggtcttttgctggagatgcccaaatgtcaacatctaaactcattttctctggactttccaatctgttgcctgggaatggtgtaaacacgtgtgttggcatcctgagaaaagagaactgtagctgtccacctgtgaggatgtaggctttcacttaatcctcttattttgagtgtgcacctcatcctaactttgctttaggttgtgtacccaactctgggattcagtttttctggcaaatactctggttatggcagaggcagggggaaaagtagccctccagctacagagaggggatggagacttaggcactcattgtttccatcactccctcattccacatcacctaattttcatggtatctgaggcctccagttcctgagtctcgttaggtgctgggggtagcattatttcttatgggtaccccttcctccacaccctcacctctgaagacacttgggtttctcttctctgctaagttatgaactatcctcccttcactttctgccttcatgtgttatgagtccatgcaaggcaggatttgtgtacatttctttctctccgtattatttgaggatgatttttgagaaggggaggggggataaatgtattttgttgtcatctctatcatcttaaaactcaaaatgttgagtttggtcttgctaatactaggtaaaacttgaaaagtctatcaagtatgaaataattacctatgatactccagaaataagtgttgtgcaatgatattgtgctaaaatttagagagactttgcccatggaaaagctattgactagaattagctgatgaatcagagcagtaagttagagataatgttaaaataaggtaatttgactagaaatttaatcagtagttaaaatcaaatgccatctaatagatttgagatcaaaatccccagccatttttaagccatcagttatcacccattttataataagatggaacatattttgctaaaatgttccacacagtccctgtcccctgctctgcccagaaatctagcatcttggtcttaaactactggtatcatggatacttttaagaacataacagagccctagactctcttcctagaacattttctataattttataatatcaaagactatggagcctatctctagatcctcggagtagagaatccctgaagtacagcacccacacacagtcacacaaaacatatttacctctcccgacggtgatacctgagttactgaagcagcacctatctcttgactgtgatttaaagctgcctggtaaatggtttctgggagtcatcaggcctgaaaaatgcccacctgccactaagtgtccttttgcccctcccccgccctcatccatcttcctcccagggctatccattcaggcctgcacgtactgatattgagtagaaaaagtcaactgcctgctgaagacaatatactttcaaaagaaaacagagaggcggcaggaagtatattttaatgcatttaccccattcttgactctggtttattcttttattttcaaataaaattatatttttctgctcctgacccaatcattatgggttttattgagctttaatgttaatatatcttctcacctgtattccctcacagttcgtatcagaaataataagcagtaaatacaatatatctaagtaaagagtcagccagggcatataaacctatttcccatgtcaccccctccagcaaagcctttcacctgtcctctgagcaggcctccaatgatattccttcattgggctgaaatgtatactgggataagcctacccccagccactacggcatataataactagaactccaaaagacccaagccagtaagattgattctcagggtctcctggactacccagtaatttctatcattagccaatgtaaaatttaaatcagccaggatgtactctcattttaatgttgatcctgtatgataccagtgaatgggggaatatcatagccagagaaaaatgactgttactttgtgactctgttgaatccaaacaggtgtaaaaacacccataatatcaacactagatggtgctatagacaatttactaatttaagaagtgtcattaagtgcctattatatattgagcactgggtagatttgagaagaggcctgggataatgtcaacaacagttaacttttatagtgcttagtatatgccgggcattttcctaaatacttcacattcattagctcatttaatccttacaagaactctctgagacaggtaactgttcttatcttcccattttgtagatgaaaacattgaggcaccaggttacaagactacaaagtaagagaggtgggataaaagcccaggtagcctggctccccagtctgtgttcttacttactgtgctacacagcccctaagttgaggtgtgggttcagttgcacagcttttaaatcctattgtgatgatacagtgttagataatagggctgtaaagaatcccttggtgtgtgctttatttcacgaaggacgttattcttgagtaggaagagattgatactgcagagccattggatatttttagtttaaatatggctctgtcacatcaatatgtgcttgataatatacagtgctttataagtgaggtttggagagaaaagaaagatacaatagtttgtaatatctcaactttataaaatgtttaaatatatgtataggaaaaagactgttaagatgtatatcaagatattatcagtagtggaattacagttggcttaaattttttcctttgtgtctaaaatttccataaagaacatttgtttataagaacatctatatttatacacgtgtatgtatatttgtacattcttttttgtttcaagaattagcccacacttcatcaaactgtcccagcttgaaatgaaatagtgatattctaaaaagtgtccattcattcattgaacaaatatttattatttactgatttcctggcactaggaacagggcagtgaagaagacagccgccccttgctgcacatagaatctggttacccttcgagccagcagagcagtgccacagagcactgttttctaaagagaagctgtcataacattggttgtgctttgtggaagacagaactggtaggaatgtccagctcctcctgcttggtttctggaggaggtgcaccatggactgcacacccttgccatgtgtgcagtcctggctcagcaatctgagaaaatgatgccagaaattctgctctcacctttctttttgaacccaactatcggaagtattgaatgataagggatttcctgatgagttcatcctgttgattctgagatgtagcagatggcaaactaagacagagggaatctaatgatgtactagaaattcctaatggttgcagacaccctaaagctgaagacagtaggctccatatgctccaccatggattctgatgtccaggcactgcagcagagccctaggtggattggctaaggttgagggacaatatgatagattttggagagtctttcttcctcttcttcatctttctcactcttttggaaaagaagaggaaaaagtacggctcagacaattccaaggggttggagagacatggtttctcaaggaggtgcctcctctagaagagtctgcacaccatattcctaatctgtgtcatcgtgcctttgctgatctatagatggcttgaatttgaaggccttatgagcttggaacagaaaggcagtatttacagaagaagcatttaatttctggtattttaaaatttctggtacgtagagtgttgcagggtcactctctggggtctttgtttggtacattattaaaatcacatttatttcagccaaaaaagtgctctttgaaggtttcattgtaaatgccacaaacaagatgctcatatcatcttaacaacaaaaaaaaaggcccaatttgcaatgctgatggctggtccagctctgctgggtcatacttaacatgaagagtctgcttgtgaaacttacatctcctaatggaagctgatggttctataagaagggtgccttcaatcacccccaagttcagcacatatcccactcatgggtggatcacggtggtcagagaattgttagggcaatgttagggctccatgtgcatggacagcaaccccagtatgcttctttttgagaccctattttatttgctttgtgatggaatggcaaccactcaacatatagatcctaggggcagcctaatgggtatcaaactgttttatatgctccaaggcaataatattgagcagaggactatctcaagctttggagtggaagcagatttcaattgcttactaggagtgcttatgagtatttatactactggatgtcgcagcataccttctttttaaaaaaggatcttacctttgtcaatcagagacagtgtgtgatgaaagcataaggggaagaacaggtatgcaaccacaaacttcaatggaggggaaaaaatccctactgagcaaactatagcatctagatttagtggtcatactccctcggcatttacagtaaagtttgtctaccaataaatgggtctgctgaagagaaaagggggcaccttagccccattttgaggtccagagaccagaacctttccagctgatagggaatcaccatctaggaccaacaaactcacatgtctcctttaccagagtatgcaatgtaacaagccaattgcaggttgtctaattattcatgggaacgggatagttttgattgaatttgcttatctttcttttcaagatgaatgcaaccaaatattgatttggcattaattaactattgatttaggcctaactggtcctttccttaccaagctcagagttggaaaaaccttacagtctatatataaatgactttctttcccaaccagaagcttctgaaggcacttactatcaaatcataaaaccttagtcatgttttgggaatatgttgaccctttagcctcaactacggttgcaagtgcttgtgtatgtaagtctcagaaaggcaacacagtccagtacaattacatatgttgcgtagatgtttgatgcatacatttaaaaattggattaattttatatataactttattattatattctattacatttataaccacttctaaggcttaatttttaacctgtttattagcataaatttcaaattctttattttggagagttaaaaacatacaaaaaatagaataccattaatataatgaacccagtgcagtcattgcctaacttcagcaggaatccaggttttgcggcttgtttcatctgtctcttcacatgcagtgtgtgtttgttttgttttgtttgctagcgtatttcaaagcaaacctctggtatctgtcaacactatttcattctcaagaagtcctaatgtggtcaaataaaatttgctcaatatatttctgctgtcttattttgataaaatgtacaaaaagatatacaaataatataaggaaattttcaactaaataataagacttgagaaagtggaggtttctacatcaaaagataataaataaacatagctgtatgtatatagcacatataatgcattttaaaaggaaccaaaagaaaaatatcagattcttaaggacttagctttcaaccctaacaatatttgtgctttatgattttttttgaggacaaggacggtatgttttgtccatgtttagaaatataatttatattttatttctgataaattaccagtgaactgcatataatataacatatggtttatgaccacagaaaatgaagcagatcacttgctgcacattaattgtgtagaaagacagatctctcaaagtgccacagagcccaggttggtgaatttcaagaatttgaggcttcttcaaagctcaaatttttattagccataattcagccgaaactaaacttgagacccatgaaaatttaaaactttttatagctcccaacttaacacccttaggtgccaggtttcagtcccaagaaagtgccactaggaaatcatacaccgtggaaaatggaggctgtgataaatgaccatggctctgctgctgggtctccctgacctggaggatttggctggcgtcataaaacacaaagcgacagattaagcagtttaccaacatcataaaaatctcaagaataaattcactttaatcaaaaatcctatattgtaactaggcagccccagcctcgaaaccacatacatttacgtataagcctatgtccgtgagcaagaggttatactttccctgtaacgtcggacatgattatgttcatacacttttacaatttacatgtcctaagaaaaatacccagctctggctgatggtgcgggagaatttattttcactagaaagggaatgacccataactcatgaatggcagcgcttaaagtgagttatggaggttactctcctgtgagaggaaatggattggattatccttctgcccaattgtatgtttggttattagcacaccaggttcttaattatgtgcagctttgccttttttcttttataaaataaatgtggataaaggcaatgtcagctggaagcatggagtgcctaattggggctctgagatgcagtcagagagaagaaaaatagaaaccttttttaaatgattaaaagacaggagtcttaaatgtaatttaaacacagtattcaaattgattagccccatagttaatttattgtgtctggtgctgatgttctgcaaaaacatttaaaaattactccttttctaaattaaaaatttgccatcttgtaggttacatttgcatgaagattaaagagttggttattctatcatgtagattttattatagtattacaataatgctgccatttattttaaagtaaatataacaagttactacttttttgataaggaaatacaatgtaaaaatgatgtttgatgattacaaatatgattactgtttattaatttatttcagtcagttacagaacaaaacatctagatctctctgtaacttccagtgttacagtctacaaaggaatttgatttctgttgagattaggattctgattattgagtaaaaatattttatttaaaatttcaattggttctgtatttcttggacagggagggaggagtttcagctgtgcttctaagatcttccagaatgaattttctacctcaaaaatcaaggacttttctggaaactgcagtcagaggacagaacatcagcctcaagctggtaaataggatggattttctccctaaacatcccttctgctttctagtttgaattatcaataaaatggtttggcttatctctgaaaataaccttgttgacaacacaaatatggatttaaacacgctacctccacattaagatttaagaagcccccagtaaatgtcagggggtgtcaatgtgtttgctgtgatacttggttattattagtgtttaactgcaattccccaccagcgccacgctgcctgcaccaccataaattttaatgtgatcatgtgctcttctcttttcatatccagtgaattctgcaagatcataatattctatatgaaccctagctgaaccttagtgtgatatgaagaaagaacaagatttcaagcaataatagttgttcaccattttatagctttttttaactggacactgagcaacatggttccttgaataatattaccctaaactaaattcactcattcaattaatctttattgataccctacaggatgcagggcatggctcaaagtgctaatgagtacatttatgggatagtaaagaatactgactcttaaagaaatctttttttttccccttggaaaatctgtcagagctcatacatcatttataaaaccgaaaaaaatgtctctgcaaccttggcaccactacatgccttttattttacagaatacaaacaaaagcagagtcatttccgatatctagtctacatcgtgaatataagaaatatgtccctcatcttttatcatgtatttatagttataatttatttattatgtatgtgcatgatggaatatttgttctataaacttctattagtaaagaaaatttatatgatgatcattcatctgcaggttttcttcctcattttaaccacaaataataactgtcactacctactgtatttgtcagaggaattcaaagtatttgggaaattttaactatctaaatatctttttaaaaacaaagaataacattgaagctttcaaatttataaatgtgaaatttcagaccagaggcatggaacaaattaataagtcattaacagggttcccagtgaataaaatgttcatcattttatatcaatttgcctgtcctacacagtagttctttttttttttaatttctaaaggaacaaaaccgctttgttacctacacatgaacctgaatacttttgcaaaacacaatgctgagtcaataagtttattttccacccgtgaagtgattttagggttaaaggttaggaagctggggcatatatttataatttgcttgtcctgttgtacgtggtgccaaaatttgttcagcagtgacacacaactatgcatttccccattcccagagacaataggcttggaaaaatacacaatcacagatttaaggtcacacggagaacactattattcactttaacagcacggtatgcaaggtggcagtcataaaacaggcccatcctgatgggagatgctcttttccgacagactggttttgttgctatctcttttaggaaaaacatttattttgtggtggggtgtgtacctcagtattccctgtgctagaagaaaagaagcactttcaaggaaggtgggtaaggttttttcccccttttctggaaaccagctgagaaactttgccttggagcgccatctagaggaagcctcagcacacacacgctgtgctttcttagccttatgacatgacccaggttgaatccaatggttggtacatggtgagtttcttttcttttctttcttttttccccccagattaatagagaattttggttctaacacaacccacagacaggaaatatgagatcactggaatggaattttaatcactgataagatcaaaacattgaaaggcttttagaatcttcaggagtgccaaaagcatgagtgcccattggtggtaagaaatagggcatcattttaccataggccgagtcacattccagagatgagaattgatgagcgagttaaatttatttttagctacactgattgagtcgtctttgttacttctgtaattattttcttaattaaaaaattctgattaaccagattgaccagagtcaagcttggagaagatacttacgttagagagaaacaaatgttgacacttttaactgactgtaacccttagttaagttcaacaaaatttaatgagcagaaaatactatcttttccagatgtggctactcaatacaatgtgaaggagaacaaaataacgttgtattctttctgaagtcatgtttttgttttgtgatctcctccacccaccctccttagagaaatttgacaatgaagtctcctctttctgtgttagcatgaatgcaaaaaaacaaaacctaagccttctccaacaatgctgctcttcaagattgctgagcatacttgcaaaaacaactgtaccctggaaatattctgacgatatgagcatccccattgtggtgacatagtttaagaattctattctcttcaatttcttggaaaggatcaaaattgcccatataatggaaatacccactgcagaaaactggatatatatttccttttgctcctaagtgtccactgtgaccctgctgctcttgccagtttcccctattccaactattttaaggtttgttataaaaatctgtctctgtccttgacatttctaactcaaaaatgtcacagccatttctttttccttcattgaacagggttcctacttacttattttggcaattcgcataaatccataggttttcccaaataatgggttaaaaagttttttattgaatgtcctctgtgggccagacatatgaaatctgtacacaaaacattataccttgtttactgaggtaggatatggaaaaacaaaatgaagattttttttttccaagcaatggttgttacttgagctattaagcctcatggttcaaagcaccttcctttctcacttgatggctcactcctctaacggtggatgcaacagaagaatggaatcagtccagttttcccaggccagtctgcctgtttattaagcagttgaggacccaaagcacaagtccctagtataaaagacattctggccccatcttatgctagatgcacatttcagctcatgtcaattcaacatacattttttgaaaacccaccaagtacatgacagagtgcagggtgctggtgtgaccctcaataaatggtggttgagcaaataagtagatgctgttgaaaaaacaagaaatgatctcttccctcagcagcttactctataggaggatgacagatttgtaacttaaaatacacagtagcaagaaagatgtgttgtactagatacagtacagggaaagaagtaattattgatgatttgggagaaaggggaagactttgtagaaaaactggcactagatgaatgccttaaaggatgagtaaaattttaataggcagaaaatgaggcagagttttttttttttttttgagaaagaagcagaattgtctttgttcatttggaccaaaggaaaatgcatttcatttggcgttctgattttgtgtttaaattttagtctgggtgcaaaaatataaggtatttattttatgttggaagagtccaagactcacattctttttttttgtatggcaatatgtttacacacacccacagatatgtacgtacacatgtgtgtatatataactatgaagccaaagaaaccaacatatttaagccagaaaacattgtacttgatgatagtgtaacaatgtagtagaaattatgccaaaaaaagccttatttcttgccagaagaagtaaatagaggatttgtttcaatatttgccacaaacatttgctttgagattaaattccaaggcttatatctgcccagctgcactagatatctccgtgaaacagactggccaccatcactgggttaaaaccccacgggacgagattttaaggcaagtaagccctaaacctggagagtgcgcactcttacccctcttttctccttggcctccctgggcattgtctcaaataagcatcctctcaggatttccatattcctgcgggtgatgttcacacctccctactggctttccaccagccaagagagtcatatccagtgatctctttgttctgttactcaactacatttcctctgcaaaaagattactttaaaaatctgagcatttcttttgtaaaagaacaagtttaccaagaaaaaatactgaacagaagctcaagtaatcattccaaggctacactggcttcaaggggtcaacaatgttacagctttcaagctcagaaattgctggcacatatatactttcataaccagggtaggtaagttccaacataaaatgatcacatggtaatttttcagagaaatggaaatgtaaaggagaaggcctgccagttcctacgaatgagaaatgatcttccaccatcactaagcacacttacggttaacatcgcgaacatcagctgacacacgttgaaggcatgtctccagttgtggtatagaaccatccgatagtttttcctcactgtcaaaagccacctacacagtgtctgaaatgggagggagagggtgcgtcaggcagttgtaagtgattctagtggacccttatctcaatggtgccttatatctgagtaaccctcagtgatcaaaggccttccacaaacatctcttctggttctcacagtaatcccatgaggtgtgcagggcagggattatcatccccattttgtatttgggaaaccagtggttcagagtggctaacacgttgtcccaggtgaactgcttggatcacccaagacagacatcttacctcatagtcaattttaaatttctgtaccatccccagctccatgaacatccggagagcagctgtgatcatggcatcaacgtcgagagaaaagtcatcaaaatgaatgtcatcgatggcaagttctgacaccagagggatgttggctgcctagaaaagcaaaagacataagtcaagccaagttcaccagctttcccaaacccccatcctgctctcctcccctgcttatcagaagtgccacataaatcaggcctgacctgcacttacaccctgatacagctaaactctgagctgtaaatgtcttttgtttctgaactgcaaatgccccaagcaaatgaaggtgggggcagggttgggggcggggggagggaaactaatctgaagataaaatacacgcactggatctagcctgcagaatttataatacagaactgtcaagtttatggaaactgtggtcatacaatatattctgatgcatattacagagcactaaatgcaagaaacatctgggcagccagcagctgtgaattttaattgatgctattcaggagaaggagaagggaatacaccactttgccttgtttcttatatccttatatcctgtagcttgcacgtgttctttgttacacacgtgttctgtatattcagaatgatcgaaaggatcagacagcacatctctggtgggaaatatgttgccttaataaaatagagatatctgaaggtttagcataagcctatgtttcactgaggagatcaattttgctttcttgtttagcttcattctatataaacatcacaacataattacaatactggtcatacatattcaaggttttcaaaacacccatgttaggcaactgtcaatcagctgcccacaaacgagcctaaagaggagaaaaaaaatctttggaaatcatttgtatggtgatttcattgggtttaccatattctttggatcactcttggtaagggagtcacttttatattttcaggttatcagagaccattctgtattcatattcctatctattcactgggtttaaattaccctgacagtaatttatgccctggagctacttactttggctaagagattcaatccaactctggctgctctaagcattccagaaaccacataattaatccttgcttcccaactctatgctcctccataggtggagcttagtttttccatgtacttgcaattaattcaacccctaaactctctatcagttgtctaagtctcttctcaaaatgttcatatgctttgggcattccgtcagtttcacgaataaatcactcctggaacttcccgcatttctccagtctagaccaactatcttataagtctgatgtgtagttttcatcctaggatattccttcaccataattgtggggatgcctttctctctttcttttgtttctctagcccacatctttctctttcttgctttctcctctcattttggtgagacacatcctctaacagattcccaagaaaaggtgtggggtagatttgtgaggctgtgcagtctgaaatgtttttgtattactgtcacatttcattaatagtttgcctaggtaagatttctaggttggaaatcattccattagaatgttaaaggcattgctctttgagctttcgatgttacttttgagaagtcagaagctattctgtgctattatactttgaaaataactcccccctccaactgagtttttgtagaatctttttgcttcaagagttctgaaatgtcatacaaatgtgccttggtgtgagtttattttcattcattatcctaggcactttgtaagcccttttcttttttccccctttttttttccagtgtatctattacaggtttttgctttgtagttaccatgaggcttagctttagctgtagtaaattattttaaaggcttatcattagctataataaattattaagatgacatcttaattttgattgcaaaaaaagaaacagagggaaaaaagatacttaattccatccccctctgcattttgattttttgttgtcactttaaatcttttttaaaaatttatttattatactttaagttctagggtacatgtgcacaacgtgcaggtttgttacacatgtatacatgtgccacgttggtgtgttgcacccattaactcgtcatttacattaggtatatctcctaatgctatccttcctccctccccacaccccacgacagatcccggtgtgtgatgttccccgccctgtgttcaactgttctcattgttcagttcccacctatgagtgagaacatgcggtgtttggttgtaagcccttttcttaattggaaaattatgtcttttaattctagaaaaacattttaaaataagctctttgaagatctcttcctctctttgtttttctgaaattcccttaacttgacctttggactggtttgtctttcttttctttttctttctttcatttctcttttcctttagtttttattttctttttcttacatgtttttcatttctcatattttttcttttcctttttgctctgctttctaggaaatttcttcttactgttgagattttaataccacggttttcattctaagagctcttcttttgtcgtctggatattcctttttatgtatttttaatagtaccctaattttatttcacggatacaatattttctcttacctgcctgaggatgtgaatgacaattctatttgtcattttcttctcttcttataattggcttcactctctgtactttgttttagtctctccttttttattgtggtaaaaatactgtactgtgtacagtacagtagtgttaactatatgcacattgtcatacaacagatctctagaactttttcatcttgcatggctgaaactccatacttattaaacaattccccatttcctcctcctcccagctactgacaaccaccattctactttctgtttctatgagtttgattactctacctcctacaagtagaatcatgcaatattcgtcttttttgtcattggcttatttgactcagcataatgtcctcaaagtttatccatgttaaagcatatgacaggttttcttttttttaagctgaataatattccattgtatgcatataccacatttttgttccattcatcaatcgtttcatctctgtcttcatcagccaactttcaagaaattattttaatacattagaggctttagaaatattagaggttttccttagcggcctgataatctttagttttccactcctgtgtaaaagtggggctctaaaagtttctattggagcttctgggggcttctctgtagggggaatgtgtctgacctgtttccttggggaagccaccaaatatcagtgtctttgtgtctttactctttagctactcagaatccccagagaagagtcttctggctggagcctagcggggaagcaggttggaggaggagtctcagcattggtttcctgttcattcagtcctcctgctttcaccctgcacgcccaccctcaccctctgcactgacgattccctaacccaaagacccaagattatactctctccagaggacaagcctctagtctttatggagtgggggagtagaacaaaggatatggggctctaactgcttcttagactctctgttttcctgtttataagcccatcttcatttgcacttccaaaggtacttaattagtcaattcctgagctatctgtggggaggagtctatggtataaatctgcttgcctctcagcttttcccattgctaggttattttggctgtcttgagtttgctaaattactttctattcatccatctgttttctagcatccaaaattttgtcaccattaagtcccttcccaatttctttggctttgagaatttatgcactaaaaaaaacctttatttttgttttaatagggcatggggagagaacaaaagaaaatgagtgtagttaatctatcatctttatccaaaaataaatgaagttatctttattaaatgatacctagaatggtcagcttggagaactcagagggaagccagcctttggtctgtaggccctttgtttctatgtgcacacctggctgcaaccatgtagatctcgttctcttattctgcgcccctgtgggttcacttgtgccagtgaactcacttattaggctgtaacaatcttagaggcagatgccatgtttatttttcttagggaagatccaaacaattctttactcctatcatgtgtttgagggtttgtaaatagagaataccaaggtctcagaaagatctgtgcttgtggtaatttgttccaattcaaaatcaaatgttagtgggaaaaacacttttcaagagatagaggccctgtcccaaaagacacaaatctttctggtctcaggagagaagtttagttctgaattggcaaaggaggctgaaccttgttacagtttgttaccaaagaagcagaaatggtgatagaggcagcactactccactccaggtggcccctgtcttgtagattattaatagtgtattccctgataccattataaatcctctaccttccaaaggcactaaatccacttaattatcttaaaaattaaagaatataggaattttttcattatgaagtgttaatggaaaggaaataagaacattacgttgaaaatgtaaaatgacctctggttcaccaagacccatccttattgaccttgtctttttttcccctaataggttgattgatccatggttaaatcataccggtgtgtagatcacactaagccctgccataaacccttgctggcacttgtagatgaaagaaagttccaagcctttcaagaatgaccattttcagctattttgagaagtctgggtagttttcatccccacattgctgggttcaagggcaggttctggagaaaactatgaagagtaacaggcagtatgtatcctgagcagacaagcataaaagatttgggaatagccttccattgacaaattccttgttatagagacacagtgctccccattgcttccagtaaacagaaaatgagattgcatcttccaaacctataattactctagccataggatattaacaaaacaaatcaaagtcaatttctccaaatgtcagtcttcaacttttcaatatttataaggtgtcatatccctaaatcaaagaggagtgccacaatccaaaataactactgaattaatagccagaaaataacatttggataaaagaaccatttactttactgcagcaataaatgaaaacacagaattatgagtcctggagctaatttgaataatgttcaagaagtgagactctagctggctggaagcacctgatatcctttgaccattcctcttctttgtttgggtcttaacagttaagtggttatcaaagggagtcataaaactgcctcctctaaaattgaaaaggtagctttacaaagaggccataaaatgttaaaatacaatcctggatcccttgacacatgaatattacattttgtgatgctcagaaaatgggaagaaacaacaaagtgggtggtagtccagccttggcaattcaaaggaaaattgacttgttgctaattccagcccactcactctcttaatcctctggacaaaaagcagtagtcaggagccttacgattctgggattaatggagacaggaggttgagctgtggtgatgtggaagggacagcaaagttctttcttttgccaatataattatagcccttattatgtgccagatactgttttagtgttatgctttgcatatactcactcatttgatgttcacgagaaccctaaaagcttgggaatagttttaattccatgttatgatgaggcaactgaaataaataatgaataagttggtcaaatttgcagtgtgattgtcagaggcagatttgaacctggggagctttgtgctagagactggctcctaaccatcacactgcctctcaaaatgggcctatgccaagcgagggtccccctttctgtattatgcaaactaacttgggtgcaccatgactggagtttgggatttatatccagatgactagcttttcaatccgttttttattataagcaacctggacctatgtgagggacaatgtttttgtctttacctatataaaactccttgggaaagtctccaaattcagagctgactttggaatgaacccaaattgttactttgtgttgattgtagctaacccagaatcaactcgaatactcccaagaccatgctgaaaaaataacttgtcttctcggggagcaaacaatgaggaggtgacaaacgaggagataaatagtattagcagaacagcgatgttatgaaaaagtaagtttttgcttgatcacaggagtttgaggctgcaatacactatgatcgcgcctgtgaataggcactgcatacactccagcctgggtaacacagcgaaaccccatctcttaaaaaaaagtaggatttaaattctcctggcaattgttttctcttgatgccattcattaaatttgccttgtagttgcctagaacactcttcatgacagatatgggctctcatcctacctttaacacttacttggctgagtggcagtgggcaagaaactaaagtaagcctcagattgagcattctttgtataaacaatcacaaaattgtgttgcatggctgttgtgaggagtgaatgaaataatgcacacaagagcctagcacagtgcttggaaataggaaatagtaagtaacggtgcctggcatgatggcgcttgatgttggtgtgttgttgttatgctcattatgatttttatactgatagcagccccatagaaggatagggtgagtggagaagattttggtaactagactctgaagagtcaagctctgtcctctgccccaggagaccgcccagtttaatccattttaattcagtacatatgtattgtgcatctaactgtacgccaggcactggcatatgctgtagttatgtttgtaaaattagtgtggtccctgtgctcgcagcctgtcagaggatacagagaagcaaacgggcaattacagaacagtatgggttaagagctgcgatgggggaaacacggggcaccacaggaacccccgggagagtttagtgaaatacattcggcttcacgttcctgccttaattccaaactgtcattaaacctcagctttataaagtatatttagtaatttaaacagttaaaaatagttactatgataaaaaaatgtttaaaggtcatagagaatgtatcaaaacctaagaaaagccgtggactccattcctgagatgctcatggcctacccaagaagaaagaaaaaacaatgattcgtggaaaaaaaaaaccccaaaaaaccagaagcataaagttcagaggcaacaacaggaatgagcgtatgagatgcaaagaagcacaatggaggaggatcatctaatgtgggcattggagggtgaatacaagttcaccaggagaataaggaaacatggcggagaacagcactacagagtagagttccaatctcccctgaagatggtgcaataccaggaggcacagacagggccccattgttaacaaaaaaacagtgcttgttcacagagatccaagacttcctctaataggcttggaccccttggctgcctaaacaactgtaaaacttgagttcatccaagtaaagggcatccgctttgccaagctccagtggccttggaccacagtgcaggcgcctggtttgcctgtgactccaggactgacttctgttcgctgtccatgccaggttggctcccttgacccctggtagtgaccagtctccattctctatggccaaacctcccagaacttcccctttgaagctctggtcccaattttagttgtggcaggtggcaaatgtttgggccgttttcgtatgggaaagcaattgtcagtgtttccttttccctttctttgctgcactcaacagcgaaccctttctttcctctcctgggaatatttgaagaccaagcaaccctttgtgtcctccagggaaaaggaatttgttttcggttgagtggggttctgggtctaatgggtctatctattttgaaagaaccagggaaaaagagagagtactctagaaccagaaggaaggaaggacgtgctcccgggggagataagtaacagaggaagggccaggcgtagtggctcatgcctgtaatcccagcactttgggaggccgaggcaggtggatcaacagaggtcaggagttcgagaccagcctggacaacatggtgaaactccgtctctattaaaaatacaaaaattaatacaaaaattagctgggtgtggtggtgggcacctgtaatcccagctacttaggaggctgaggcaggagaattgcttaaacccaggaggtggaggttgcagcgagcactgcactccagcaggggtgacagagtgagactccatctaaaagaaaaaaaaaagaaaaaaaaagaaagggaggaggaagaagaatttccccctttcacagagatacaggaatgaggaaagagagggaaggagacagcccctgggagcatggctgctgatccttgtgcatttacctagaaagtggatgcacctagcaaaggacccccatggaggcaaaggactcccatgttggagctcccataagctaagtgacagttgaatcagaatccatggactgtcccatgtttaagttgaaacctctcattatttgcactcaagagttcaccagctcttcctcccatggaagagcggtaaggactttagctcattagcatccagcacctcaaccactgaccacccaatggaaatgacacctgtttgggtaatgcacccttgcttagtcaccaaacacacaatacctaaagacactaataaagccaagaaagaggctgggtgcggtggctcacacctgtaatcccagcactttgggaggccgaggtgggtggatcacttgaggtcgggagttcgagaccagcctgacaaaatggagaaaccctgtctctactaaaaatacaaaaattagctgggcatgatggcacatgcctgtaatcccaggtactctggagactgaggcaggagaatcgctttaacccggaaggcagaggttgcggtgagccaagatcacgccattgcactccagcccaggcaacaagagtgaaactctgcctcaaaataaaataaaaataaataaataaataaaataaaataaaataaatcacattattggctgggtgcggtggctcacacctgtaatctcagcactttgggaggctgaagtggacagatcacgaggtcaggagatcgagaccatcctggctaacacagtgaaaccccgtctctactaaaaatacacacacacatacacacacacacacacaaattagccaggcgtggtggtgggtgcctgtagtcccagctacttgggaggctcaggcaggagaatggcattagcctgggaggcggagcttgcagtgagctgagatcacgccactgcactccagcctgggcgactctgtctcaaaaaaaaaaagccaagagagaggggcagggttctggatacctacaacctacaggaatgctgggagggtgggagtggaaggtggagaaggcttctacacctgaactaggttgggaagctgaaatgaagcagcttaaaacttcctgagagccaaggcagtggttaacgatgtccatcattaatatgttgtgtaattattgttgaaagtctgatggacaaggataggaattacgtctgtcttgtttactgttgtgtcctaaatgctcattgcagtcttcaccactgtaggcagtaactggcacatgggagaaactcattaaatatttatcagatgaatgagtgaaggcttgataatcctgctggaagtcatcttactagtttttcccaaaccatgccacaatatcccctggtgaatttgagttgtgtgaactttttgccaaccaccctggtgattacctcacacttagatacacgtgcacatggaaatccaagatcaggtaatataggtgagtcaagttgccttctaagtttgtgtgaatccggtgctccattttttatacatcagtggggcagtttttagtagaagacacatagaggagtccctaaccctgtgaccccaatcttcaagttccaatctgagctcaccagctgggtgactctgaggttagcctgcttcatccctccaagaagaaggtaggtccttgcagggtggatgtgtgagtgcagcatggtggctctgtgagtttgtcatgaatttcctgtagtgtccttctttctatgtcttagtagcaggaaagtgatggaaggaaggaagtgctcttgggggagacaagaggcagttaagcttgtgttgactacattacacattaaggtttagagacgtaagatacgaattccccaaagatgatgctgccagtccagcatgatctttctggctcagagattgctgccttttgtcttggttctgctcagacctactatgctctctgtatactgcttcttaactcacatgctcggttgaatcttaatggcttcctgcctacatcaacctcaacctgctgcattgtgggtctttcttgagtcctcactgaccctccctgctgcagcctcaccagagagagggagggcacaaccactattccttcttccatattccatggtgcttgatagcacacaggcatgagacaacaattcaatgactgtttcagtgactaggcagaaaaagaaggaagataatgagagaacttgttcaccagcaggaaatgaagctgtctggaaacatcggcctctagagatggaccagggttcgtaaactaataatagagaccacatgagttggtttagcactttagtgtcaaacagctaagcctaatgaacatcatattcccttgtttctgcagtttaaaatgtcaagtttatcaaagcattgccagtaacaataagtcaaaggaacaagccaacactaacatggaaccaagctcttaacgcacaaaagacagcaaggggcatcaagcctcaaggcctgtgaaatggtagagaacaatgttagagggcaaagggaactggaggctcaacttcctgtttttatcgttttgttcaaaattaacctgatcttgccctgcttgtcctggggtgatgagtgccaatggtcctgttacaacgtgctgcactccaccgtgcagcaaagccagtgaagggtgaaactggaaccttgggattagacttagtagctaatggcaatagtaggctaccttgaggatgaagaggatggtgcaaagccactgccagaagaggggttttatttgggttttctattcatgttactaactggatcccatgctcttcctcaatcttgtcctgtaccccaagctcccatattttggcctgctatttggagataggagtgtactctgtcaccagtgacacatgaggctagttacccaatcatcaccttccagtgagctggtcagaagaaatgtttcaaaatttatgcattcaatataaacaatttcccatcctgtgcatcaaaaagtatcgtagagtctctttgtcacttctgaaatgaagcatctctctgctgttgtctcaacattcagttgagtgtcttcttaaagaaaaacagactctagtttccacatatttttcacggtccctctatgcagcaagataaataagaatttatatacttttacttgtaaatccagtaaatatttatattggtttttgccataaaagcacatgaagcattatgaaagaggtttctactcttagggctgaataaagccatcactcgcagtgaggaagtaatctatcaaatgaggcaaagaggggtgtgtgtcctgattcctgagccacaattccctgtcttgaattgtacctggatttactcttggctggatggtggtgttcctgaatacacacacaagtacatacatgcacacatctcatgtacacacttcgtttttaatctgctctttgacttctctcagatattttattagtccattctgtcttcagttctgttagactgttattccacacagacaaacatttgaattttgcctggactgtgttgttggtgaaatatgttagtatctgacttaagctgaatatggtggacagagcaaaactaccttggaaatgaaattatatttgaataacccacatacaaaggtcagtgaagatattcataaatttaacaacactaagagctttaatttaaaaaattaagaactcaaccatgtttagacaggttggctagttttgttagtgctgggtggaacacgcattagaaactttttttcatcatggtgcatttattaagacatattgtgtatcaagcattgtgctaagtgctttatagtattccatttaatcctgcaacaaccccatgggtaagattctattactagtcccagtttagcctccatagcacagatgaagtaactgaggttaagaagataagcgactttctcaaggtcacataactagaaaactgctgggactagaaatcaatcccaatgaatctagccctgccctctgtgtttgtaaccactaccctatattgcccacacaatcatttgaatgcctcttagcttagatccactgcagcacagcatggaattattgcttccagagattttcttccatgcagctttaaaaaacttatttatttttgtggtcttgtgaatctgtctctcatcattcataagttccataaggaaaggattcagattctcatatgtcagcaattatcatagcctagtacttttctcatggcaagtaattaataaatgtgggttggtgggatgccaagtgcataacctcctgagccaaacagatgtgcatttgaatctgagtttgctgcgtgctaaagctgtggccttgagcatcagtgtcctattctgagaagggaacacaatgataactatcttacagtcattgaaaagcttcagtgagacaaaatacttagcacagtgccaggttcataggaggccctcagaaaaagacagtgtgttagtctgcaaaataccacaaattgggtggcttagacaacagaaatttattttcccacagttctggaggctggaagtgcaaaagcaaggtattggcaggtttggtttctcttgaggtctctctccttggcttgtggatggctgccttctcgctacgtgctcacacggccttctctctgtacatgtgcacctctggtgtcttttcctcttcttgtaggacactagtcattggattacagctcaaccatatgacttcatttagccttaatgacctctttaaaacccctatctccaaatacagtcacgttctaaggtactagggattagggcctcaacatatgaatttgggagtggggaagaaacaatttggtccataacagacagttatcattattgcaaatgaattgagcactaaatatctagaaattcaaaataaatgttccatgtcagacccaaaaatggtggtccctttaaagtgtcctgattacaattttagttctttctctccttggtgccttagagaacgcaacctagaaaggctttttctctttagggaactgcaccatattcactcttggaaagaaatatattcaatatggggttatccaagatacactggaggaaaacatgatacatcaagtccaagttaaagataagaactgggtgtgatggctcatgcctgtaatcccaacactttggaaggccaaggaaggagattcacttgaagccaggagttggagatgagcctaggcaagatcctatctgtacagaaaaaaaattagccgggcacagtggtgcacgcctgcagtcccagctacttgggaggctgaggtgggaggattgcttgagcccaggagttcagggctgcagtgagctaggatcacaacactgcactgcagcagccttggtaacagagtgagacactgtctcttaagaaaaaaaaaaaaaaagataaggatcagaggactgtaaccttgtcaaatgcaattatcaggctgcacagtctgccagggaaggagaccctcttgtgaagagctggcagtggagtgcttctccagtccaataatcttgttgagtgcaccctcccttactatgcctaggttcctatcattatactccctgtatttagagaaaactatacatgactatcctgtttagaaaaggtccaggaaagattttcccttctcggggagccctagtatgacaatcccagtttgtctcaccccatctagctctacggaacccctggcctgcagctctaatcctctctattgcccctgatgaagtctttcttggtgcctccaagcacaggcaatgtctgtcacttcgatcttcccttacattttgtccttttctctcctacagcatttaccatagactgctctccatcgaagttgctgtgcagtcaaccactcactcagttcatttgacaaatacttagtgagggcttgctatgtgtcaggtacattgccaggtgctatgcaggtatctatgcatcccacaagacagggactctctgaagggccggacagaacagaaactgtgtttgcctcatttttgtaccagctagagagtccaccccttggcaggctgtccctaaatgttagctaaattcaatggacagatgtgaaaggggactttctctgagaacactttcctcaggaggaagacaaggctaggaaagtaaaaggaggcaatgtcttgaggtctgaagaaaagctccatttccaaaggtcagtagaggtaatggaggttctgacttttaatccccatcctgaaaagggaggccccagctaagaggagaggtggcagagccagcaagaggaaagtgttagggaccagtcccagagcacaagcgaaatgatcaagcagctaaataaatatcagctgcttttcctactctgatgcttctggaattcgtgggtaatgtgtttctgaattcgcctcctgcttctgcataaacaacaacatgatttaatgatgtggataataaagctgttgaaaatgatttttctttagctctcttttgggacaaggaaagggaaagaatcaaagcttaatacagatgctgattacagaaaccaggggtgaaactcaagttttaaataattgtacttattttctgttaaactctcatggtttttgttagttataggatcactaattgttagcaccacacaaaggttaaatgtgcaaatactgctctcttggtttcagctgtgaaagaaaagagataagaacaaggacatataaagagggcatgaaacttgtaagatgaaggacaggaaagtgaagggtgagagaaagaaattgggtcatcaagtgctcactgagcaccaacagtatgccttgaactgtgcaagcattggatgacagggcacagggtagaaatgcctgcacaactctcagataaaagggtacagggtagagatgtcaggaaaatcaacctcacttggtctaggatggccaagaagttatagttcactcagatcccttgaagagaaattaaaaggaagtgaattagcattttttaagtggctaccacctgcagttagtttcttgttgaattcacacccttataaggcttagagagttaactaacttgctggtaagaatctgcaataagttattactatattataaccctaaagggaaaaggtagggagtggggtagagtaagaacttggacagttttacaactctaacacccagaaatcaggaaggggtgattgaatggggctatggatgaaattcaagttggaaatgagagaatgtgtgagcagaaggccctaaaatctctgccagccttgactgggtgagataacttttgctttttaggtatctgtatcactcagaaagaaagataagcttgctaccacctggggtccacctgggggctttcctcccctcctctcctcctctgcccctgcccagcagtgaagccaagcaagaaagggaatagtagggctggagacttaaaagtcaagaccaaatggggactccagttcaggaaacagaggggaggagaaaaccttgaagctataaaacagaaaaagttggaggtattgggggaagggaataaagggatgtgtgcaagaggaagagttattaagttgggggtaggaggataagagacatgctctagtgaccttgcagggtgcccctgaagtctgtctgtgataatctgcctgggggagagtgtgccaaccagttggacctctctgattgtttcatgcttttttttttttactatatgactttagagagatcaacatgaatctaaagtatgttcagacttctttcggattccttttgcttgtttgctctgtggagggcaggaagagaaaggacatctcgcacctgcctgaatcactgagtgctgagataccaccagccatgaggtgtaggaggtcaagggtccagttcaccttattcaatcactatctatcaggtggttttctctactgagtctcttaatgaggataatttctgaaagggatgctttcaagctcaatggctgtgatgaatggtattatttccagtatccactttcctacatgtgagaggattctacataagcatgcattgccatgtgacccagggcctccctagcaatgatgatgtttacctgtccagtgacttcaagcttggccgtgacttgctttggccaatagaatgtgagtgggttgatatatgctctctcacacgcacatgcacggagcagaaaccataggtttatcatacggttttgctagctctcttgttttattccttctgccataagaatggcatgtttcagatggggcttctacttcagcctgaatcctggatgaaggagcaacagagccacagccaacccatcgctcaaatatagtgagagctagaaacaaacctttgcagtgcttctttccgcaacataacctagtgaaagttgctatcataacaattttctctgtatgccctcctcattttatattgccccagcatttttaggtccagtgtttgtaataaaggatattcattccttttcacaaatacctttccttcttatcccaagctatagaagaccatgtcacaaaaaatcatggcatgaaagagagagaaactggtatattgaaaaagaaggagaaactgagtatatctcaggtctttgggagagttagcattttgggtataaaacacagtggccagaactcttaccagggcatatttgttccaaacacatctaaaatggcctcctattcccctagacagaagcatcagcttccaccctaaatcagtggctctgctactcagccctgttttagattcacctagagaaagcatcaactcagatttccaggccccacgttgagagtctgattcagtaagtctaggacgggacctagaatccttatttcttaaacattccccaggtgatgccagtgagatgccagggtgggaagccagggctagtcccactccactggcaggcttgctgggccttgagagtgccagcaaagcccaggtcctgaagggttctgaggctggtgtgagatgctggcctctctgggccacatcagagcccaggccttatgctggagagcactaggaattctaggaacaccctgtccccagtggtccttcttggcaggaggacagcaacagcatatgtgagtgtatttgttttcccagccctcttgtatatcttgcccactacagcttgtcaggcgggctgagtcctcctccactcctgagaggtggggatggtatcagccatggctgccagctgaggagactagggagcccaagaggtcctctgctgaagtctccatagaggttgataaccacctgcctgtgaactgtgaaccccactgcttacctgtggggcctcaatgcctttcaatagtccttggactgctgcccttgaagtctcccaggagtcagacctgagcctcaatgaacaaaggaaaataacaaggcataggaagaacccagccaccagacagaaatagagctgctggggtagacagaagacaatttgcatatcatcataatcatcatcacatctaagggttaaagcaggaaaaatgggtctaaaaatgagactttctaaaaaaaattcgtaggtaaattgaacaagatggttcttgttgagatctgaagtagtgagttggaagattaagtggaagaaatatactgaagcatagaaagatacaaaaatttggaaatctggagggaaaacacaaaatacttggcggatagatctgggaggaaacggaacaaacaccagaaattccagaagaaaaaaaaggaacctattgaggaaatgaaataactaaacaaaccaaaataagccatttccctaaaccaaggaaagaccagagtctgtagaaacaatgaaaatgacccatactcaggcatattctgatatcacatctaaggtggaaggaacaagaattctacaagctgccaaacggaaacaatgcataacttaaaaaggaaaaagaatcagtctggtattttatctctcaaggcaaacttggaagctaaaagataacatctatggacatatgagacaaaagaattgcaatcctagattcctatgcccagcaaagacaggcttcacttgtcagtgtgagagaaagatttgtggctgggtaaggcagagcttctaaccatacaagtaagcctgaacagagactctgagggtgagaggggaagaggggaggaaaaagatggtgagaatgaaacttgcagtatagagagctaaacctaaatgtgaagtaataaaagattgactgggattatctaacattagcatcaaatgaggattactgaaataagatagataccagaggaaactaagaactatctgaaagtattaaacaatgacagaaaaactgaggatagaggcagggtatgaagtgggcaggcacaggagaggagaaaagaaggaaaagcaagcattctgtaatgtcagctggatagaggccagaagtaggagtgttctgaagctttattgtggtggtgcaagagtcctggggaaacactgacctgttgtctccatataacagtactctgagggtaggattctcactagtagagaagaaagtaaagaacaacttgaaaagcatcaatgattttgtcagggacctgcttcattgctcctgaaatacagccagcgttccctcgactgtgccttgttttgacaatttggctcctgtttctaaattcaccccacctgtgggaaagaccctgttctgaccttggtgctctactttggacacatttgcttttggctctgaactcccagaagcctggtctccagcctccgtgcacctcaagtcacacacttcacctctacatagaatgggtggcacagggagtttgctgtggagcatctgggccaagtccaaaatggttctgggtctcctactcttgaaggaaggtaaagaagtcaattctggcggtgttccaaactggtctcttgggctagtttaaaagcttagagatgttggaattatccttttcacctttctcctttcctcttccacttccatccccacccaggatccaatgctgaagtttccattttgaattttgggttctcaggcaacatatggcctgccttttatcgtattgcctgtagcattcggggatttcaggaaagcctttgagagaccttggtctcatcctcagctcagctcactaggaacaaacaagagattggctgtgggcctctgaatatcactcagaacacctgaaaatgatagtaggccgatccctgcttgtctaatgccagagaggtcgaataacttgcccaaggtgagagcacctgttggtggcagagccaggattagaatctaccatttccagtccagaccctcccgatcctctagtccttgccaagtcccctttcaatctgaggcagaatttgccaacattcaggatgccctgctcaatctttcttagattggactctaattggtagcactgtgtagcttgtgtctggaatacgaggcatttcagataataagggtcatacttctacttttatgccaagaaagctccagcacatggaaacacgtttaataaatccaataaatgatatgataaataatttatttaagacagaatactttcaaagtcagaattaccactgagaggaaacattttgcctccatgaggatgatttgactaaacagaaattctagatggagtccattttttggactcatacaggagtcctgcatgctaacccatcagagaaagagtagacagattgtaaatttatcttctgaaaatgaatcaagtcgtatttctcttcattctggttactcttataaagacacagcaggtgaataaagccctttttctatcttatctatttgcgtattattaaacactgagatcgtgcaatgcctctgcctcctagcaacagtgtactggtaattcttggaagagtcatgaactatgtagggtgaatgaaaaaagcttcttgctcttatctagtgttgtgggatatatactataggcatgagacagcagttttttttttttattcttttaaaggtcacaaaggataaatgattacaataacatttcacccactgactctaggtttttactagtaaatcctgatgttgatttcaaaagctgcaaatctataattcaaatatttctgatcggaccataaatcctgaaaatcaaatctttttctgaatgaaggatctatgaaaatagatgatggatttcatgggctgtcaaagcaaaaatgttacatttcatagtttgtcattgaatatgatataaaacacctgcaggtaggttatttatattgataaaattattgttcttcaacattggaaactgttttctggggaataaaaataaaatataaaaatagcttttaccacaactagaaattttgtgctttagaattagacagtggaaaataatgtggataaatgccaaaagccattttctttaagccaaatacagtgtgtgctattgcaaggatggataggccaggctggactgcttttcccatcagacactatatagagtatcacccatctaccattatttttgctggaaatacaggagttttgtttgtttgtttgtttgtttgttttgtgagagagggtctctcacactctgttgcccaggctggagagtacagtggcacaatcatagttcattgtaacctcagactgttgggatcaagcaaccctcctgccttggcctcataaagtgctgggattacaggcatgagccactgtaggagctaatattctaactcttttttgttgtttttatactttctttatatattgtccttttttatactttcttcccagaggttaacaaacattagatttatatttcagtcaggttaagtatgtccaaagttattctttcctttctgggtagtgattgtgagattaagaagctagtttgctttgctattttctatggctactgtcggtgggccatactccagccaactttctcaggcaaatctaacaccacagctccccagacaactaagagttgtttaatgattaaattaagataacacatgtaatctggcatatagtaagtgctcaactaatgatagtaataatggtaatacaaattattattattattttcattatacctaacttgaataatttctaaggcccttggcatggagtatggtcactagtttagtttaacatgatttagaaattgctcatggttatatattaccaactacaaatggaaaaatgacattgttggaaagggagtaagtcagatattcagggaatatgtaggctcatattaggaagggaagatgcaggctcaaagagctcccttctcagatcctgaaaactagagtttgggtttcatttacaacagtacataatctcagctgcacataagaaaccttgccacttctgctcagtaaaatacaaatcactgactacccgtttttattttaggcagttagatagttagtacatcgttaatttctgcacatactcaagctcaatatcattgtcagttcggttttatttccacctcctttcagagatccctggctggaggtaaagacttgctctctgagtgtctctgggtatactaaggcaatatgaatctttaggagctccccttctttgggggcaatttataactcaaaacagcaacaaattttcttttcagggtggaaatactgacaataaaaaatgaagcagctttgaaatatacattactgtaattaaagtgacttgctctttggaaattcctgagataagtctttattgcaactattatttaatgatgagcataataattaaaggctcattcttgaaatagtatcagtgccaggatctggatggtcctgcagcatttcagattacagaacatggccactggtggatgcctcagctcaagattctctctgcctttcttttgacaatgtgaggccaaggccaagtccaaggcaagcatgtgcttagactggtgttccctagtacactgttatagaagccaccagctgatgggctttgtaaaaggtgtggtcaaaactggctgggtgaagttagtactctaccatttgaggcacaatgcccacaagggtataaagtatcagaaattgtacagtaaaggcacctgtttaactttatttaatatagcatttaaaaaaattatttgagtaccaaaacactttttgtggccatgtggtacatctattaatattctgtggagcagtgttctatgagataccagtttgggaaatattagctagacctgtgcttttcattcctagctctattacagaatcgcctgggggcttaaaaagtatatcaattctggcccactgcccaacattttttaaattggtctggggtgacatccaggtattggtattattttcaaaggctcccttccctagccaagtctaatgtccagccagagctgagagccactgacagaagcctctcacttatgcatcccaattatcccctttctaatgcatagagtcatagtgagtaagaaaaaaaaaaaaaagctctccaaagctctgatgtgtctgagaaagaagcttttcctggggtcagatctggatctactcactgatcttggagttttagctgatatgtggatttgcctgttcatggacttacttcctatcacacttccttctccttggtggttgtcattttcagcaggaagggacaggctgcctgctccacccagaacctttcctgaaaacctacacctgccactataccaactttatgtaaatgactaatagcgcttcctcacaaaaaatgatgagaacctctgttgtaggtaaacattccaagactttatctacaatttatgaaagcctttctcccattgagctggcaggtcctggaagccccagaaatgtccatatcattagtgcagtttccctgggaagtgggagctggggaagaagcctgggaggtggagcctcagaaagctgtgtctaatgcagatttctagctttaaatttgttccttgtgtctgagattttctagagttttactggaagagaaaacccatttctcctcccctttaaataagaaacaaaaatttactgattaagcaagaccaaagagaaaaatgagatgactttatagactcattttataatattctaaacaaatgagattcatcttatttaagagtacaggagaaacaggcatttaatatttattgagcatctacaatgtgctaggatacatacaggttttttcatatttccatcttatttaatcctgacacaaccccttgaggtgattcttctgttctcatttttgtgactgtggaaagggaagcccaaaggggttaaggtgttgcctacagtgggacgtgagacagagctgggacttgaacccacgtctagtgatggtgatggccaaaccagagccagatgagccagttccccacctctgcagcgctcaccacgagaaaaagaatgtgaaaaactccagcctgagatcagtgacctgttgagagctcaggtttttcatccggcctgcatcgtgactctcagtgtatttcatatcatctccaaaatagtatctgaattttatacgcatattctcttcaatgttctactctgggctttgaaacagaagaagggttaatgctgtggtgaaatgtggcctgtcctgctccctgggttcttctttcattactcaaaaaatacgtaggtttcagggtagactcttataatggtaacaacatgagctttggattagacctggatttaaatcttatactgtgattactaattctgtgaccttccgtgacttattttacctccttaggcttcagtcttttcatccataaaatgaggtaataataacatttgtctcatagagttgtgaataaacaagattataactcaggtctcctgaatttactttccattagacgcatatacccaaacatgtaaaagatcgaaatgtttcacagctttccaaggcttatcatctgtgaagctcaggtagatttgcaagttcgggtttatttatcaattcattaattcagtcatcaatgtattgctttagtcattcaacaaatgttttattgagtgcctactatgtgtcaggcattttgttagtcaccggagataatagcaattttcaagtagcttagagtctaactaaggcaaatctgactgtatcattatttatacccattagaggttcacaggaatgatattcactcactaatttgttaatgcgagtctgcagaattaacatgcatgtaatagtattcaatctaagttaatatgtttgcccattgttgattatcataactgttagttatagttaatttccaatctgtctagctctctggaaaagcaaaaagcaccttccctccattttgctgctctgaactgggaaagagcagatgcccaggtgaatggcagtgaagaacgtatattcagtgagctcttacaaatcaaactgtttgccctgaattaggctcaagtccacaactaatgacaactaatgtatggattcctggcattgaagcatttggagtttaactgtttgttgtcattgaaagtgaatgcctttccaacatgtagcctgaagtgctgagagggcagatcctcagctaggaccgaatgtcagtaatttaatcatttattttttcttgtctgttttatgacatgttcttttcagagcattccctagttgctttgattcacatatacattccatcaatattaattttctgtgttatagtaacaacaaaagagtaaaaccagaaagaggaaaaccttatttttccctatgaatagcccaggtccacatgaaggagaaattagagtagacaggtggcactgcagcctgttattcaaggcccaggcaaccctgactagttccttcgttctctcctttgcttttttctgaggaagaaaaatcagcctgaagagtcaagcagaatgacgaactttttaagggcaagataattcacaggatcagttagtgatagagtaactttggggacttgctttgcatttagaatacccaccctatatggcatgttagtcctagcagagagaggcttgcttccacaccaaaagccctaattcactttccacggaggccctccccatccctcagcagcacttccctttatcaggcagataagattgggggggccaacatctatcttgtatgcatcctatgacactgcagatgaaaactacctgccctggtgtggtgtcacattttttacatttgatttttatggatgaaagcattgcttcatctgatacttataaaataccacatttgccactgagaggcttctgtgtccaaatatctgccccgccccccatgtctaatcttgatcttcacagctgaggcccatctggatcatcctcctttccagctgacagtgagagagccaatgaaatgccttttcctgttgctgggtgactgcgaatattttgaaaacaagttccttaaaggcagcagcttcaaagcctgccattggctggctaggcatactgtgcaatgctgacgcatgaaggctggcagaggagtgacagttgggaagagctacgcaaatatattactggcctgatggtccactggagggaaagactatttcaaggctgagtgacaactataacataccctgtcagaagaaaaataaatctccctgagtctacattcaggcatctgaagaacattgcagaaaatactgcagacaaaaaaaatgcaaaaacaaaaaacaaaaaacaaaaaaactcaaggttgtcctaccctcagatctcctgctttttatggtctgatgagcagttcttcctgttcaagaaatatatgggtatttccacatactttggtagaatttgtgttcatacattttaaagcccaagcttgtttatttggaaaataattttcaacaaagtcatggaagattttctttgcttccttgtctccagcgtcccttccttcaccttcctcccctgaccttcaagtccaaaaatccagcaggcacagtatgcggtcagtgtcaggggcagcattggctgcattttatctcactctgtccacttaaaatatttgcatcctggtgggaggataagcacagtcctgtctaaacagccttggggttcagctttgcagctggagagagctgtttggatacaagtaactgcttttgctaacaccgggttaactgttcacacacaaatctgccaacgagcctctaggaaggaatgtccttctactaattgaattctaatgaggccaggaagtagattaggaattgagctattttactatgagtttcaaatatcagatctagggatgtttggcctgtctgatctccttaattctccagcaggtcccaataaattcatgaagaaatgactagaagaaatctgtgggttattggttgatccagttgcagggggcttttctatatatcagagactacagtgttcaaacacaagagaaagaggctgatctgagatgacctgatgggctagtcattagtgaggagttcctggaccaatttaattggcatgtccctggaagttatatttatttgccttataatatttgggtaagtttgagagccaaatcagggtgagcatcagtggggtcacccctgattctacttagttgtggaaatagaaatgctttaaggacatagtagaacattcttttcaataatgctatatagccaacatcacttgtggaaccacttcagcagacagagcgatcacttgtgggtgtcacccagtttctagacattacgaagaggctcttgtgagcatcttgcctgtatcccaggaaatgcctgcctgccataaaagagggcatggggtcatgcaaaagttacctgcatgtactgtgaaggacagctatgataccatccaccaggtacctctttcctttctagaactggccctccttctgctgcgaccccatgtttccacctggatttgatttttccaactgacacactttcctaagcacacactcctcatcacagttgactggtccagggatggacaggggaaccaagtgggccaagcggaccaatcagaaaatgtccctgatattttccaaactggaacttgggactccatagttcccttctagaaggggttgctgaaagatgagaaacccaggctctgccagaggccacttttacccctttgtagagcaagccagtctgcagtgagtacccaagggctccatgtgcaatgtgaggcttttcatatttggcccaaggggccacctgggtgcttagtggagagtcacagcagccagccccaggaatcaccaagtggctctgagggtagcagatggttttgcaggagcccattctgtggggcagggtttccttttggtgtgcactacgctctcatttgtaacacttcctgggaagactttgggcttttacatactatatagaggaaggagattttacatctgggaccttggggccatttcaaccctgccttcccactaatgaatttaccacacaataagagaaagagttcctgttgggagagaagcttgtttgcaccccaggtcagacagggccactgctaacactagaatagtgggcccctggtctttcaggggttatcaaaataaccagcttttgccctcacacacaactcctcagagaaccggagtaaagctgttttcaagaagaccactgatggtttaaaagatatttcaggcagaagcataaatttcttcatggttttaaagggaaagaaattccctttaaattcatattggagaaatgtcatcacagaaagcctctcactctcttctcgttcatttctgaattctaaatcttttctgttggtggtgaggggaagagtaaaaagtggttttcctcaaaagccagcttcagtggtttacggagttgtttgacaaacttaagcccaagtgttgaggacggccacctgttcccacagaaatcacaaagcttggttttcacagaactcgtctccatctccaggaaggccagaggtgaattatagtatgtgttaggaaaatgaacctagtagcaagaggaatgggatcactcagcacaggaattgtttgaaatttgccctttggagaaaataagtgctgttagcgcccacaaacatgtcccttgaagttgatattctagaatgttgaaggctaaggaatcatacctgctcaagcaatggggctggattacttttcaaactatgtaaccttaaaacaaacaaacgaacacataaacaaaccaaaacattcttagcaaggtctgttgaaacctgaacccatctatcgagaaagtaaaccaagattattcaagggctcacaatcagacgataaggagggtcaagccaagacgagaagaatctcaaacaaaacgcattccatgacatttcaaaaaggatcttacaaattcagcatgcccacccatatctcaatttcttaatgtgtgcaatgtagttacctgggcgtttctctttgtacctcagttttatcatctgtaaaataagaaaaataatagtagggtttttgtgaagactaaataaattaatacaggtaaggcaccaaaaactggcctggcagctggtaaaatgttcagtaaatgtttattttccagatgactgtcacatggagtagactgagcatatactggggcccaagaaaagggcctcagcagcatgaaccaaggtctccaaactggcagtgtaacatctctcttagctgcctgatccttaaatgggatagagccgctgatgcctccttcagaggcttgctgttaacattcaatgaaataagagctatgaaagcacttagaatcagcaaaaatgctgtggttatcatagcatttgtcttagtgaacagcaatatttgaaaatgtataatgattggtatcatgttatcctacagaaagcccaggaaatgtattttaaagtccgtccacttgtagatgcttaacaacagaacagtatttaagcctcttatccctggataggttgaacagagcctcgctgtaagttcttaccagcccttctcagactctcacctttcgtgggtgtggatttgattatagtgagtgtaaagaagtacctgtggatgctgctctgggaaggctttcagagccagtatgaggccagatgctggggcccccagcctggggggatgaggtgaaatctgttttgaacttagatcccttctaccatgtggtcttatagaaacgattctagagttttctgttacagtgggactgtaacagacttgcagtttttattaaaattctgacttgttcacagcctaattccttttagtctcaatgaaatgctttaggccctggatggaaacatcatcctgaattacatgacagtcttagaatattctctgtggaggcaaggcacggtggctcactcctgtaatcctgtaatcccagcactttcggaggccgaagtgggtggatcacaaggtcaggagatcgagaccatcctggctaacacggtgaaaccccatctctactaaaaaaaaaaaaaaattagccaggcatggtggcaggcgcctgtagtcccagctactcgggaggctgaggcaggagaatagcatgaacccgggatgcggagcttgcagtgagccgagatggcgccattgcactccagcctgggtgagagtgcaagactccgtctcaaaaaaaaaaaaaaaaaaaaaaagaatattcaaagaacattctctgtggctatcaaatccaaagacagaaaaatcctgcacagatgttgtgtattgactatagatgttctgatatctggctaaggtggtgtctttgtgaacgttatgaattgcttctagggaagcgaaaagcacctcaacagagctaccatttcaccaacatgcagtattctggggaaaaggaagagaaggagtgcctgatggctctatcagctctggcaaggaaatgaatgcattgaaggaatagagtgcaggcacacagacagcgaggctcaaatctcctggctgcatgcatgctgcaattacacaccacaataaaaagaattaatgtagcatctgacctgctgacctccagatgcctactgcaccacctcatcaacaatccccagacctccacggtgcctccttggccacccgccggctgcctcactgggatacagcaagcacaagggccttacacaggctttgttcttaaggctaaaccaaaggggagagtcccccagtccctccacctcgtgcctgggcaaatgaataagctgtccatgtcactaacatattccaggtcatgcgtacacacaaacattattatatctcgatattacttttaaattactgtctctggggttttagccattttcctagaaatgtggctcagcaaatccttacgtggagcaaggatggcacccagtggccaaagtgcttcatctcagaccctgttttctcagggattttccatttgcttctctctttggagacaatgaattgccatgagatccttttgtaaagccagagttgaaactccaaatcatatgactatcccgttaagttggagcacgtgcacacacacacacacacacacacacacacgcacacacaaatggaaacagtatcaggagctaattcagaatagctaaaatttctgaaaaatctttaaaatttaccttgagagttttatgttaaaatcatcatatttcagatgtgcagattaccatccatgatgttcccaatatcaagtatcactataggaaatattataaaaaatgcaagcccagtctcacattcttcacttcatattcccccaaatagtctctagttcataagtgctcatgccttaaacataagactttatcacctgacaagtgctttatcatgaaactgatgtttgcaatctcatatccttgttatctttcgtacaaggtacttggcaggcctggagagcacaggataatagagtgggactactctttttcctttgagctttccagatgtcaagagattttgatacagctagatagccaatcagactgtaaggaagacaggcgagatgtcagaataatgaaccatatactctcttgctaagaatgatgcaatgtctccataatgtttctgtttccaatttccttaggttcccaagtaatctaaaaccccagggcaaaaagtcacatggatagtacaaccacaatacaaaaagaagtttctaataaaacaacattacgtattaattgcccaaagagtaccataaacagtcttactaaaagtcaatatgttgagttcagccaacaattctgtctttctcagacgtcattaccattcatgcttatttgacccccaaaatgtcaaaatgccaccaagatttcaagaataatagctgaatcaaaagaaatgacttaaaaatgaaactccatgacattgcttccattttcctactccgccacttgaagaacagcattgtcttcaggaacagacaaaacattgcagaagaaaaaccaaagcagaggggttccatttttcttgctggttctttgatccttagttgccttctacataaaatggagatatgctaaccctgccctcaccaagactttgtgagcctcaagtgagataatggacatgtacctgtttttatacactgcaatttcttagtacttaagacatttttcttatttaaacatttataggtagcattagtgtatagtttttatactgatgagattgagactcttgttttacccacgtaatcacacatcttcctcatgagtattattatattatattacctttcaaatataatatagtcatgggggctttggaaattacttatatgtaattaaatcaagctgagctatcttgaacagagcttgaattaaaaaatttgagtatgcgaaaatcataaaaacccctaaatgttttgtcaacatttatgttgttttatgttttattttcccctttcttcctagagataaattttataggttcataaaattatagcattttttagctagagatggctttgttttgcagatgaggaaacctggagcctagaaattgaaattaaccaaaaggtctggtggttactttgtctttttatacacttgcttgctcttgtcttactgtgtccatggtcttacaaagactgttaaaagggcagatctggctacagagactgcagaaaacccttcagccagacattgtctcctaacttcctatttcatagggtgtcttgagaccaagagaattatgattcacaaacacttaaaagattttggatgaatccatttccaaatgaggaaaaataggaagaacagccaaaccagagcatgatttcaaaaacaggaaagacagactatagaactatataaaatagtaaatacaaatacaaataacaaagcattaggtgttttgaaggtcaaaaaaataggtttaaaaaaatttagtcagcagggtggtggtaggaggatacatgaatgaagaaacgtatttagtagtaaagagattgctgaatcaactaagagttaaagggcaaggggcttttgcctccagcggggaagagagacactatcattacagcacactccaaagaggataggagtacctatcctaaacaaagaaaacgaatccctttattttcatatagtttagggtgcacaggacaacaaccaggaacataaaaacaaggggtttcaaacagcataaagcaaggattggggtgaaattgtcagaaatttccatcgtcataggtccctgcttcaaaattccacccaagcattataagttcttttgccataaaaatggcgaacatttcaaggaatttggtcacaaggtagaaatttctccagcacccaggtgcaaggcatggctttaggtgatataagggttaccaaatgagtaagtcaaggattctctcctaaaaatgcaactgctttaatcatttgagtagacaggtgcaccaagatttatattgcaaggtagaaagtgatgaatatggtaggaagaaaggcaaatgagaaggtcacttttgactgaaggacagcaggaatgacttcatggagaaaggggcagttgagaagggtcaggtagattgttagcgatttatatatacagatagggagaaggatgggtgcaaacatataaaaggacagggaatgggcagaaaacaccaagtagaactatttggttaaggatagctcagtgggagcatgggaaacaggctggaaaagtgagctgaaagttagagtttggaatacttttaatgtccaattaaataattcgaattgaaagaatctagaggcttctagaagatactaaactttgtgagctggaacctacaccaacagaagagttcatctgttcatctgttagctgtgcacaggatggatctcggatagggtcaacagcaggaggcgggaacccagctaggaaagcagtgtacaataatggcctgcctgaaggagaatgaggatctgaactagtgagggctgtgaggatggacaggagcaggagatgtttggaaggcagaatggacgggactgcatgtgggggcgggcagtgatgaggaccccatgatgactgtacaatgatagccaaagtgtgcaactggagattgagggctacagaagcccaacagccaggaggtcgtagctctgtgcacactgaacgaacagtagagggaaggccacccattgtgatggctaacccaagcccctctcactgaagtgagggactacgtgttcttcatttcctggcgtcacagctagagttatcaatggatctaattagaggaaaactaaaaagaagataaagtgatacagtcccagatgcgctagtgttctggaaggttctgatgactttaacctctccagttcccttcacagttcaggagtcagggatctcactgggccacactgttgctctccactggaccttcaggacttgtcgccgctttgttcctagcgctctgaaacaaaaatgagccctcctttgtttcactgcctcaagttcagacttcctgcgccttcccgtgtgacacttagggaatgcagtgaattctgctgtgctaacatgggggagggagaaggtgggagaaaatcctccaggcccgctcttcctcccagggaaaggagatgctcacagtgatcttctggggagagtgtcctcgctttgttttcaaatagaaagaagtgacaaatagtggctgctgaagttgatgtgaggggaggtcagggtcaccacaggatgtattttggtcaggcgggtccttgaagggccctcaatacctagccgcttagctcagcaggagggaagacgagcctgggcttgcagatctggttcccctcatgctcagcacccactcccccgccctccgccactatcttcaatactcaagagtgacaaagtacaaccatcctttttctgatgtggcatttgattaagacacaattcatacagacagccggacatttgaacgcgaagcactccgcatatttatggatgcgtcctgagcagtgcaagccgcccggctcggctgctgcttgtgagcaggagatgccctttagggtgctgatgcagctgtttcctctgcagtcaatttcctggtgaaggttcaataactttctctgacgataaaaaaaaaactcggatattaaacttgacataaatactatttaaagtcaaaacaacttcctaaattccaaaggcgggcacagaagaggagacagcataggctaggtaacgaattccttctatatagcttcgaggtaatcttttaaacaaccttagaaatgacccgagatgcactggaaagccactgttgggatttcagaaggtagcatttcaggaaggccatgagaactgagactgtagataaacaagacaaagctcctgccctctttctggtacccagaagtcctgctttatccccggctgtggaggagcctctatgggtcatctgccctgagggggaggagctggaggtgcccctaccgatggggtgggtagtaagctcccggcctctgccaccccgctgctgtccatgggactcaggtctacccctcttcctcttcggcgttctctgtgtcgcctgagtttgggtaaatgccatggtgttaccctctgtctgcatagtgcactccgcctctgcaaggggctgctgcaagaattgggctcttccagggcttcggaaattgattgcacagggcggtggctagcgcgtgtagtgcctttgtggcaattggagaaaggagcgccacctggtggatcaactactaaaaggcactccatgcacttggccagccaagagaaggggggcagccctgcacccgcctgctgtgcaaggggccctagtgcagggcataaggcagacacatctcctggcatagctgtaaaggcagtcttgagggctgaagcttcttattatacactatttcatggattaaagtgtcttatcaaatctaattttttttaagcctagtaaatcacatcctattgctcagtctgcaaaggaggtcataagatcctatttttgatgcagtcattcttatttcagtatataaatgccacaaggagtacctattcttggtactttattttattttattttatttactaggatattaatttgtggcctagtcattaacattgaaaacttgaaatatgtatgaggtagtccaaacccaaaccccaacctgagttactggtgcttaattactgaggcagttacagtgctgtaaatgagttcatctctgattgcagccgtaacccatgcagtgctcaattgaaggaagggatgatacaaggtggcaatataacaccacaacatccatgagttgattttaattggtaaactggcaatatatagtgagaattgtttggtctgtccaccgcattgcaatttaaggaaagtccataaaattacaggagcatataattggggtactaaactcattttcttatgttatcacagctggcatctttaggttattgaaagcctttaaaccagccatcttcaaggagatgtaattgtcaatgtggtctttatacattattcctgttagcacagagctgcagagataaaaacagtcactaaaatatgcacaaattttctgtatataactttcttatttcaagttcatggaagatcagtaaatgttaatgaggattaaaaaccattttttagatcctggtttcctcattagatgcacagggcaatcaacccataaaggataatttattgatactacaacctgaatcagacttttgaaatagttaattcattagttccaggaagttctgtgatctttttgtgtataggtgaagctgcaagaaagactgtttcttgaagtataaatgatatatcagaatcaggaaaaataaacccaaattctgacattcttggatgagtaattatatgttgttttatctatttattctggctgcacagtccaaggacacttctagaaaggttttcacactctaatcccattctcccacccatcactactacatgctcctcaaggaaatttttcccaacagaagtaatagggttatcagaacaaaacagaacaacaacactctccctaacaaggcattctagaatagggggagaaaatcccaaaacataaaggagtatgaaacagaaagaccagatatgaggaagggtaagatggcatcagcctagcattaatgattattaaaagattcactacaggtttatcttatgtgaaatcaatcttcctttaggccccacaatctctgagtacaaatggtacaaactaagagtaattaatggtgtatatatcacattctccaatagtacagagtctccatctctcctacttatttttgggagtcctcagggtgtaccttacctgccttaaaatgtgaccactgagcctgcattgattccatcgatgccatcagcttctgctggtcacacaggtaggaaggggccctgccacgggtccgtagtgatgcttccttcattaggctgctgccttctgttagcacactgacccattctatcgggagcatttgatgcactgaaaccataccaaagctcatgccttctgtgtttactcacgttctgagctgagaacatggatccatgggaggctgaggtgagggataaatccaaggtacaaactacatgctgaacttggaatcatctagacactgaggtccatggccttaactttcatgaggaagagttcttgactcagaaggcctgttagtctctcatgtaaataactacaactagcttgtctcccagacatttctgcatcccagatgtggtgcaacttgggttccaactgaagtctgtcatatttacgtatgtaaaatttgacctccagatttttgtcagcattggatgaatcagtttcttcccaaactctggcttaagctctgaatcactgatcactagtctggtcgggtataatccaatacactgggactcagccatcctttaactcagtggtctccatgctttttggcgccagggaccagtttcatggaagacaatttttccatggacctgggaggggtgggggtgtgggaatggttttggaataaaattgttctacctcatatcatcaggcattggattctcataaggagcacgcaacctagatccctcacatgtgcagttcacaatagggtttgcactcctatgagaatctaatgccactgctgatctgacaggaggcggagctcaggtggtaatatttgcacgcctgctgctcacctcctgctgtgtggcctggtaccagtccatgggctgggttaaggaccccttctttaactcatgaaatctcacggataactgattccagacttcaaatcattgcacacttaaaaaaacttttttacaatcatgtttgttaaaaaagtactgcaggtaggaagaatgacaatacacttgaacgtaaacatggtttgtcatatatattggtcaaaacaaagcatgtatttactattatttagctacaatgttagaaaactgccattgcacatactccagcctggaatttcagtaaacgcttttcactgtctatgtgcaggattatgttaagcccactacattttaatgttattgctgcagttataacagacatcaactaccaattagaataatgttttatttactgtctatatcaagaaaaatcccattttaaaatggttaaaatgatctactatatctcagttacattgtaataggatactagctaatatctgtcatgataaaatctggagtaaatcagttaaattattaatcttgataattttaagataaaataaccctttgttctcaaatttaaaaacttcatattttaatatatttgtgagctaacaatagaaatgcataccaaattccaggacaatgttttctttaagcaaaaaattaagcctgaatgttggtgcctttagaaagtaaacagctaggccaggcatggtggctcatgcctgtaatcccagaatttcgggaggctgaggcaggcagaccacaaggtcaggagttcgggaccaacctgaccaacatggtgaaaccccgtctctactaaaaatacaaaaattagcagggcatggtgatgcgcgcctgtaatccctgctacttgggaggctgaagcaggagaatcacttgaacccgggaggtggaggttgcagtaagctgagactgtgccactgcattccagcctgggtgacaaagagcaagactctgtctcaaaaaaaaaaagtaaacaactatggattttggcctgctatatctctgggcagctcttgcagtcatatctagtcatatgagtcaaagctcatattatcatctttgctgtctttcttcttgcctaccccaccctcttttagcaatgatgataattataacaacagcaaaaatataatataaacattacattagcattttagcaggaactggatattttcataaataggattcctaaataattgaactttattggctaacattaaaaagcttaaatatttttgatggaaaatgtataaaatttacatacattaagtaaaatttatatgaaatatataaaataattatatattatcaccgttttaaaattttcttaatgaccaactgcttcgagttctagaaccattggtgctcttcagatgtatttattcattcacttttccattcattcattcatccattcaacaagtatctattgagtgttactatgtcccaaggaccaaaaaaggcaggagagatacagcagtgaataaaacacaattagtgctgtcctgatggagcttgagttcaagctggtatgcaggatgttttcctctgcaacaaatgggccctgactgctgtggttttagttgttctgtctcctccctctgctgtcagctgtcacctcttggtggcaccctatctctccctttttatctgggttacaattgcaggtctttccccaaagcatctctctatgtcaataatagaccctatccttggatggagcctgagcagttcctatgcttgcagtgtatgtgctgcttccggcccttgcgaggagttcttttatccctactctcagtgtttggaacaaacatcttcctttgctccctttcatcattcatgcgcttgtgtttggaacaaacatcttcctttgctccctttcatcattcatgcgcttgtgtttggaacaaacatcttcctttgctcccttttgtcattcaagtgctcagttctaatgatctgattcaattcttaggcccaatggtctctgcaccatatatatgcaaatgggactcttagaaaagtgtccatcaccaagtgatattacattctaatattgcagtataaaacatgatctttctcatcactgtggtagcttttcctgataattttctgaactgccacctaaatataaaaaggcaggcaccaaaactttcaaaaggaaaggaaatcaatttccctttactcccgtgttttgctcattgctaaaactgcctggtaggagtgcagggacacaagcaggaattctgaattgcacttaaggaaatggtagtaactaaggtgataaggaatatctaacactcattcatagactcatcagatgttggagttgaaaggggatcactctgtgcggtagtgaagcatggtggttaagaactccagttctgggaccagattgtcatacgtcttacaattgtttgaccttggcctggcatctccatgcttcaatttattcatctgtaaaatagtatgtttttcacaggattgtgaggattaaatgaattaatgcaggtaaaacgcttggtagtgtgtctggcacacagcaagcacttagtgttagctattattatcccaatctcgtcacatatttttacagatggaaatacagccctaagcttttaactgaacagcaagttagaggtaaaactgatgccaaaaccgggtgtcctgattctcaccatattatagacttttttttccctgatatcgtgctttcttaataaatgggaagaaatactgaatcatgtacatgattataaaatgactactcagttatacaaaagtccttcttcccctctaaaacagaaatataaaaatacacctttgcccagtgctagtcctccagctcccaatgggcaggattaattctctagaggcatgtgacagagctcaggaggccaggagaagtttaactgtatgcactaataaggaaaccattttcttccttaccttaaacttgtcaacttcagcttttgaacatgttgcatggtatgatagcacctgattcagaagaaaaaaaaataattttaataactagacatgactgtattttctgaaattctcctggcttaaaaataagctttgcttatgtatatcaccttgatttaaaggtggactttaatgtatgacaagaaacaacatgtctaataacattctctgacataattcacatattaaagaatattttataccgggatttttctatgggtagttatgtcatcaaaaggacaatggccaggtgcagtgcttcgcgcctgtaatcccagcatttgggagggcaagatgggcagatcacttgagcccaggaatttgagaccagcctgggcaacatggcgaaaccttgtctctacaaaaaattcaaaaactagctgggcatggtggtgtgtgtctgtagtcccagctattcagggaggctgagatgggaggatcacctgagcccaggaggtcgaggctgcagtgagctgagatcatgccactgcactccagcctgggcgacagagtaagaccctatcaaaaaaaaaaaaaaaaaaaaaaaggcatgctgtggctcaaaactgtagttcccaaaggatgtgaatacttgtcctgtgaaatgctctacaagcaaatgaaaagctagagcatgtgtgtgcgatctgtagcaaacactgtaggttgatgactcaacttccatttcctcacctattctcatttgcctgcttttattatattaggaaagattatattgatatatatctgtgaccccttttgtaagaggattgtgcttccctgccctattgacatcagcattggcatatgacttcttttggtcaatgggaaaagtaacaaatgcccttttgagtgtgtcttcaacagcaatcacatagttctgccacctcctttttccctccaccaagggaagggcatggcctgagaggggccgatccttcagtctgagcccccaaataaagaagatatattgagtagaactgcagccaacctgcagctgatggcatgtcatttgagtgagaatcaacttttgcaatttatctacatcataactcactgacacagaggcttaaaagttaaaaaccccaattcgcaggctccctgcagctggggtggtcctatagggtggcctttatgacacggccttggtcaatgaattataagtgggagtgtcggcgctgcttctttctttttcttccttcatggaatacagctgtaaagcctggaggtgcagcaaaatctggtgtgtatgaggtgacaagcatggcagtgaatgccagcttgctgtgaacagaacagaaagggaaagagaaaggaccctgggctcccctgccccagaattcttgttgtgtgagacaaataaatgcacattggtggcattttataaggcatatttacagacatatacacactcacacataaatagcatatgtatgttatatgttttatgctgccagacacatgtttgttgtggttttgtttttgagacaggtctcactctattgcacaggctagagtgcagtagtgtgatcatagctcactgaagccttgacctcctgagctcaagcgattctctcacctcagcatcccaagtagctgcgaccacaggcatacaccactatgctcaactaatttttgtattgttttgtagagacaggtgtctcatcatgttttccaggctggtctgaaactcctgggttcaagcgatcctcccgcctcagcctcccaaagtgctgggattataggcatgagccttcgcacccagcctacattcttaatctacacaaatctcaaacaaataagtctgggaaatgctaactccttcttcacctacaaaccttagagaatcacagtgcatatttggctgcaaaaagtaaagtaacatgctttatttcattaaacttagtatttcccaaatttaattagccacagaactcccttttaggtaacattaaactggtaacattcaacctaataacctattgaccaagaactttgagaagcactgacctatggcacataccatttgtgtgatacaagcaaagccacaatggaagcagtgtctcagggtggttagaacacagccttcagagtcaggctgccacgcctccacttccgagccctgggagcttgggcaagtggtttaatctctttgggtctcatttataaggtggtataacataatactacacaggcatctcctgcttaacgtagaggctcctcctgaaaacactaacaaggagtctacttttaattatttttaattggaaaaaaattacagtgtattataagatctgcagcaacttcttaaaactcaactaaagcacagtaaaattcataggtatatttaaaacaaaaaatacagttatgttatagttacttaaaatgttactttctgtgggaggctgaggcgggcagatcacctgaggtgaggagttcaataccagcctggccaacatgatgaaaccccacctctacaaaaatagaaaaattagctgggcatgatgatgggtgcctgtaatcccagctacttgggaggctgaggcgggagaatcgcttgaacccgggaggcggaggttgcagtgagccgagatcgtgccattgcactacagtctgggtgacagagtgagactctgtctcaataaataaataaataaataaataaataaaaataatgctactttctgatcataactaatatagttattaacaaaaagtttctttgtgttaagtaatactttctcttccattgtagacttttttttactgagtttacttgtttttccatagttttctcaatccttttttatctttgggaggggactcagaaaaatgttgtattgagagataaatatgttctatgaggtttggttattaaaaataaagatatattctactgggaaattttaaccaaggaaatattctatggagtgggcctgtactttacagagttcttaggaagattaaatgcaatactacatgtaaaataatgtggcacacaaatagccaacttataggtattgtattaatattcaattaaaattctaccaaataaatatttggctggatattatgttatgtcattatcttatcttaaaatatcaataggtatttcagtgcacagatgaattgattttgctcttttgtttcagttttactgtggtaaaatttaatttggctgtcattttattagaatttcttactgttttcaagtctatttctgcagattcactcttcaaactttacctttaaaaaataacccacaaaaactcaagctgcaattcaaaatctatgccaccaggtggtgcttagttaggtttgtttaaatcaactcttcccacttcctttatttaaaaaaaaaaaaaagctatttactccactaaattgaaacaatttgaaacagtgaagcagacaattattacagattaagacttttgctcatttaaaattacaatagtttgttttgtttgttattgagttgtaggagttctttgtatattttggattcaagtcctctgtcagacatatgtttcataaatattacctccagtctatggcttgtctattaattttcttttaatgtgtcttttaataaacagaagttttaaattttgataaagtgtaatttgtcaattatttaaattgctatcgtttcacatattatttctttctttttttttgaagagtctcactctatcactcaggctggagtacagtggcatgatttcagctcactgcagccttgacctccctggctcaagtgatcctcccacctcagcctcccaagtagctgggattacaggaacacaccaccacgcccaggtaatttttttatagaaacagggtttcactatgtggcccaggctggtcttgaactcctggattcaaacaattctccctcccaaagtgttgtgattacaggcatgagccactgtgctcaatctcacatatcctttctaaaatttttttactgcccccgagttgtgaatatatacctcatgctgtcttctacaaactttatagttttatcttttatgtttaggtctatgatacatctgaaattaaatgtatgtacagttaaagaataagaccttaacgaaataaatacatgctttggttactttttcatgattcttaaatttcatgggccacatcttagacctaaagcttttttggattgtatcctgagattttaagcctctactggctaatctattaagtacataggaatttatttattctacctaattagacaaagttaatgataaggaagcttctggtttaccttctggatcttcttgtttctgagagttcctgtttgtaggactccaagaaccagtagaggggggagagaaatggtctagctaaagaatctttcaactaccttttcccagaagagtacaatccatgttggtgagcagggaggaatcatcggctaataggagtacattgttctgaaggactgggccctattgctaaaccacagtccaggaagatggtagcattgttccctctaagaatccgtagaaaaaccaacaagccagaggagtggattccttaagataagagacccttaaatcttgcttaagaactctgattttcttctttaagcagttccttctgtttggtcccataggattttctgggatgcattcagaaagatggtggtgcttcagtttaccctcagtgtttgcaggttttacacacagggcacagcgagaacccagtaatatctgtacctctttcatgtattgtatcaatttagccatcatgcgattctgactggatgtaaatacacaaccaagctaagtttctgcttagctcccagcttcttgttgaaaagcctgtgaccaaatgtatttgccttgctaattttaacaagcatctacacatgctattgtggtcacataggacttttccccatcacctatggtcactggccatatcccatttactcctcaatatgcctcagttttggttctgcccccacctctccactggaacagctcgtgtcaaggctttcaatttcttgccaacaaatccattgatgaatctccaattgccttttgcagcagtattaaacttgggagagcactcactcctattttgaaaagtctcctttctgggcttccatgacaccacattattttggttttcatcctatttctttggctgctctttatgttttcttttttggcccctcatcctctaccttaactgtaaatgtggaagcttctaggctcagtctcttcttcagtgatgccatacactctcatggctttatacaccatcgttgtgttgataactttcaaatctctttgagttttgcactcacatattcgtctgcctacattactaacttccaacttggtcaattcactggcttttcaaatttaacacgtctaaataaacatgaagattttcccatatgtgatagacagaataatgctcccccacaagatgtccatgtcctaatcactggaatctgtgtatatgatatgtcacaaggaggaactgaggttgcagatggaattaagattgctaatcttgtcaccttgagatggattatcttggattatctggctttgcttcatgtaatcacaggggtccttataagtgaaagaaggagacaggagaatgagagtgatgcaatgtaagaaagacttgactagccattgctaactttgaaatggaaggggccacgagcacagaatgcaggtaggttttctgtggaaaaggcaaggaaatggattgtcccctagagtctccagaagaatgtagccttacatacatcttgaattttgcccagtaagacccatttcagacatctgacctgaggattgtaagataataagtatgtgttgttttaatccactaagatcgtggtaattcgttacagcagccacaggaaactaatataccacacaaacccatttctctctcagtcttccccagctctgtaagtgccactccatccaatcaattagtatcaattggatactaatccagtctccttggtacacatcagccagagtgatctttaaaaagtagaaatcaaatcatgccatctcccagctgaaaagtcaccagtggcttcccactgcacttttgctgtatttccttcaatggcatccacagattggtcacaaatctcaggttcatgaggttaggtccaaagcctggatcgtgactggacaggtcctgcaccatctgactgttggcacgttctcaaactaaacttcgtgctgcctgtgctctgtcttctacacacttggccacactcatttttgttcatttttgttcatttatacaccaagcgcttttctacctcagagcttccctgtcctcatcacctcattggtatcatcttctgaaactaagttaaatgtcaccccttcagtgacttattccctgaccaccatgagaaatcagcctctgttaactccattattctctgagttaagtggctgtttccttcatgccacttgcacaattggagttgcctgttatcttattcatcacctgcctcccctactagactgtaagcactttgaaggcaaggattggtctagttttggtcatgaaggtatatcctatccctgggagtatggttgatacttagttggcacttagtaaatatttaatgaatcaaggaataaaaaataaaaacattttaaaacagtatctccattacccatatgtctcactgtttgtattattaatggcctgaattagtgtatttttttcaatgaaatcatgatatgccttatatatgagcataaagtaagcaatgtaggtaggatcaccagttttagcaaataaaaatagaggacacccacagttaaacttgaatttcagatcagcaataaatattttcactatttgtgtcatatgcatacttaaaattgatttatggtttatctgaaattcaaatgtacttaagtgtcctgtattttatctggcaaccctccttctacatgctccaaattaagaaggctagaaacaaatccggaaaacgctaagctacatgccaaaatactgtttctcctttcacccccacctcacaacatctcccaatgacatttcttccaaaatattttatctgctaagcttaccaaatgcctcaagtctgaaatattttcagcaatgctactattatgaggggaattgtgccccccaatccccaccaattcatttattgaatttctaattcccaggacatcagaatatgactgtatttggagacagggcctttgaagaggtacttaaggtaaaatgaggtcatgtgggatgtgggtgtgtcctaatccaatatgactggggtccttacaagaagaggagttcggaatatgaataacagaaatagaagaccaggtgaggacacagagagaaggtggccatctgcaagccagaaagatagccgtcaccagaacctgaacatgttggcatcctgacatggtttggctgtgtccccaaccaaatctcatcttggattgtagttcccataatgtctatatgtcatggtaggaacctggtgggaggtaactgaagcatgggggggcagttaccctcatgctgttctcatgatagtgagtcctcatgagatctgatggttttataagtggcttttcccccttttgctcggcacttctccttcctgtaccatgtgaaggacatgtttgcttcccttctgctgattgtaagtttcctgaggcctccccagccatgctgaactgtgagtcaattaaacctctttcctttataaattacccagtcttgggtatgcctttattagcagagtaagaaggaactgatacacaccctgattgtgaacttctagcctccagaactgtaagaaaataaatatttgttgtttaagtgacccagtctgtggtattttgttgttatggcagcccaagcaagtttatacagtcacataacctcattaacctaagacctgtcacaaatctatggaggccattgaaggaaatataaaaaaagtaattcttaattacttttagcatagtcaatcttcaagagaatcgttactgttttatatacataaataatattatatggctcagataatgactaaaaatcaggcaaatttctatagttgagaataaatcttaacaaattgcagaatcatattatttaaaagtactattgccctaccttcctggataagttagtttcctccacaattccaaactatatatttcatagcaagtatctaggttcatcatacatttttgaataataatacctttgatcaagtaaaaatgctttaattgaatgcattataatagttttgaagaaagaggcatttgtaagacatggttttataaatatactatcatactctatgagaaacaggttatgagagtattactataacgtacatatcagttaattttttcgacagctaaataaaatttgtgtaaagcatacatacaaaagcaaacagttaatccacagaacacttgatgagcattaaactttcacaagaaaatttctgatagatggatttatcttttgtgttggtattaattgagcaaatatttttgactcagttttgttggtgagctctgacttaagaaatttttatagtttctaaaataaatcactatttgcaaaaccataccaactttaattaacttttggattgaacttgcttccagcaaaacaacaacaaaaaagcagataaggcaattatcggacccatgaaagagagaggaaagaagtcacgtttttgtgttgcatttacacagcaagaaaagacaattaactatatttcaaaagaaaaacaatgggcagagctatgagataggaccactggatcaagccttgccattctctacatgcagttcaggaccagaaccaaatgcttgtcttgcagcccccagaactgtccctgagtagctggaagacagacctcttgcaccaattgtcttgaatgttaatttgttgtggatttgggcagccatttgctcctgaaatgagatatggaccattataccagcagagagaaacacaaatgtaaagaagcacttaagagcgaggaggaacaaagaccccactgaggatccagactgagtgtctcaggcacaaaagggctgcatgaatacgtttattgctctgctggcaaagtggcacttggtaaaggctggatggccgacttaagctaagctgatctgaagtaaaatcccaaataatttatattgatgagctccaaagaaataaagaagctttgctctcagcagtagtccttaaactaagaaagatgacaaaccacaaggaatgaaaagccaatttacttggaataacccgacagaagtgtcatctaactatatgaagaaccatactccaggatttcttaacaagatgatgacagtattcaaagacatggcaactgaacagacgcgttgaaactgagaaatcatcagtttttattgtcaagtatttaagacactgctgtataatagaatgaaatgttcaaaaggtacttcagataactgtgtctgctgtgtgatctgttatcatgaccttcagaatcgatcataaaaaatatttttaaaaaatctaagaaagattcatttttttaaaattgaaagtagaataaaagatacctgccaaacatggggtaataataaaatacaggcatacctcagagatattgagagtttggttccagacgacctcaataaagtgaatgtagcattaaagtgagttacatacgttttttggtttcccagtgcatataaaagttatgtttatactatgctgtagcctattaagtgtgtaatagcatatctaaaaaacaatgcacataccttaatttaaaaatacattattgctagaaatgctaatgatcatctgagccttcagcaagtcgtaatatttttgctggtggagggtcttgcttgaatgttgagggctgctgatagatcagtgcggtggttgctgaagctatggcaatttcataaaataagacaatgaggtttgcacatgaattaactcttcctttcatgaaatatttctctgtagcatacaatgctgcttgatagcattttacccacggtagaacttctttcagaattggagtcagtcctctcaattcctgccactgttttgtcaactaaatttgtgtaatattctaaatattttgttttcatttcaataatgttcacagcatcttcaccaagtgtatattccatctcaggaaaccactttctttgttcatttatgagaagcaactcctcatctgttcaagttttaccatgagactgcaacaattaagtcacatattcaggctccacttgtaattctagttctcttgctatttccaccacatctgcagttacttcctccactgaagtcttaaacccttcaaattcagacatgagggttagagtcaacttcttccaaactccggttaatgttgatattttgacctcctccagggaatcataaatgttcttaatggcatttagaatggtgaatcctttctagaaggttttcaatttattttagccagatccattgttggaatcactatgtatggcagctacagccttacaaaatgtatttcttaaataataagacttgaaagtagaaattactcttgatctatgggctgcagaatgaatgctgtattagcaggcatgaaaacaacattaatatccttgtacagctccaccggagtgtttgggtgactaggtgcattgtcaattagcagtaatattttgaaaggaatctttttgtctgagcagtaagtctcaatgggaggcctaaaacatttagcaaaccatgctgtttactgatgtgttgtcatcaagactttgctgttccatttatagtgtacaagcagagtagatttagcataattcttttattttttattttttagacagggaatctcactctgtcacccaaactggtcttgaaatcctgacctcaagtgatcctcccgcctcagcctcccaagtagctgggactacaggtgtacaccaccacttctggcttgatttagcataattcttaagggcccgaggattttcaaaatggtaaataagcactggcttcaatttaaaatcaccagcaacttaccatagcccctaacaagagagtcagcctgtgctttgaagacattgacttctcctctctagttatgaaattcctagatggcatcttcttccagtagaaagctgttttgtctgcattgaaaatctgttgtctactgtaacaacctttatcaatgatcttagctagatgttctggataacttgctacagcttctacatcagcacttgctgcttcatctcacacttttatgttttggagatggcttcttcccttaaagttcatgaatctctgctagcttcaaacttttcttctgcaacttcctcacctctctcagtcttcatagatttgaagagaattagggccttgatctggattaggctttggcttaagagaatgttgtggctcatttgatcttttcttcagaccactaaaactttctccatatcagcaaaaaggctgtttcactttcttattattcatatgttcactggaacagcatttttaatttccttcaaaaacttttcctttgcatttacaacttggttgtttggcataagaggcctagctttcagcctatctcaccttttgacatgcctttctcactaagcttaatcatgcctagcttatgattaaaagtgatagatgtgcaactcttcctttcactggaacacttagaggtcattgtagggttattacttggcctaatttccatattgatgtgtcttggaaaacagagaggcccaaggaaagggagagagatggggaagagctggtcagcagagcagtcagaacacaaaacatttatcaattaagtttaccgccttatatgggcacagttcatagtgccccaaaggattacaatagtaacattaaaaatcactgatcacagataattgtaacagatataataagacgtataaaatgttgtaagaattaccaaaatgtgacacaaaaacacaaagtaaacacacactgctgcaaaaatggtgccaatagagtttgcggtcaatttgagaccttgcccatcttggctgaattctcaatttctttttcttttcttttttttttttttgagactctgtctgtcactctgttccccaggctggagtgtagtggcttgatctcagttcactgcagcctccatctgctgggttcaagagattctcctgactcagcctccaagtagctgggactacaggtgcgtgccaccacacccagctgatttttgtagttttagtagagaaggggtttcgccatgttggccaggctggtcttgaacttctgacctcaggtgatctgcccgcctctgcctcccaaagtgctgggattacaagtgtgagccaccatgtccagctgaattctcttttaattaaacttcttgaccaaagagatatgccgtttttgcttttgttttatccaaaggtatgaagccaactctccagtggtttgagtgggccctcaacttgggatgagaaattcattcaccattttttcacccaaatcaaaggtttaatgtaatcattctatgtcattacccagattaaaatgttaattttagtaaccacactttaaatctcaatctaatttttaaatgcaagccattaagatgcattcataaggctaaatactattcattagctagtacataatgacaacactgacattcatttggcagtttcccaaactatctttccctctaaatattggtacctgtgcccttgccagaggataacatatcttgtattatataaatcttgaaatttaacaggtactttgcaactacatccaaattattatctggtgaattaagatgaccacacattctttgacactatttctatgagaggtggggtctatgtcccttccctttgactctatgtggggtttgtgtttaaaccattaagttgccaaaaagtggttaaaaagcaataaataaacaaaacattatcaacattcaactgggacttgccaccctatgccatccaaagatttctgtaatcaggtgtcaactgaagcttccttgtctttcaaaatctaggtaagatcaacgtgaacccctaaactcatgaaatactatggaaattcaaagcctttttcaaaatgtctacatattcttggcaggtttatattctcatcttggcctttgagttcttatgtattcttgtgctgtatctgttatataatcatcacactaaatgtgaaattcagctccctcctcaatttccacaccaaaaaaatccactcacatcaagaattcataaatttagtataatgtgaagaaggttctttcttttttgcttccttccttccctcttcccttcttccctacttccttcctttctctttctccctcctttttcttctctttctctccctttcttttctttctttccttcctccatccttcccttccttctttctctatctctcccctctccacttgctttctgaaaagacaaattatgaagttgcatcaaaacaaacaaacaaacaaacaaacaaacaagcaccctctcatgaagtatcagctccaccattctcaaaatagattttgcccctgccaccaatggggcatttcactgaccattaatctcgtacagtctcagcctttactcatatttctggcttctctccaatgtaactttctctttttctcttttccccctccctatattcaaatgtataataacacaattctcttcatttctcatacagaatcatttcccacatcctctgattactagaggcagtcaatattcattccctcataatctgtacaatatcaagagggcttgtcaaggattttcccatacaactccttccttagtcttagtgaggaatgctggggcctatggttagataacatttcattcaccttgttatacttcagaagttctcatatgtgtcttaagttatttattagctcagtggttagattctagtcttgtccatgtttttgaggtggtttttttccccctggaatttggactgatttctaaattctttctgagcaacaagtacccaaactaacattttcatatttgtcttccattttttctattaagctcattaaaattactactaccttttttcctgaggccctgcaagctaaagcttattccttgcaatataggcaagaaaaatgagtcagattgccactgcattactcttctgtaactaaagatgctttaagtctaacatctggatagattttgcccaaaattaacctttgtttttattctgtttccacaaaaacgcctcttattgaaaatctgtttggctttgtatttcagacaaaagggtactggttttccagcctattcacttagatttcaaatggcattgatctcttcctataagcattgttaaactggggttaagcattttattaattatcactaggtgctatttcatttaaaaaattatttgttatattcaacaggtattcagatgggtaaagtttatatcttccaggctaccaaagttccagacaaacatgataattgactcaagggttccagcctgtgccactgcaggaaggactgagtccctataaatcattagataaggtagtgagagatttctatgcctccagatcagatagagatgacagctcctgttcaggatgaagcagttacagaagatgaaacctctgtccctctacaaccttttaggattaaggaagagtgcacagtctctgaggagagatgaaaaaggaattcagcaggacttgtttcacaagatacagaccacaaagactgctgataaaacaggatgtggtaaagaagtctgccaaaacctgccaaaaccaagatggctatgaaaacaacctctggtcattctcagtgctcattatacactaattataatatattagcataccaatggaaactccaccaacatcataacagtttacaattacaattacagttacaaatgccgtggcattgtcctgaaactaccctatatgatctaaacgggagaggatccctcaattctgggaactctcagctgctttcccagaaaactcatgaataatctactccttgtttagcacataatcaaaaaataaccataagtatagtcagtcaagcagcccatgctgctatctgcctatggggtagccacccttttattcctttagttaataaagttgctttcactttactctgtcactttactgctggctttcactttactctatcactttatactttattgctggctcttgaattctttcctgcacaagccaagaacccatgtgacctcccaagctgagttccaattttgaggtttgccctgtgacatctttggcttatgaaagcaatctgattaagatccagcttaaaattataatcatgtaagtcaactctactacatagttttgagcacagaaatcagaattcatgctatgaattgccctaggcttgtagtctgaacttgttctctccctatttgcaggggtcagtggtaggatttaatctgtttatacggattaactgctgtatagattacctacagcaattcttaagacaggctgtttcctttcatttagtaaaactttgttttcttaatttgtcaatgcttagtgtgccaacaatggggggccagtatagtttggtctttgagcataggggctttgtgtcagactgctgagctcacaatcctggctcactagacctgtaaccttggcctaattatataacctatgtctcagtttcctcatcagtaaaaggtgagaaatatatgcacttttcaatcatatttcactggccagagcaagttacagcactccacctgatttcaaggaagtgaggcagtgtaatatgatcatgggcccagataggagagaaccagaaaaaaaactgatgatgagcactgatggtaaccacaatggtttgggcaatcaaatagcaagttatgttagaatagcgtttaaagacaattctgggagggcagccaagatggccgaataggaacagctccagtctacagctcccagcatgagcgacgcagaagacgggtgatttctgcatttccatctgaggtaccgggttcatctcactagggagtgccagacagtgggtgcaggacagtaggtgcagtgcaccatgcatgagccgaagtagggcgaggcattgcctcactcgggaagcacaaggggtcagggagttccctttcctagtcaaagaaaggggtgacagacggcacctggaaaatcgggtcactcccaccctaatactgcgcttttccgacgggcttaaaaaacggcgcaccaggagattatatcccacacatggctcggagggtcctatgcccatggagtctcgctgattgctagcacagcagtctgagatcaaactgcaaggcggcagcgaggctgggggaggggcgcccaccattgcccagacttgcttaggtaaacaaagcagccagaaagcttgaactgggtggagcccaccacagctcaaggaggcctgcctgcctctgtaggctccacttctgggggcagggcacagacaaacaaaaagatagcagtaacctctgcagacttaaatgtccctgtctgacagctttgaagagagcagtggttctcccagcacgcagctggagatctgagaacgggcagactgcctcgtcaagtgggtccctgacccctgacccctgagcagcctaactgggaggcatcccccagtaggggcagactgacacctcacacggccgggtactcctctgagacaaaacttccagaggaatgatcagacagcagcattcgcggttcatgaaaatccgctgttctgcagccaccactgctgataccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacggaacaaagctggacggagaatgactttgacgagttgagagaagaaggcttcagacgatcaaattactctgagctacaggaggaaattcaaaccaaaggcaaagaagttaaaaactttgaaaaaaatttagactaatgtataactagaataaccaatacagagaagtgcttaaaggagctgatggagctgaaagccaaagctcaagaactacgtgaagaatgcagaagcctcaggagccgatgcgatcaactggaagaaagggtatcagtgatggaagatgaaatgaataaaatgaagcgagaagggaagtttagagaaaaaagaataaaaagaaacgaacaaagcctccaagaaatatgggactatgtgaaaagaccaaatctacgtctgatcggtgtacctgaaagtgacggggagaatggaaccaagttggaaaacactctgcaggacattatccaggagaacttccccaatctagcaaggcaggccaacattcagattcaggaaatacagagaacgccacaaagatactcttcgagaagagcaactccaagacaaataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaacactttacagacaagcaaatgctgagagattttgtcaccaccaggcctgccctaaaagagctcctgaaggaagcactaaacatggaaaggaacaactggtaccagccgctgcaaaatcatgccaaaatgtaaagaccatcgagactaggaagaaactgcatcaactaacgagcaaattaaccagctaacatcataatgacaggatcaaattcacaaataacaatattaactttaaatgtaaatggactaaatgctccaattaaaagacgcagactggcaaattggataaagagtcaagacccatcagtgtgctgtattcaggaaacccatctcacgtgcagagacacacataggctcaaaataaaaggatggaggaagatctaccaagcaaatggaaaacaaaataggcaggggttgcaatcctagtccctgataaaacagactttaaaccaacaaagatcaaaagcgacaaagaaggccatcacataatggtaaagggatcaattcaacaagaaaagctaactatcctaaatatatatgcacccaatacaggagcacccagattcataaagcaagtcctgaatgacctacaaagagacttagacttccacacaataataatgggagactttaacaccccactgtcaacattagacagatcaatgagacagaaagttaacaaggatacccaggaattgaactcagctctgcaccaagcggacctaatagacatccacagaactcttcaccccaaatcaacagaatatacattcttttcagcaccacaccacacctattccaaaattgaccacatagttggaagtaaaggtctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacgtaatgaaatgaaggcagaaataaagatgttctttgaaaccaacgagaacaaagacaccacataccagaatctctgggacgcattcaaagcagtgtgtagagggaaatttatagcactaaatgcctacaagagaaagggggaaagatccaaaattaacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttcaaaggatcaacaaaattgatagactgctagcaagactaataaagaaaaaaagagagaagaatcaaatagatgcaataaaaaatgataaaggggatatcaccaccaatcccacagaaattcaaactaccatcagagaatactacaaacaactctactcaaataaactagaaaatctaggagaaatggataaattcctcgacacatacactctcccaagactaaaccaggaagaagttgaatctctgaatagaccaataacaggatctgaaattgtggcaataatcaatagcttaccaaacaaaaagagtccaggaccagatggattcacagccgaattctaccagaggtacaaggaggaactggtaccattccctctgaaactattccaatcaacagaaaaagagggaattctccctaactcattttatgaggccagcatcattctgataccaaagccgggcagagacacaaccaaaaagagaattttagaccaatatgcttgatgaacattgatgcaaaaatcctcaataaagtactggcaaaccgaatccagcagcacatcaaaaagcttatgcaccatgatcaagtgggcttcatccctgggatgcaaggctggctcaatatacacaaatcaataaatgtaatccagcatataaacagaaccaaagacaaaaaccacatgattatctcaatagatgcagaaaaggcctttgacaaaattcaacaatgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctgtcaccactcctattcaacatagtgttggaagttctggccaggacaattaggcagaagaaggaaataaagggtattcaattaggaaaagaggaagtcaaattgtccctgtttgcagatgacatgattgtatatctagaaaaccccattgtctcagcccaaaatcttcttaaggtgataagcaacttaagcaaagtctcaggatacaaaatcaatgtacaaaaatcacaagcatttttatacaccaataacagacaaacagagagccaaatcatgagtgaactcccattcacagctgcttcaaagagaataaaatacctaggaacccaacttacaagggatgtgaaagacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcgccatcaagctaccaatgactttcttcacagaattggaaaaaactactttaaagttcatatggaaccaaaaagagcccgcatcaccaagtcagtcctaagccaaaagaacaaagttggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagacatatgtagaaagctgaaactggatcccttccttacaccttatacaaaaattaattcaagatggattaaagacttaaatgttagacctaaaaccataaaaaccctagaagaaaacctaggcattaccattcaggacataggcaagggcaaggacttcatgtccaaaacaccaaaagcaatggcaacaaaagccaaaattgacaaatgggatctaattaaactaaagggcttctgcacagcaaaagaaactactatcagaatgaacaggcaacctacaaaatgggagaaaatttttgcaacctactcatctgacaaagggctaatatccagaatctacaataaactcaaacaaatttacaagaaaaaaacaaacaaccccatcaaaaagtgggcgaaggatatgaacagacacttctcaaaagacatttatgcagccaaaagacgcatgaaaaaatgctcatcatcactggccatcagagaaatgcaaatcaaaaccacaatgagataccatctcacatcagttagaatggcaatcattaaaaagtcaggaaacaacaggtgctggagaggatgtggagaaataggaacacttttacactgttggagagactgtaaactagttcaaccattgtggaagtcagtgtggagattcctcagggatctagaactagaaataacatttgacccagccatcccattactgggtatataccccaaggactataaatcatggtgctataaagacacatgcacatgtatgtttattgaggcactattcacaatagcaaagacttggaaccaacccaaatgtccaacaatgatagactggattaagaaaatgtggcacatatacaccatgaaatactatgcagccataaaaaatgatgagttcatgtcctttgtagggacatggatgaaattggaaatcatcattctcagtaaactatcacaagaacaaaaagccaaacactgcatgttctcactcataggtgggaattgaacaatgagaacacgtggacacaggaaggggaacatcacactctggggactgttgtcgggtggggggaggggggagggatagcattaggagatatacctaatgttaaatgacgagttaatgggtgcagcacaccagcatggcacatgtatacatatgtaactaacctgcagattgtgcacatgtaccctaaaacttaaagtataaaaaaaaaaaaaaagaatagtgtttaaagtcagagcaaatgagtccaatgtatgaactctagtatatacatttgtggtttatttgacttttgcttacttcctgattctctcctgtgtttcagggttgtgtttgatagatatgatctccaaataagtaagattatagtatatgtttcttaaatattgtttatatttaacatacatagtacatagagtatatgaccattaagtactattgcttttactatattttgttacctataggagaaaataattatgttaaggaaaatgattggcttatttttgttctataacttttgtgaaatgcttagttattaatttcaatcatttcaatgtccttaaggtgaaagaaattgcctatttctttggaaaacgttgcatgtgataatgagtcttctgatttttctaagtttttagtattctcctataaaggatctcaggcattaacacttaaaaaggttttaatgattaattcttagtgagattaaatatggctctatacatatgcatattggactataatttataactatttcaaaattagtgttccattcccacaattgcattactcctctcattctgttttaaagtgaggctgtttttcttaatcatataggttattaaatgtattaatgtttcacaaattcttttctaatgaactacttgcttatttgcttttctcattaataagaacagagaagaacatagcattcttcgggtataattgagcaacttggattggttattgctgtttctgaaaccactataatatgtgccaaattgttttcaaatctataacttatataactagaacttttagtagtctgatttcacttaagaccatacttctgagtagcatgttattaaatatttatatatactgattttccattcctctccccccatggtttttgcataatcaaaggattaccattatgctttgagagagagatacattgcttatttgcactggttatgcaggaacaccatggagcattttatgtttgaaacagcgtggctctgctgggagctcctgaagtaaaaggaataaggagagatcaggcctagtttgggccactgtcaaactcactagggccacagaagtgactcgtcaccatggatgaaataaaaatgcaaagggcaatttccaatctgtctggaccaaggttgctggccatggagatcagattagatttgagtaaaccagggaatcacatcaatgcagtctgggatgtaccgatgaatgaaccattcattcaatcaagacatatccattgaagacttaatttgtgcccagaactgcgcagtcactaaacaggcaaacatacaagttgaaataattgctacaaagtcaagtagcaaaatgcgaaagaaaccatgggaggaggtgggaagaatggcagggagtggcagggaagttggttagggatgacctctttgagacatgatacttaagctgagacctggaaaatgataaagaaccagccagccaacgggtaggggaagagctctgggcagagggagcagtcacctttgtgtggtgttagggcatgtaagtgggcagaggagacaggagagctgggcacaggcctagtcatgcagggcctttcaggcggataaagacttcattagagtccatgggaagccatccagggtttcaggcaagaggctgacattgtctcattagttttccagtcattatgaccttggaaggccctaatgtgcccctcctcagtgataccccaccccagaagtgaccaccactctgacttttgtggcattcattcccttggggtagtatatagttttgcctgttcttgaacttacataaatggattcatattacatgtagaacatggccctggttgtgtagagggtggactggaggtgggcaagagtggatgtgggagggaaaacagtggctggatgaggatggtggatgcgagacctcgatctgtggagacaatacacagggatctgcaaaaaaaaaaaaaaaaaaaaaaagagctccactcagggaggaaaggaccagagccacagaagcactcagtcccgggtcccggtccctgaaggaaggagccatacaccagagaccatcaaaaaggaggaggaaagggcatgtgaggccacatacaagcaaactggaacccaaaacaaggaaggctgcttccctctgcttgtgagtacctggctccatcgctcacactgcggcagtacagggatcaggcacactgacttgctccggtgtctagtcagtagaaggatggggagggactggaccactttggttcacagccatctgaagctgcagatagtgaatttcattatgaatttgaggcaggaatgggcaccagtattgggaaacacaatgcctttaaacatttctcagtcaacaaatatttattcagtatcagctatgttttaggaactattgtaggtgctagggatacatcagtcaaaaaaagagacaaaaatctctgccagtatggggcttatgatctagagtggagagagtggagtgaaataaggaaaaggtagtgtatcaagtgatgatgagtgctatggagaaaaacaaagcagggaagggagattagcatgttgggggcaggaaagggggcacggcagatttaaataagactgtctgggaaggtggcactgaatagtacaaataaaacctgaaattgcagagagagcaagccgtgtggatatcaggatgagagggtgtagggtgcaagtgcaaaggtcctatggcacaaatgtgcccagcttgtttaaggaaaagcaaagaggccagtgggacagagtgaggaaagtgagaataacaggaggtcatagagggaccagggattagatcacagaagttttggaaaccatcgtaacttggccttttgttaaaacaagtaagtgtaggcacttgctggggataaaaacaaatttcccagaggcaggctcatcgaattgggcccagtatacttgctaaattaaggagccattttcctccttttcaaagagataaaggcagctttcccctcatttctgttaagctcaggggctgctgtcagccccacagacccacatgagccagatctttttctttggatgaatctaattccttggcaatctgggtatgattcccacccctacccctacaccgaccccccaacacacccgacaaacgaatgtctgctgtttgttaattggtgtctggtttttgtttgtttgtttgtttgtttgtttgtttgtttttgagacagagtctcgcactgttgcccaggctggagtgcagtgtcacgatcttggctcactgcaacctctgcctcccggattcaagctattctcctgcctcaatctcccaagtagctgggattacaggtgcccaccaccatgcccagctgattttttgtgtttttagtagagatgaggtttcactatgttgaccaggctggtcttgaactcctgacctcatgatccacctgcctcggcctcccaaagtgctgggattacaggcatgagccactgcacccagccggtgtctggtttttaaaatggcattctaacctttattcttatttcattctacgggatgaatttaatcacggaagttgaatgtgaggttgggagatgggtctgatggggccaaatttggagtttctggacaatgggaggagtgtttagggtgggacacacttttggaaatagacatataaaaatagagggtttgaaaacttccttacattcatcacctggtgacatctgatgacaggaacgggaaggggctacaacaggtaggtttctccagtctctgctctgggcccaacacctgagccaatgttctgattggctcctgtttgcttccattccaagagcagatgtttttgctagaaagtgttgattacccgcttcggcttaactgccacagagtttatcaatatatgtgatgtcacacacacacatttagggcatggagaagggggtgggggcttttatgctctttgtttttaggtgctagtcaaagaccttctgaaatgccttcttgggtacctaaagtcaggcctctcctctttccactgggcagggaattgaagataaccccaagcaggttttgttttaccctttattgatatatgataatttacatatttatggggtacatgtgtttgttacacgcaaagaatgtatatagatcaaattagggaaactgggctatccaccaccctcagtgtttatcatttttatgtattgagaaatgtggatcccacctccctaagactctgcatcatcacatactttcaggtggttagggagggccacgtgaagcaaaagtctcccatgttgtctctggggattgtagataattattactattattttgtttaaactatatatatatatatatatatatatatatatatatatatatctttgctttaagatgccagtatggggcttatgatctagagtggagagagtggagtgaaatatatcttaaagtgatatatatatatctttgctgtaagattttagctacagtaagtctttttggaaaggcctgactgtgactttaaggccataatgaaggcaggtgctgggatggagacactcagaacaggagcctggttagtgtctttgtgacactcaggtgactgacttgtgagagttggcctgggccccaagctttgaagggctccactctgtctcttctatcccctggaaagaaaagtccatggatttccgggacgatgtcattcagattatattccaggtacctgggatcagccaaactaaattccaggtatctcaaattcccccaggtaccccaaatgccccaagcccattgccagtacctgcatgggcttccccctgagatttgggctcctctggatgcacctctgcaggggctgtgtgtggggttgaccaagtttgaaatgtgcataatgtagggctcacacctgttaaaatccagcacagtgtggagggggatctagggggaaggggaggtgagtaactccaatgtcttctaaacggtttgtaggcttagttccttctggttggatttggggtgtgatctgccaccttttgatagcagcatcctggtactgtccccttatgacagcactatcaagatactgagcactgggcctaaagtgaatgtcagtttcttacttggccaactataaacacggctttcataagccaatgttttacaagagaagccagcaggcaaaggcatggctgttccactacagaaagctgttctctttcgcacactgtggggtaactgacctgagtcaactaacttagactcagcaactgctccagaaaaaagtgagctgctggagcccaacagagacactggctattactcctaggatctgcactgtaaaaccaaaagcattagggttgaaagaaacagtttccttactgacaagttagtaattttcagtgaggtaaaagaggaggaggaggacaatacatttccaagggtgctttattcagtttgagcttttaaatcaatgggcaagtcttcattatttacccttaattactgtcatcacagtctcataaaccagaagcatgcccccggtgtagaaaacaggccctttaccttggctctcctcccacttccatcagggcagccaagggctccagtggtaaatgctctcctgcaactgataggacattcctcaaaagagcccttgcggtacaatttgtacaacatggccctttgaaacagatagatctgagcttgaatcctggctctacttctagctgtgaaatgcaagccacaaaacctctctcagcaagttcctaaacctttctgagcctcaatttgctcacttgtcaaatgggaatgatactgtgtactccatgctgttttggtgaaggttcaataaaatacatatgcaaaacacataattaatgcctgacacataagcatttaataaatatagcatttcaaaaaggaccaaaataacatagcaaaagcagaagaaataagaagaatgtaaggtaatgaaagaaaaattttaaacaaataaaccagaacaaatgcatccaaataacaattacttcttaaggctactatggggactatgttaagttactccaaatgttctgctgtgtttgggaactcttatccaggatctcaaagtacgttccttagaccatgacagtggtggcaaatcatttgagagcagatttgattttggaaaaccacaaaaatcatttaacagaaaataaaataaaaacatgatcaacaattttgttttaaaaaagtatgattatgaaatactaagataaattttatcttctcagctgccaacatgatctctctaaaatgtcaaactaatcatgttcctctcctgctgaaaacacttcaatgattctccactgcttttagaatcaagttcaaattccttcatgtaacacaagcatcctttgtgatctgaccccgggtagctctccagcctcaggccctgcctctcccctgctgtgcccttttccctgtctgcattgaggtgcttgaatagcatgctacttcagttctccctacttttacctatgactttccttctccatggagcattcctgctagttgtctttagaaattgtatagctcactgctacctgtcactctgaaattgccttctatgcaaagcagttatgtctgactttgaacaagatgccccctcctctatgcttcccctaacatatctacctctttcttggagctcgttacacttggcagtaatcatactttcatttatctctgtcctctattagactgaaatcacatgagattgtactacagcttatgaaatttacatagtcgtagtctactctatgctgttttggtgaaaatcgagttcttggcacataataggtgatccattcgtaacattaatgattatttatcttacaaatctcatggtttccattaaagtgtttcaaacatatttaaatgatgatataattattagaagtagtacatagactcccctgcagactatttgcagagaagcaccatttgtgcatacacataagttcttttttgttgctgttaaaaaattaccttactggattctggtataaaatgatatctgatgaagaaaggagtagtggaatataaccctaagtgtaaaacaaatattggtgtatatatatcctgagtatataaatatattgagataaataaacacataaacagagagaagagacaaatatcccatacaaaagaattctaaataatatatgtagataattcctcttcaaggaggtggagcataactccccactccttaggtgtgagctgtgcatagtgacttccttctaaagactacagtgtagaaagaggaaaaaagagtaactgtacattggggaaacctgacaaacactacttccaccagacgatcaaggttaacatcaatcatggtaagtcattttgatagtatgtccccttgatatgatgtgattaaaatggcacttaacctctgtgccttcctcccccaaacccataattttggtgtaatcgtgaggaaaacattgaacaaattctaatagagggaaactctacaaaatacctgaccagtttgctcgagactgtcaaggtcaacaaaattgaaaagtatgaaaaagtatcacagccagggagagtctaaggagacatgatgaatcaatgtaatagggtatcctgaatgagatcctggtacaaaaaggggatatttggttaagattaaggaaatatgaatcaagtatggactttagttgataataatatagcaatatggttcattaattataacaaatgtaccatatcttaatagaggaaactgggtatgaggtataagggaactctctgtactatcttcccaatttttctgtaaatctaaactgtcataaaatataaagtttatttctaaaaaatgatacctcacggctgattctccatgtaagttctcccactttccacagaatacctaaatgaaaacctagaaaccatcaataactaaaactgataacctactactagaatatgagaagaattttcaccaagtataaggcagatgcagctggactcagaaaaataactagtagcttaaccatgctttatctccacccccaaaatgaagcagtcccccttggtctgaaagaagatgggaaggcattgttctgaaagcagtctccagagggcagtgttcctttctgtactgtctgagctctcattcagagacccaggatctgtgctaaccagaaaattaaccagttcaccttctactgaatggtagctgtttttgaagtattcgctttcatcttgtgggaaagagtcactgcaaataaagcactgtatgatggtggggggtgggggatgttataatataaataactactacttttgacattatatgaacacagtggtaaagattttactggcgttaattcacttcatcgttattaacaatcccacaaggttgggaagtgagaacaatgaagcacagagaaattgacctgccctgagatgcacaggtaaaaaagtagcacagctgaaattaaaatcctaatagtctcagaacaaaggttaaaaaaaaaccttaagaataatcctaacagtctaattaaaaaaatttttcttttttttttttgaaacagggtcttgctttcttccccaggctgtggcatgatcatagctcagtgcagcctcgaattccagggctcaagggatcctgccacctcagcttcctgagtagctgggactataggtgcatgccaccatgcctggctaattttttttcccttttgtagagatgagatcttgctatattgcccaggctggtctcagactcctggcttcaagcaattctcccaccttgacctcccaaagtgctgggattacaggtgtgagccaccgtgcccagcctctaacagtctaatttaaagcctgcccttttaatcacctaactgtagttcattcaaaaaccctcgtagcagcgtatgctgaggattgagattcttgtactttaattatgatttttatttgtattttactatacttgatccactcaacaaacatttcctacatgcctactgtgtgctgctggtactgggcacataatggtgaaccagacccatagacatatttctatacataagggatccagaatccactgagacctgatggggggaagaatattccatctcagcctagcaggagtacactagatctatgtctacatgctagatgctgagaatcagcctagtaactaaatattagtacataagtttgctccccttttgtatatctaaccaaggagattcaacaggacataagtggaccacaaaagagctcaggggcaaccccaaagtcttgcctgttggcaaacactgcagtccaagggaaggagagaagcaccctaaaaacccagagagaatgttttaatacatctgataattgtttcatgcatgcaaccttttagaaatcttatgcttagtatcttcaaagatacaagaagaaagagcatcattgaaagtggatcagaaaaccatataggcaaaatatgtttgaatgaaatttataaaacaaacagaagaatgagttaacatagttcaactgtcacttgctcagggtggtctctcctgaatgtatccacagtagccccatatttttagtcactttttattaaaacatcctgctttattttctttatgatacagtataataaatttatcttgctaatttatttgtttacttgtctactgcctgtcttactagaatataaggttcatgacaatatgaatactgtttgatttttaactgctgagtcctcggtatggagaatggtgactaccaaaaagtagaagctcaacaaacatttactcagtgaatgaatatatagacaacaacagagatggttaaaatgtggaacagtttcaaaagaactcaaattataatagcagaatttaagcccacattggagttaataaatattttttaaatgcaagagctcagaatcaacaatcaatggaaaagaatgcagaacagaaatgggccaacacttattttttaaacaatggtgccaaagtgatcccatggaaaaagaagaactttttaataaatgataaatattttatttaaaaatgaacctcaatggctatcaagatgaatcatagagcaaaatgtaaaagctaaacccaaaaaagcttttagaggagaaaacagtacaatatattcttgatttgtgggtaggcaaaggtttcttagatcactaatagcaataagctttaaattaaaaaactgataaattagacttcatcaaagctaaaaagacaccatgaaaaaatcttatcaaaagacaccatgaaaaaatgaataagcaagctgcaaattgggtgaaaatattgacaatacatatatctgaccagggactagtatccaggatgtataaagaactcttccagtcaacaataaaaagacaagcaatcctattaaaagtgggcaaaaaaattggacagctcacaaaagaagacatccaaatggtaaataagcacatagaaaaagagtacaacatttttagtcataagggaaatgaaaattaaagccacaatagaatattatgcacttaccagaatgactaaaattaaaatcaatgatagcattaaatactggtgagactgcagaacaactaagactttcatagttacttgatagaaatgtacaatggtatagccactttggaaaaatatatacctggaagttcttataaaactaaacacatactgaccttttgaccaagtaatactaggtattagcccaagagaaatcatagcatatgttcacaaaaatacttatacaaaaatgttcatagcagctttattcacacagccccaaaatggaaatagccaaagtattgatcaagaggagaatggataaactatggtataatcatataataaaatgttacttagcaattaaaaacatcaaagttatatacccaacctggacaaacttcatatgcattatggtggttgaaagaagccttacctaaaagagtacatattgtataactgaatttacatgaaattctagaacaggtagaattatggtggaaagaatcagaacactggttgtgtctgggggtagcagtgatatcctggggacggagcaaaagggaactttctggggtgataatatatcaagacatttttcctattgaaaaataacaaaattgttgttttaagctaatacattttggggcattttgatatgcaagattagattaccaaaacaaaaagattatgcctaaccaaatgttatgaatacaggtatattcatactgcaaaagcacttgtataaatttaaaaatttgctaatgaaaatgtaactaaaaatctacaatacatgaacaaaaactaggaaactatagggaaagtgcatactccaattctttttttatatagtaagaaattaaaagatactcattcatttttgtcttgagaaatattgattaaagaatgcttttgtaaaaaaaagataacaaataattttcacttcaagtaaggactaaaagaaactaagcaaaatatagtccaaatagtaaaattcaggaaaagcaaagcataagaaagtagaagctcagatagaataagatgaaataatagatataaagcaaaatccctcattaaaagcagaatcttagattagataaaaaattatattcagagcagtgagattatgtcacttataaaaaaaatctcctaacaacaacaacaacaacaacaacaaaaagaccaggagcagatggattcacagctgaattctaccaagcatacaaataactaataccaatcctcctgaaactattcaaaaaaatcaaagagggaattcttcctaacactttctacaaggccagtataacccagataccaaagccagacaaagacacaacaaaacaagaaaattacagaccaatatccctgatgaacatagacacaaaaatcttcaacaaaatactagcaaatcaaatccaatagcacatcaaaaagataatataccatgatcaggtgagatttatctcagggatgtgagaatagttcaacatatgcaaatcaacaagtgtgatacatcacacaaacagaattaaaaacaaaaaccataagatcatctcaaaacatgcagaaaaagcattcaataaaattcagcatcccttcatgataaaaattctcaacaaatcagacatagaaggaacatacctcaacataataaaagtcatacacaacaaattcacagccaacatcatactcaatggagaaaagttgaaagcattccctctaagaactggaacaagacaaggataaccatatgcagaagaatgaaactggacccatatttctcactatagataaaaatgaactcaagactgattaaagacctaaatgtaagacctcaaattataaaaatctcagacaaaatcctagggaggactcttctggacattggcctaggcaaagaatttatgaccaagccctcaaaagcaaaggcaacaaaaacaaaaatagacaaatgagactgaagctaaaaccttcctctacaggaaaaaaaaatcaacaaagtaaacaaacaacccacagaatgggcaaaaagtttccaaattatgcatctgacaaaaggctaacatccagaatccataaggaactcaaataattcaataagaaaaacaagtaacctcattaaaaagtggggaaaggacatgtaagccggcaacaaatacatgaaaaaaatgtttgacatcactaatcatcagagaaattcaaattaaaaccacaatgagataccattttacaccagttataatagctattattaaaaagtcaaaaaacaacagatattggcaaggaggcggagaaaaggtaatacttatatgctgttgataggaattagtaaatctttatgaaaaacagtatggagatttctcaaagaactaaaaacagaactaccattcaatccagtaatcctactactaggtatatccccaaaaagaaataaatcattatataataaagatacctgcacccatatatttatcacagcactattcataatatcaaagatatggaatcaacataaatgtccatcagtataagactggagagaaagaaaatgttatatatatatccacataatggaatactattctgccataaaaaagaatgaaactatgtcttttgcagtaacatagatggaactggaggccattgtcttaactgaaataattcagaaacagaaaaggcaaataacatatgctctcacttataagttggagctaaagaatgggtacacatggacatacagagtagattaatagacatggaaggctacaaaaggtgggaggttgggagcgggtgagaattgaaaaattacctattagatacaatgttcactattagggtgatggatacactaaaagctggctcaccactacataatatatccatgtaagaaatctgcacttgtactccctaaatatattttttaattaaaaaatatatatatatttagatgtatgtagtttacaaaaaaatgcctaaaacaaaatgacccagaaataaaaaataaaataaacagatgagtcaggaattattgttttaaatatatatccttaagaaggatttacctaaaaccccagtagaggttatgtcccctctcagatgctcttatggcatcctgtattttctccttacaagaatttatcacaactattactatattctggtttccatgatttttttttcagtttgcctccacattctaagctctttaaggcagaaataaacctgctttgctcactgccttatttccagtgcccaacccaatgcttagaaataggaaattttcactgaatgactgtattccagaaaaggagtaaaataaaagagaaagcacagataacaacattaatttcaaactaagtcgattccaaggtcaaatcaatgaagtaaaagggtaatcttaaatctataaaagaaacacctcatgttcttgaacctgtttttgcaaataatatggaataaaaatgtataaaacaagaaatattaacaattcaaggagagggatagatgatagactaaaaatatgtttatattccttcctgacaaaatatcatgaaattaccaaaatgctaatatctgatacattcagatcagtagtggaaaatagaaaggattggccagtggtttcaatttatggttaggtaaagaagatctcaaaagattatcactgccttcataacaagaaaaaagagacaaagcaaaaatcatacttcattttaaagctgtcaaagagtgaatgtgagacaaagagaagtctaaacaaataaaattccagtcaagagaagccttttatagaccaataaaaagcagtgactgcttccatatctgggaccaattggttacatagtggagagatgagcctgccatcatagagcaactcctaaaaggagaaaaactagcaatttttcaaatgatagtatgggttggcaaacagactcttatctagaagagccacaaatgcaaaagtaaacctcttggcttgaaaattctctgccacaggaatttgctgtgaaattgatgatgagtgcagagccagaaaactgaaatcttacattcttgcacatgaatttggctggagttgatgccaaagagaactgaaatgaactctagctgcaattcaaacccctcccagctcaaatcctgattgtgaccagttactcaatgcagcctgggtagttgggattgggttgaagggcaaagggaaatcttcataatctctttttaaagcagaaataaactgaaactaataaaaagcttcagccaatccccagctaaagcattgcagatggtcaaatttttatgatcagcctctcattctagctgtctgacatttttaaaaaatcacatatcctctttatgagaaatagaacaaaacaaaagattttatttagttcaaacaaatctagtaaaaatattatttacttttgtccttctatacaacatgtttgatatgcaataaatacttatgaatacatgcaaagaagcagaaaaatgtgacctaaaatcaagagaagaaataatcaatacaggcagacttacagatgcccttgatgttagaattaaagaccaagaatacgaaataacaattataaagaattatgtgttaaaaatttatagaagaaattttagaatatatagaaaaatttatagaagaaaaggtggatataattaataacagttggtaagtttctgcagagaaataaaaccttaaaaaggaaccaagtcaaaatttatagaactgaaaaatgtcagagtgccagagaactgtgggccaatatcatttgattcaacatatacgtaactgggtccagaaagagagagagaataggaaaaaataagtatttgaaaagatattagccaagtattttctgaaatcaatgaaagttatcaactcttagatccaagaaactcggcgaacaccaagcataagaaacataaagtaaaacacatttatgtacatcatagtcaaatgactgaaaaacaaagatctaaaaggaaatgttaaaagcagtaaagaaaaaaacccattacatttaggggaacaacaaaaataatggcagagttttcactagtaacaacggaagccaaaagacagtggtatcttaaaagggctgaaagaaagaaaaaactgtcaatccaaatgataaggtagttagctttaagcagtaagttaccactgatttgatttcttctaaatactttttacattttctataacaattgcattgttcttataatttaaaaacatttttgtttttattattttattttattttatttttttgagacggggcttgctctgtcacccaggctggagtacagtggcatgatccagctcactgcagccttgacctcctgggctcaggcaatcctcccacctcaacctcccaagtagctaggactacaagcgcatgccaccatgcctggttaatttttgtattttgtattttatagagatggggtttcgccatgttgcccaggctggtcttgaactcctgggctcaagtgatcctcctgccttggcctcccaaagtgctgggattgtaggcgtgagccaccaggcctggcaaaaacatttttaaaagaacaactaagacaaatattgtatatgggttacacttagtatacaagaatcctcagaaaactatctgactaatctttatcctcataccaaatatctacacgattactactgttttcactagtctttgtaaaatatttatatatgaagattaactaaaaaacagtttttatgtgtcaatagcccttttataaagagattaaaagtaagaaacaatcacatctcttggggtaggtgagaaaacattaatgaaagacgtgaaatttgaggtttgttagaaaatactttaaggaaatggagaaaagtttcagaataaaaatttcaagatatatttgagaaacacaaataaatctaggttttttcatggagggatgaagcgagatattgatgtcaatagtggagaatcttgaaagatctaatttgtaggcaatggaaaaaaatatttacctaatctaacatgttttgagtaaagaagaatttacaaatgagaacaattctgtatctactggtgtgctacatttggatttctaattgacagcttggtattccttgtacctgtgaatcaacatgagtagatagttatcatttggacaatcactagatcattgtctgacagtaacttggtctgaaaaaattattttggtagataaaaggatgtttaagtggaactcttcctgagtttataacttagaacaacaggtactatattctaaaggtacatgctaagccataggacttggaaagaaaatgccccaaactaggtctacctcctccaagctgagctgctcactgttcatctctgaattgtgtaagaaaagggtaacagtttatgagagagccttatatggaagatttcttagctagggtttcttaaagcttccttctacagaactacttggagaacctaatatgtatttgcccaggatgtgacatgctagcagacactggtagctgatccatacctaaaaattctaaaggttagtggacagaaggaagagagtggagtgctacattgaggggacctgtgtttgtacaatttaatgagcaaagactcattaaattgagtgagttttcccctgacccaaaaagacccatgaaaaataatcagaccatggaagcaaccctagtatccactaatgtgtgaatggataaacaaaatgtggtatatacttacaatggaatattattcaagccttaaaaatgaaggaaattcttacacatgctacaaccttaatgaacctggaagacatgccaagggaaataagccagtcacaaaaggacaaatattgcatgattctatttatatgaggtagctagagtagtcaaattcatagacataaagtagaatggcagttgccacaggctgaagagaggggagtggggagttagtgtctcatgggtacagagtttcagtttgggaagatgaaaaagttctggagatggatagtggtgatggttgcacaacaacgtgaatgtacttagtactactgaactttacacttaaaaacagttaaagtcataaatttcatgtgtttattttaccactcttttaaagcaacaacaaaaacaaaaacaacaaaaaataaccttcaccaagaggactgcctagagaagtgagctgacccccacagagggagggtcaggatgggccagtggaagccaggaatgagaatggattataagctgttagtcaggagaggcaaacccacaagtaattgctaacaggagattcccagccaggcagttatctgaagaatttataaaagcagctcattacaaaaagaaaatgttggtgtctgacacagatggccctgaaatcaagttaggaaatcctaagactttgccctttcatcctacctccctcttgagccctgtacctgaattgggagataaggtgaagtgaggaagagtaaagaagctatgactgtgtctctctcctgactacaggcttctaaatgaagggaagggaagaagctcagagacaatttaacatctgtgtgtgcagacaatttaacatctgtgtgtgccaaaaaagtggtggaatggtactagacagtttatacaggagtggggatgattgattcaacagagtaagtttaaaggaagaagagtgagaaagaatgaagtggcattctacttgtagtctctgagtctagccctttcatccagtgagagaaaatctttcctcggagcttagaagattcctgatgaaagaatcactgcttccacttctctccttctcccttaccttcaggaagtcagattggcttcttcatcctcatctaaggatatatcccatggaagatggtatctaggaagaggtctaccatcctccccaaataaaagcgcaactctgtatctgtacccatggcttatgaaggaggaagggaatacgagctgatgttatgccagtctgtggtcagcaagactgccactaagagtgactgtcaattctcccaacatagcccaagcttttccattccagaatgttgtcatggcagacaaaatgattatttgtggtgggatgcattcatttattccatatacttttattgagtaccaattatatatagaatactgaaaagaataaaagctagataagacatgatcacacacttcaaggcacatatgtttcagcagaggtaaacatacagacttacaattaatgacaatgtagggcaaacaggaacaaaaaagctttgggattagaaatttttatagaggagattacatttacattgtgctttgaatgatgggaacattttgagtggatatggcataattgaaacagagaatgacaaaagtggaggggaggttagagcagagatcagatggcagagaaacaggtagctggtcttcagactatgacatcattgggtttgtaagtagcatataatactcttgagaagagaaatgagagccaggggtaggaaagtttggtatgagatttctgagggcctcaaaggccaggacatttgttctttaataggtaatgggggagtaatttaaggtctatgagtgggtgagtgatgaaatctaaaatatgttttaggaagaacaagtagaaggctattgcaattgtccagtgcagaggtaatggagcccttaagtaggatggttgctgtcacaattggaaaggcagaaatagatgggagaggctttggggaggtagaataaaagaggcttggatcctgatagcatatgcctttttcttactctctgtcaaaccctcatttcttccctcttctgatcctaaagctgtatgcagtgtcccttagcacacagacttatattttctggcaaatttctcttcagtattaggtaaggcttcatttgcagtaactgtgaaagacaccccaaaggacagttcctgatgttcaaaatgaggaagttatattctacatctacatttttattttatttttctctgtattgtggcttttagaaaaaggttcctccttttacctaagaatttctactctcagaaaatatgaacctacattagcatagctcttctgaagctcttggtcatatagaatggaaatcaggatcatgaaattaaagttattaaaatgatagtaaatgcctctctttgttccattattcagctttaagagcatttctgctctctaagagccttaaagtattaattttatatatttaggacaaaggattttaacaatagaattgtataattaaattacaagaaattaagaaaaacagtcatcaaaataattgagttgataattcaattgttaaacaaaatccagataatgtattagtcactccaatttttaaaggctagaacagtagaaaatgttttgtatgcttacatttctatttctcaccatgtgtggattatggctgaaataagctgaagttgccaatatgtgacaacagggaaaggactgccttgcatggtaagtcttttggggaagctttgtccttggagatgtctagcttttaaagacctgttctgtttctgacatggtaaattttgtatttctatgccctagacttttctgcagatacatgtatagtaacacaggctacagacaatgggcctgcattgagcaaacactggtgccctggagcagctgcacttgcgatgcttctgggatgttcagtggtgtgaccaaacagcatgtatcaaagaactaggaaacaggcaatctgttttcagctctgactttaagcaggtagtaattttcctgataaaacaggcgaaaaaattatagctccccagtcagcatagtcttacaagaaatcttgggctaagtagacaaaactcaatgaagattaaggactccaaatgcactggttggtaagaacaactaacttttattaagtaccagttgtaactaaacactctttctaaacactttccctgtaatttttttgtaactgttaaaacaggcttgaaaatttttttttaacttataatttttgtaggtacatagtaggtatatatatttatggggaaaacaggcttcttatacccatttaacatatgaataaaacaagattgagaggttaagtagcttgcccaaggtcaatagctactgaaccaggattcaagcctaactaaactgatcaggctaatactaaaatcgacactttaaatcttctccctatgctgccttttgcatggataaagttagcaacctccttctgcaggggacactgacacaaagcaagatctgcattaaaagtgtacttaaagcaatgaagtttctggtttagaaataggtagatcaatgggacaaagtaacatgtaaagaaatatacttgaatatatataagaatttatataatttaatgcggtatttcaacttgttcaagcaggcagataagctagatatgagcaggagggtgagtcccctgagaaaagggaggtttggaaaaatctcataacccagagaccacccaaaacatgcatcctagctatgagcagagaggaagggaaatacctatggagaaagagatgccccttgactcccagtaatcactcactccacaattaaactgtcctgtcagaatgtagctagctacatgctgttaagcgggtaaagagggaaaaaggagaaattcctaagagatacacaggtgcaataagcacagctttaaccactttccaaccttcctcaggtggtgataatgagtaatgcaggcattatatagaatttgtatccaacactggcctgcacatacatgtgaactaacagtaggggggaatcccacaaatttggagtggaaactaggtggggacttaaggcagaagtgggaactagacaaagacaaaggtggaaacttgaggcagaggcagaagcctgaagaaacagtctgccataataaccacaatgcagaactcttggggctgctgctggcttatcccttttaaacaccctgctctgcctcatctttcagcgtgcactgtctctgctactacctaacctttgaggctactactcctgtttctccagctggaccagcctgctcctttcttggagtgtccttctctcaataaactctgtactctttattttctttcaataaatcttttgcttacattactaattggtctcttggctgaattctttctcccaggtaagacaagaactgaggattcctgtacttcccagtaacaaaatcattaggaaaagtagccagtattaaatgaatatatagaaatcagtggctgtttgggagaaaaaaataaagttaaagccctattttttttaagtgtacttccagtgagctctgagtgttttagagactgtactctgccccatttgtgagaattattagtctttccagggaatatatatggagaatatttactttcagaggatgtaccatggagagaagtatttttatgaaaaatgccttgggaataggatttttaaaagacagaagagaacagtgtggtgctgtctcttgagtctcatgaacacacagcaagacatgtattcccattaactctctaggccatgaactacttgtgctccctttttaaggaaggaaaagattctagggtggtttttgtcactgggtgctgtggaatggattatttccctccactcttgttgctaaccggaaaaaaaaaaagacactgcaataaggttatgggactgaaagagctacatttagacacagctcttttggggtcaaggtcaagtaggacaataatggaaaagaataagcaaaaatgagacaacacaaggagaagaggaacctgggcacacctgagtggggaatcttcccttagccacagtggaaaaggggaaagcactagcccaggatctcagaaagaagggataggaatgatagaagggtaacatggcatttggctttctctctcagctctgttattactattttactttttaaaaaactttgttacataatatatattctcataaagtagctcaaatcttttatgggactaagcaagttataaatacatactttccatagaaatatttagaaaaatattacacttacacatattcatatataatatgtataaatacataaatttaaaaatatatattcagaagttgatgtatattataatatacgtatatctcattcctgaatttgggtttagtagctctcaaaaaatcactttttgtctttataaagtcctcagggtaagaaatccttccagatactcttgcacatggattcctaggccagggagcggggtggatgccacctgatcactagtgtcaagaatttcgtactcagtggggtgggagttggctgagagtggaagcggcaagagcaagatggcaacaccataattctgactgggaatgccactttccacactggcacaaaataaagcatgtggaacaaagaagtcaatgcctataagtcaacttcttgaaagtttcagattgtcacaaggctaagagttgggctagagatttgtcagagtcagtaataatttttgtgtctaaggacagagggatctgagttacataaacaagaggtgttcactatgaactgaaataagcaattcatgggtaaagagactggggccagaaattctagggtatatgagcattttctaggtaatggtaactgtggctcattggggtaggagtagtgccagtgagagtggtgccttttactgaatcttcccatctgggggtaaatggccattcatgctgcaacgcagttattctagctccttctcaagaggacgacgatgtgccagaggtagatgagaagtgagaatatgggcatatgtaagatgttctctctttgtgtgttaattatactgtgacataatgaagtaggatttagatgggactagtgtatggtgtgtccttctttttaatagctgcagttactgaaaaacaatgggtgaagcaacactgtggagatcagaatttgatgatggtgaaggaggcataactcaacatttgctgttctaaattcctgtcctttgctatttctccccaatccatggtgatttctcagtaataaatatactaccacaaataataatagtattattgctatgattttacgaatacttattaacatcttcacatgcttcatctcatttaattctcacaattgaggtaagtgacagatccaggatttgaaaatagttctgcacacagaccttaatgctatactaatgattcttatcagttggttgaatacttatagttcactcatttattgatgcatcttatagatactgtttttagtccttactataaaaagatattacatataaacgaagcagggctgtctcagaagagcaaaaagcatcccttgccaaggtaagggattctttccttcctccttctttccctcccaccctccattcaaaaattattcaataaatcccaactttgcactaagcaccctgctaggcattgcaaataaaaatccctgtgcttctagaatccatgatttagccagaaaattaaaagcacatagatagataactataattttacatcttttacatctcaaatcagagcagtgcaggtaacatcaatttgcctacttcttatatctggcttgacacacagaatattttgaagatttcatgtgtattatatcatactcttctatatacttttatcttggcactgacattttatcttgcctacttagtaagtatttcatagatataaagaaaatatttggtaaaatctacagagcaggccaggtgtggtggctcatgcctgtaatcccagcactttgggaggccaaggcgggcagatcacctgaggtcaggagttcaagaccagcctggccaacatagtgaaacctcatctctgctaaaaatacaaaaattagttgggcatggtggtgcatgcctgtaatcccagctactcgggaggctgaggcaggagaattgcttgaacccgggaggtagaggttgcagtgagccgagatggcaccactgtactccagcctgggcaaaaaaaacaaaaacaaaaacaaaacaaaaaaaacaactacagagcagaagctagaaaaaaacgagtcttgagtcaaaacaagcgtctgagattcaggggagattagaactgctcttttggaacttagtgtctgagaggacatatgtgcagacatgggaacaggtcaaggttcttgatgggacatgtgttgggggagggaggaagaaagggaatcggataatgacaggagtagctttccccatctaggtcatatatccttgtagtgaattcttctcctacgataagaaaagttgtgactttatagattatctatacatattcaaatctaagtttaaaataaatttgaaatcctgccaaattatctttggattgtcactatttaataaatgtaattttaaaaaatctatatctaaacataggacttatatgaatgggcttcaaggcatctgtgaacccctgaaatcatatgcaacattgtgtttctctggacttcatgagatttaaacccacaacctaaaatgattaaggcccaatgaataattaaaatttgagaaattaagccccataaccagggaaattttttccctcataaaattagagctgacagcatacaaacctgacataaacactgtacttacatcaagagccacagactgcttggcccaggacttcttcacttgatcatacataattgtgttgttgatgccaagtccacaaaagatgacaaaagcctaggaaagagcaaacctgctaattaaacattgcagcaactcattggcaaaatctaatatgaaagcaggcagccaccagggatgggtctgaaaatacaatcttgttgtacacagaggtaggccttggggaaataggcacattaaaattcttaattactattgttatataacaactttatagctcacactgcacatgaggaaaaattatgaatttaatgtcattgtagagaaactatttcatatgtttaaaaacatacttacactctgtttaagtgggttcttaatttatttaggttgtggactgattttagtaaatccattctatttaaccaaagcaacctcttttagttgctaggctataaaatactttggtaaagaaaccaagttaatgtaaccataaggtaaatgttaaggggaaggaggattgagttagaaccattaataaagaagctatgaggtattcttgattagagaaagataaccatgggttttcatgttggctactggtacagtctatgaggaagcccattcaaggctagcttctccagctagagcgcctggagtgaatgcacggaagcgtgtaaacaagagaaatgtgagggcagcacgcctggcagagctggctcagggtttcatgactctgaacacacacaaacaagacaagaataagaaaatagcactttggggaaaagagagggtaattctgtaataaaattaagataaaaataatggatggttacaaaataatccaattcataaaaaataggatcaaatctcacttaagcatttacatattccttaaatcttcctgttaattttgccctccatttaagtataataataattgactaataattgtttgtctttcaaatttgggcaagctgcaaccaggggactattgatgactccacttggtttataaatttattttcttacctcaaaaagtcgttgatctgcatcatcaaaaggtttcccatcaagtctgtttaacacttgagccactcctatggggaaagagtggattatgtggtcatttttagtactggacattgtgtttctctaatagagtagccacagctaactctatgccttttttaaggaactgcactcagtttaaactctggtctctcaagtgcctgccgatttcatgagaataaatctgaggtgtaggacaatgcactctctcttcaaggctgatttatttagactagatctcagtagttcggagttctaccaaggctttaatctgattctagatgactagttacagtaactctaatatattgcccatatattatatatacaactgagtatatatgtagctgaatatgtgtgtgtattcagctacatatatatatatatttcaactgaaaatatatatatatgtgtgtatatatatatatatatcatactctgaagcacaatacttgaaagaggcagtatggcactgtgattaagaacataagctttggacttagatgatctgagatcaaatttcaactccaccatcaggtgtgtgaccttgggcacgttacctaacttttttagcactcaatttcctcatctgtaaaatggggattaaaatgttaactacctaagaaggttatgaagattaaatgagataatgttagaatgttcataaagcatttagcatattgcttcactcagagtaaacattcaagaaatgttaggaattattacaagcaataaaagttgatataatacagttaaccttcaaagcaaagttagttctgtttcctgctaccagggggtacatatagttctacaaatcttaatttatgagtgattactttttccaaacttcacctctagtattataccagatgttttagggcatgacttcccaaatacacaagtttaacaagaaaaatcaactatcttgaaaaccactagcctgtgtccccatttagtacaaaagaaaaaaaaaaccagctgtaattctaaagtatgcttgtatttttaaaaacacccaacttcccaccagggaggtaagtcatcatatgcaagaagacatatatatataaataatgaaacacaaaactattagcatgtaaccaggcaaactacggttctaattttgaagtaataagggatgtttacttttaggattgaaatgtaggactacgagattgccacggaatatcaacaggtaacacatggtgtttcttatggactttccctttaaacataaatttatttaaaactctgtgcatgatgtagtttaagtctttgtactagaggcttagatcccaaaccttagaatattctttatgttcagtaacataccaatattcttatgcagactaagctgatgaaaaacattatctcagaattcatatcttaaaaacactcacagaatactaaatcctttaataagcagcagtgtcttagactttaacaggcaattttagggggaagcagagaaaggcaaatggatgcattagttaccaaatgaattagtgttcttacgtctcttaggaaaaaaagtcacatttttattgtgtttcaataatttcaactaattcctccatccttcatgacttctctatttcaaccatgaattctccttgcctgggcttctttcttgaatttgatgctttcctaattgagtttttttgaggagaaggaaaggagaatggaggaagagaaaaattggaagctgcttttgcccatgattcccttattgtgaggaaaatgtggcctatttcagaactgcccaggcagaaaatgcatgctcagtatatgtccaatatagaatgttatttcttcctttgcctttacaccatgtataaaaagcacagatgtaaacacattgacatagtaagaaagtctgcactaggagttaggaagcctgaattttgttcctgaccttgctattaactttgtggccttcttgaagtcatttctctttctctctttctctctttctctctctctctctctctctctctctgtctctgtctctctctggctttttttttcactctctgcctctatttccacagggtgagataaaagagttctattggttgataactcagattctctacgactttaaaatttattggttctttcaatttaatacatatttgttcaagttgtggataatgttgattcattaggagcctgtgcttatgaaattatacgagagtgtgagacatagtttgatgagtcctggccataaaaagagggaacacataaaaaagatatgggaatattttaaagcaaacttctgtttctttattcaagaagtttaactatttaggtcatctcttaccaattatttggtggttgctattccaaatagggacacaaagaacagatcttatgtgaaaaccagatatctggtctgcctaggaaacaagaaagaagttaattaaaattgaatattaactattcatttttgatttacattttttccatttttcataacagatattcaaaaataactttttaaagctattttatacactgtaacctaattttgtaatgcataaactcactcacctgcctccttcatcacaatgaacatcctaaaggaatcaaacccaagccaaatatgaatcaaccaaataaatccaaaaccaacatgacctccttcaatccctgcagccatagagagctggacataaaactatcttgatcatgaccacaccactagacaagaattccagcaactgtttctcctctgggtatttaaagcattttaattaaaccagtgatcaatttttatctttgactgggtgcacttgttagtaaaacatgtttgtgcctataatgctgtcatatttacatttacttttaatactctatatttttactgttactatattattatgtatgttgtcaaatctagatacaaaaaaggtaagatagaggtagaggtttgaatattttccttctgtaccccaaatatgtcaggaggtgacatttaaaatacagaggtataattatcaacatcaaacattgagtaacaaactccatttaatattaaaaacagtggtccatatttgaatggttagagagaaaccactaagagtgaaagggtcttagggagttaatatgaccttgattttcagtgaggtcaatctattgttctaatacaataggagaaaacaataagatatgaaggttttggatcatggatatggagataaaaagatattttaaaatattctttgttgaaggcaagagccacatattttaaacacttgaaactaaaagttaatttacatacctaaattttatactggattttttctttttgacatttctctttgagaagttaattttccagatatcttctattcattgtaccaatatgttagtttctctttttcaatgttttttgaagattaacatgcatgtagaaaggccccaaaattgtaagtatacagcttaatggatttttacaaaatgaacagatctatgcaactaccaccaagatcaagacatagaatattatcactgccccagaagccacctccaaacccctaaattcttgtacatacttagtgcatatatgcatttctgataggcatatacttataataaaattgctgagttattcacctgttcagcttcaaaatatatattttaaagtttttgcaaagtacttgtaccaatttaccttctaaccagaagtgtatgagagttccagttgatttatatcatcaccaacatttgatgttgtcaggcttttaaaaaaaaattttgacaattctgatagatatgtggttatatctccttgtgaaagtaatttgattatctctgatgactagggtgaccataaatcctggtttaagtctgttttcctgacataattattaataatatgcctttcattctcaaaagtgtctaaatttggacaataaatttataattttcctacttatgattaatgaagttgagcaacttttcatatacttatcatctatttctactctcttccatgaagtgcctgttcagaactttggtcttttgtcctgttgggttgtctgatttttaaaaattggctcgtaaaagtatcttctatattctggataagagccctctgcaagatatatgtattacaaatatttttcttattccatggcttgtttttccactcttttaatggtgtcttttgattcagaggtccctaatatgatataggcaaatatttcaatttttaaatttatggtcagtatttttttggttttgttcaagagatctttctgtattccaacctcatgaagatattcttctgtgcttttcctagaatccttactgttttaactttcacatttaaatttataatccaactgaaaatgattttcatgtataatatgagctaggagtcaaaatttcttttttttttgaaatggatattcagttgatccagcactgttttgagggaaaaagcaatacctctccccatcactctactgtgccatcattttcattaatcaactgtccatatatatttggatctgtttctggactctctattctattccattgatctaggtatctatccttatgccaataccacactgtcttaaataatacagttgtatgataaggctcagtatctggtagtgcaaatcctccaactttttccttcttcaagattgtcttgactatttttgacctctggcatttacatataaattttagaatcaatttgcagtttatacacatacatatacattcctgggatttttatcggtattttttgaatctatctgtttgggggagaattgacacctttacaaaactgagtctttcaatccataaatatcccttaatttatttaaggctcttaaaatttctcttagcaaagtttggtagttttccatgtagtgttcttacacataatttgttttatttgtatcctgatgtttaaaaacttcatgttattgtaaataacagtagtattttattttctaatgcttgtaattggtacataaaaatacaatcgactttttaatattaaatttgtttccatcaatcttgctacattcaattattaactttaatgtcttacctgtaaagtgttttggattttcttgccacatgatcacgtcatcttatcctttaattcttataccttttagtcatgtaattttagattatgtgatttttccttttttattttgttaatagagtgaattagattgattgatatttgagaattccagatgcaaaaacaaaaacgtaagcataaatcattcgtccagtgtactcttccaaaaaatatttatttaccaccttctatgcaccagacacattgcttagtattgaggatagaaaaatggattcaaatagtcattacccttgagctactcacagtctaggaaagatagaaatattgagataaaataagtgtccaagtagaggatgttcaaacactattggaaagacaacaattcactctgtttagagaaatcaggagcagcccaagaccctttacaatgagtcttcaaagacaacagtgatgatgataagctcacatttgctagatgttcactctctgtctggcattccgctcagcactttcttatgcattattttatactttttacaaccaccccatgaagtaggtactgttatcatcctctcttatcagatgagacttagggagattaactgccttgaatgagagagactggctcaaaggagcacagccaatggcaaacacatccatcaaagttatcttccaaaaaaacaaactggttttcttcccctccctaaggataaaatctgaattaaggcaataccagtaagcatgaagagaagaaagccaattttagaaaggtataatctacagacttaggctagccacagcagcactaggatggctgggtctgctttgttttgctgtgggagcgacacatatcattgtacagaccattgggtttgaggcagcaccaagtagtaaacacaattgtctctgccaactctgggacaacagtagctcctgtctaacgtttcctacgaaatctgggcagctgaaggacaggtcacaatgggcaagaagaaaaggaacatgcagtaagaaagacaatttagaagctggtggtgagaaaaacaaaccttaggctgttcgccagttaaataaaagagaattttgtttacccatcacttttaaagtactacagttccccaaaagagtttttttttttcttctgggaaagtgggagtatgcactctcccatccccatggaggataacattgaggtttctggcttgagtaaaggtggaagagttcttgaagtggggaacacaggaaatttgagggaaatgatacgaactccaaatggacacacattacaagtgagaggggctggagataccaatcttggagtcaccagtcctctgggttaattgcatgggtaagatttaagttaattgcatagttattgcaagagagaacttgtccaacaaaaagactaaaaactgaactttggggaacacaatatttagtgctggaagaaaaaggtgacatcagtgacagggatggacaagaactccaaagctcatgctcttaacctgaaggctttactgcatccataatgtgtgtgaacagatttctacaacctttccggaaataggtttattgatgtgtatccagagcctaaaaagtataaatacatactctttgacctatcaatttcatatctaggaatttatcctgtggtaattatcaaagctatgcacaaagctttacatgtaaaagtgtgaaccacagcattatttatcttagtgatttattagaataacatgaatattcaactgaaggcagttggttaagtaaatcatagcacattcacataacagaatattatgcatctaattaaaatcatgctatagaagaatagttactcatatggaaaatatttaatatattaaatgataatagtgtacatgcctatgggtatacaaaagcatattatatacattgaaggatcctagaaaaattatgaccataatagtttcctttgaatttcttggctattagaattttaaaattattgctcctagtttgtaaattttagataataaacacagataatttgtccataagggaagaagttattttctaagtagaacttagggggagcagcagtgtccaatgctatagagaagtctaataagataaggactgaaaatggcttactgaatttagcaacatagtgggatcattgaaggcaaaaatggtcaagggaagaaaggatgtgatcaggaataaaagtcaagtggttagtcctggaagagaggaaggccataatgagaaagcagagctgcaactattcagagctggagtcttgtatgagctgagcacaggagaagaggtgaagcatcagagaatgcagagggtgtctttaaagtgtttccactgtgtttgagggaaggaggtgaggctaaggaatggtgatgatcaacatgcttgatgagcccaatcaggtgggagaggagaacaaggaaggatggcagagtgtgaggagagtgaatttttccattttaaaatcattaatgaaatcccctaattgcctatttgcggcagcagctattttttctggaaaactgtgctaatccaggttagttcatgtaaccatatgaaaaggcaaggcccaggagtccattttatcctctgcaggggctggaggaaaaggagaagggagatgaaagaagcacaggatgtctaacgaataaattccaaacagggagaaagagtaataagcaagtatgaaggaaagaatcattcctgttcaccagataaccccaactctccatatcaaatcagtcaatggagctcaaaaatgcccatcagccacaccaccccaacgaagtcacccaaagtttcaatgcctcaattttatcattaatatttatctcctgcacaccaaaatggtaacattggttatcttcatattttggcctcacagctgattctcatctttgtgctttttcttgttttccaagttgttttatgaaaatttgtgtgtgaaagggtttcaaaatttgtaaggagttttacaaatacaaatattgctaatattgaaaggaacaactgccaaaaaaatctgctttattgttccacatggtgccttggtcattcttggtttaacatttacaccattagagtctcaaaagttagacaacatgagacaaagcagcctttctagaaggcaacagttaaactaaatatatttctgcgagtgcttagttctttccaagcaaagatatgtctacttaaaaatgttaactagtttctgtcctcatggggcctttccaattaatggatctaattaaagatggtttagctcttggagccatcaacatgtacttgttatattttctagcctctcaaaggtggtcaaaggaaatgttaaataaattggtgataatataatactatttattaatgttcagtgtatttcctttctctagaaagatacgtacaactttaacaataatctaaagcaacactttctccccaaagataatctagtggtgagaaattctagtaaccagacaagctgagggagccaatgttcccagtcagtcccttgatttccatgaaataatagagagagaactgagtttggcctatcttacctgcacataggataaatcctaatggtttgtagaatagtgcctgtatatgattccttaaattcctgaaaaataaatgattgtgcttggagctgaggcattttctccactgcccatgcagcaaagtctgttggattcttagaactgtgggacttgtatttgttttcactacccactgcttccccattctatattttatttaagtcttagtaatccccctaacttctaacctctaaccttcctttcccttctgctcaactgtaattcttacgttcactgtccaatctacccttcttctcaggaaaggttctcaaactggttcacactaagtaacagaaactgagagaagattgacaagagcaaatgaatttcagctgatccacagagctttgtctcttaatgtttccaattttgcacatttccctttgcaacagaagcataactgatagaccagaaggtgttacagagaatagagaatgacctgtcctgccaggctagctctcagcagccactgtgggggtgcgggagtgctccaccacaaagatctggcaggcaaaatgggctttaatgctctaaatcagagaatctcagagcctggagccccattatccttaagtgctacatgacgaggataagtaatattgagttgtctataataggctttaaaaaaatcagaggaaaaactttacatggaagaattgcatgggactgaagagctacagagttcagatcacaccaccttagtgttaattgtgtaactctgggcattggccttccatggcagagaagatctaggtactgatggatttcccacgtctcctgaatttgtaacaaataaatggaccaccaaatccatccatgcataaggcctgccctactttttagttaatttctgacattccctttgctgaatgaaccttttctatttaaatgttgagtccaagtgttcattcttattgtaggcaaaaagcaaatactgcatgtgatggctctgaaaattctctccataactacacaaatggaaggaaatactgaattaaacaatggaatataataccttagactgactaaataatggcttgttttgcattagtgtatttattttaatgcattctttgaatctaataagaagagaagggcagaaagtgtcacagatgatatactaaagtgcaactaactacagaaaattgaattccgaggcacaatgccagttgaaagcaaggacagaatgattgtaatggtgaggatatttgtaaatagagtatgcattctaagaagtcacctaatacaagaggcggtcatctgcaaatgcagtttatgtacatgctattggggcaatctcagacaatgctcctagttggaataaatcccaagaaacagaggcaaaggcgaatagaaaataatccatctgaattccccaaagatacagcaaggcaagttgacttgtttagatattatattatttcaataatggttttagataattgtttataactttaagaagactcaaaataacctggtaaaacataatttcatataagatatagtctaagattttagaatatctttaaaatttttcatgattataaaaataatatgaacacatgaaaaatttaaagcacaaataaaatcaaaagctctaacctttccatctttagagatagcaattattaacaagttggtacaagtccttcctcaccttttcttataaatatgtattaagttcatgtcaatatataatatatttaatgacataaagcatattcataaattacacatagataatatatttgacaatattgaacaatattcaacaagaatgtctattatttactaaacatggttctaggtgttggggatacagcagtgaaaaacaacaacaaaatcctcaccttcatagagcttacattttagtgatagaagagagatggtaaacaatacaaagataaatgaataaattatatgttagaagatgttaagatgatagggaaaaaacagataagaggggtaaggagtaccaagggtatcaggccttactgtcaggtaacatttggacaatggtcttaaagaggagaggatatgagccatgcagatattgggggaagagtatttcagctgagggagtagccagtgcaaagcccctgaggtgggcgtgtaagtggcacattataggaacaaggagactagtgtggcttgcatagtatgagtaagggatgggggtggatgatagggtgccagatggtgtatggcattgtagatctctgaaagaattgcaaatttggcttttactgcagtgaaataaggagacactgaagagtgtgtgagcagagttgtaacataacttaaaatttaatagcctctgactattgtgttgagaaaagagtatagaggggcaaagtggaaggagagggacagtttaagaggatttgtacatgaaatagtacagggatgatagtaggctggatctcggtggtagcagctgagtggtaagaagtggtcagattctggataaattaagcaattggacttcctgatgaattcatgttcaacatcagagaaagggagaatcatgcctatactttttttgacataagcatcctgaaggattgtgttgcctcaatagagatatggaaacagagagaggagcaggcttggggggcaggagactgtggcctgtgctttagacatgttaagtttaaaatacctattaaaaatatgcatatactgtttatgtatatacccacatatattattctatacatacttctatacattattttaaacatacttctctgtttacttttttcttgtagacattttaaaatatcaggatatatagattgcttcatggggtagacattgtgcatggactatattttagtctttattagggtatgataggcaaaattcttttttttttaagatggggtctcatgctatagccaggctggaatgcagtggcatgatctcggctcactgcaacctccgcctcctgagttcaagcaattctcctgcctcagcctcctgagtagttgggactacaggcgtgtgccaccactcctggctaatttttttttttttttgtatttttagtagagacagggtttcaccacgttagccaggaaggtctcgatctcctgaccttgtgatccgcctgcctcggcctcctaaagtgctgggattacaggcatgagccactgtgcccagcctataataagcaaaattctaagatggcctctaagaatcccacctgccaccacccccaactctggcttcctacatatcttgaataatcctttcccttgagtgtggacagggcctgtgaatatgttagcacggtcacttccctggtgatgttacgttacatggcaaagacgatgggataatcactcctgagattatataagccactccggacatgaggtaagcttctgtcacagccaactggagtgagattctcccattggctttgaagaagtaagctgccatgtgatgagagggccacattctaggactcaagggcaatctctgggagctaagacagaccctgggccatggccggcagaaaaatgagagcctcaatctacaactgcaaggaactcaattctcccaacaatctgaatgatctttaaaaagaacgccaagatccaaatgagaattccacacggccaatatcttaatttcagccttgtgagaccctgagcagagaacccagcaatgccatgcccagacttctgacccacagaaactgtgagataataatcagtgttgttttggctgggcgcggtagctcacgcctgtaatcctagcactttgggaggccaaggtgggtggatcacttgaggtcaggagttcaagaccagcctggccaacatggtgaaaccctgtctctgctaaaaatacgaaaaattagccagccatggtggtgtgcacctgtaatcccagttactcgggaggctgaggcaggagaattgcttgaacccaggaggcggaggttgcagtgagccgagaatgagccactgcactccagcctgggagacagagaaagactccatctcaaataataataataataataataataataataataataataataataatcaggtgttgttttaagtgctgagtttgtggtgatctgttttgctgcaatagaaaattaatatacataataaccctgacaatgtcttcagaaacacacatggataccctgttcccatggagcagatgactgataaagctacaaaacctaagaacagatgacccataaacatgagggtttcttgtactactataaataaatataatattatattgagtaggtcttttctgtcttacattcttttcatagaatcttgtaacagaataaacagtgattttcataaggtcgcagaatttaaagctcacaaatgtagttctagctctgtgacatataatcttttgtcataatttttccacccataagccaaagagtctggccttaaaaccatgtatgctatcaagcccagcaggtgccacttttgagagccaactcaaacaggcattcagaaggcaaataatcactatggctcacctgctaagtctgctctgttcaccacaaggagggaactccattaaatatttaagacaatcactaagagaacacccagcaggcaaacaactatgattacttgccccatagccctctcagcaggcatctgacagcacttgggatggggtttacatcacattaaagacatccctttgtagctcctatcaaaaggaagaccaacagtttcaaaactgagatttcaaaataaggatcattctcttgctgcatatcttgggcagagtttctaaggacttccctgaattttatcaagataggaaagacacagaaattagaaatctagtttcccttcataccttaactgtatgcctaaagcaaagcttgatagagtaaattatctcttactaacagaaaatacccactggtgtcatgaattcccaaattggcaagcttcctatgctagtctgaattgaacaagaagctatcaaatgcacacaagtgggtgtattgggatcagcaccagcagttatcaatctgaagaattcacaatatggtccatggggcaagtcattcataagttgctgctgaaatatttcattcacataatagggaacacctccctatcccaccaacactgatcaggaaaacccatttgggcttaatatgaacaaaaactaagcctctattatattaaaccacagaaattttgaagtttatctattactttaactgatgcagggattgtaaatgtagtcatcagggctatgtttgaaatatacaagtgcaactggctttagctatgtcttaaggattggtgcggctttagctatatgtttcaaggattggtgggttgcataggcttgggcagtacaggtattacagtaggtatctagtcaggaaggagcacggcaggagaggccccccctgacccctccacgaatgtcaggtgaccatcaggtgatggtcaggtggttgttaaactgtctctctaaaataataattggccacagccagtgccaacaaaaggcagtctcctgatagatagaaaaaccctgaaactagtgatcagtagtgtgatggttaatactgagtgttaacttgattggattccaggatgcaaagtattgatcctaggtgtgtctgtaagggtgttaccaaaggagattaacatttgagtccgtggtctgggaaaggcagacccacccttaatctgggtaggcaacatcaaatcagctgccagcacagatagaatataaagcaggcataaaaatgtgaacaagtcagattggcttagcctttcagcctacgtctttctcttgtgctggatgcttcctgccctcgaacatcggtctccaagttcctcagctttgggattcggactggcttccttgctcctcagcttccagcctattgtaggaccttgtgatcatatgagttaatactccttaatactcacatccatctatctatctatctatctatctatctatctatctatctatctatctcctattagttctgtccttctaggtgactaatagaagtcgcttcctgataagatcttgggagttgggcaagcagactcaagcatgtgcattaagagacaaaatggaagagtttaactggtatatgaccttcgagaaacattccgctggtatgggaagaatgcctccagtaagcatgcagacaactccagtaaacacactatgtgtgctccccttccaagcgctagcaggccactatgcatgcagacagcacactccaagggaagagccagggagaaggaatgaaagatcctggaagtatgtcaatgcataaaattccaagtcaaagatcaaacagcgcacttgatttctcaagtcacctgcttggccctcctccaagtgtactttacttcctttcattcctgctctaaagctttttttaaaaaaactttcaatcctgctctaaaacttgccacagtctcttcttctgcctaacgcccctcagtcaaattctttcttctgaggaggcaagaattgaggttgctgcagacccacatggatttgccaccactaacacagccagcccccacatttaatcatctccaatgtgcctaggaaacctggtgcctggatgtctggccactcttatcatactgctgggtcctataagggaggacctggtgactatatctgcacagtttataagatatttatgtaggactttacatgttgcaaactaagtgatatgtccaagactcctcagctcttgagcacagcagataggacaaaaaagtaggtatgctggccatgagttcatgtacctgtgaggaaggagaaaggaagaatgtggtgactctgttgcctaggcagaccctcagcagctgatgctctccccaagaggatgctaaaggaaagagcactgaatcaggaaccagaaggcccagagtgttttctgtgatctgccttaagaaagctgtgtggtcttggcagaccaccagctccccaagtctccatttcctcccctgtaagctaaaaaatatccaatatttctatttactgaaagttgatgtatccatagtatgaaatcccagaatagggccaatccattttggggcattctatcccagtttctgatgaattggggtcagtaaaaagaattcattgccagaattagccactgagctattgagaaatttagaatagatattagtgatagaggcaggaggcagacaaaggcgtagacagatagagaaggatctctggagaatttccaacctgccccacaagtgttacaccagatgttttgtgcagataagggaacctgcacagggggcttacctgggcatgcccacggcagactagaggcccacatgcactgggggaatggtgtggagccaccagaaattcgggcctaatgcagaggaggagcctggcctcttcagctggtgtgtagtggccctggtattcaatttgggaggtggaaacctgcttgcaggaccccctctctttgctgagaggtttcttttcacttaatacattccaccctcctcacccttcaatgtgtctgcctgcctaattcttcctggtcatgagacaagaacccagattagctgacctaaggagcaaaaaaatcctgcatcattttggtggcctctacggggacttgtcagaagggtgagtaaaatgcagacccaaacatctctctcacttttgtttctgagctttcttgtcctcagactttttctgaaggcagaggaaactgcccccttccccaccccatcattctcaggcattggaaatgtcggcctcagtcaaacccagtcttttccatggattttccttcatttttgggggaatgtattggcacctatcttttcttttacaatattaggggtgtttcaccctcaccccaatggttgcaggcatgtgcacaggacagacaggtgagcagtggctccctgccccactcccctcctgtctggggcacacagcctgggcctggggtggctagctggccagtgttccccaccaggcacccacgcagtcttcccttcccctggccaaggggtccagctcagtgggagtcccaggaaggagacagcaatgaaaggtttctctccctgatgaagaaacccattgcataagaataagaggtttctcccccaggaatcttcccaggcttgcacctaagcttttttttcttccttttctccaccctgtaggcagttaatgcagccttgcagatatagggagcttttctatgcaagagttttttttttcattttggaaggcatcttgttaggccaggacccaaattcacaagacaccctttttctctcccttgttggaggagaacccagctcctcagctttaccttagcattcagcttatgataaggaggcagcagccagctgctggctgcagtctgtcaaggtctaaggaacgcaaaggttatgacaacagtggagacagggtgtatgtgggtgagtacgatattcccaccctctaggcccctgtgttaacgtgagtggaagctgcactgacacctatcgatagcaccctgtcaaggttgccaggacttgaagatacaaggacagaagaaagaaaagaaacacctcttctttctctgcctcatgtaccccatatttgctgggaagacaaaggaattagggacaccttatcctgtcttcctagctgggtaaccattcatctttagtctgtacctctctcaaatgcatcctgaggcaggggggctccttagagaaaatgccttctttttcctttttcctcctctgtcctctcttcacagaggggtaattgtgtccccctactacaggatactcccctcggatgcatcctccaaactgggaaaagttaatttcccagaccttaaactgcttggtctagaactgagctgagggtgagaggtgacagcgtgctggcagccctcgcttgctcttggcacctccttggccttggcgcccactctggccacactataggagctcttcagcctgctgctgcactgtgggagcccctctctgggctggccaaggctgaagccagctccctctgcttgtggggaggtgtggagggagaggtgcaagcgggaactggggctgcgcatggcactggcagcccaccacaagttctgggtgggcgtgggctccgcgggccctgcattcggagcggccagctggtgccgccggccctgggcagtgagggacttagcacccgggccagcagctgcagagggtgtgctgggtcccccagcagtgccggcccactggcgctgcgctcaaattctcgctgggcctcagctgcctccctgctgggcagagctcgggacctgcagcctgccatgcctgagcctccccactgccgtgggctcctgtgctgcccgagcctccccgacgagcgctgccccctgctctgcagcacccggtcctatcgaccacccaacagctgatgagtgtgggcacacagtgcaggactgatgggcagctctacctgtggccccagtgcgggatccactaggtgaagccagctgggctcctgagtctggtggggacttggagaacctttatgtctagctaaaggattgtaaatacaccaatcagcactctgtgtctagctcaaggtttgtaaatgcaccaatcagtgctctgggtctagctaatctagtggggacttggagaacctttatgtctagctaaaggattgtaaatacaccaatcagcactctgtatctagctcaaggtttgtaaacacaccaatcagcaccctgtgtctagctcaaggtttgtaaatgcaccaatcattgctgtgtctagctaatctgatgcggacttggagaacttttgtgtctatcttggggattgtaaatgcaccaatcagctccctgtaaaacagaccaatcagctctctgtaaaatggaccaatcagcaggatgtgggtggggccagataagggaataaaagcaggctgccggagccaacagtggcaacccgcttgggttccctaccccagtgtggaagctttgttcttttgctctttgcaataaatcttgctgctgctcactctttgggtctgcactgcctttatgagctgtaacactcacagcgaaggtctgcatcttcactcctgaggccagtgagaccacgaactcacctggaggaatgaacaactccggacgggaggaacaaacaactccagacgcgccacctgaagagctgtaacactcaccacgaaggtctgcagcttcactcctgaagccagcgagaccatgaacccaccagaaggaagaaactccaaacacatccgaacatcagaaggaacaaactccggacacaccatctttaagaactgtaacactcaccacaagggtccacagcttcattcttgaagtcaatgagaccaagaacccaccaattccagatacaaggggaagggaatccagaaacctgacgtgccagcaaaagggtaaaagtttcttttaccagttggacttttggcctctccctccgtgtgcaaaccggtaaaaggaatggtaaggatcactgtttatattctctgtaaagttttgattaatgaaaaaggatttatgagtttggtcttaagctgtagccaatctggtatgctttgcatgtctttctgtatggttctatcagaaagagaggtactttaggacaggatgtgggtgtaggaccccataagtccacttttcaagtcagcccagcaaactggtcagtaacaaactttgctgcaggcttgcatcttgtttacatcctggggagcatgacctgtaactacgtgggagtgctttgttttagtctgacattttacaatggtggctcaggttcaatcctggcttggagaatgggtactttctttctttctttttttttttttttgagatggagtctcgctctgtcgcccaggctggagtgcagtggcgcgatctcagctcactgcaagctctgcttcccgggtttacggagaatgagtactttcaagttaatagctgtgtgacttctaccatttgctgattttcttcccttccatgaacaacttctagattctcttcttaaatcttcccttctctgagctacccttaaagattctagatgttgtaaaaactgcttacctcctgctttgaaaatacttcgtacactggtagtaaagtcataaccttaattgaggcttgttggtttcacctgtgaggttacttttggtaaagttcaaaagccagaaatattggctgcttgacatggctaaagtcaggtaatacgggatttaaaaggactttcttaaggagtgctcagcttaattaaaagcagatacccaagtatgtttaaaggacctttatggtttttttcccttcttgaatcttgtttttctggaaaaaggtttcttctcagttgattgaattatttttctccattttgtcttgccactcttaaggcacacatgagaggccctaaaataatttctgatggcctgtgactccttggcaaaaacagaaaaggcaccacagatcccattttgtgagaaacctgttttcctcatggaacctcagaaattagaggcaggtagatccctctcaaaatctgtttttgtcttccagccatacctgtttgttaggccctagaaaatacaagctttcctagccttgctcttaaagggctccacccagaggccaataatccaattagattggcaaatgaaaaatcttacaactactagattttcttctgtctgtctacataatcatatatgtgttatgtgtgttatgtttataaagaaaagagctctaattaattggtttgaaggaaaataagcacttaaatgaaatatttttttaaaagaaagacaaaagctgtaatactttttagtatttagtctatcgttccttctccaaagaggtaattctaactgccattagaataggggcaaagacggatcttaactgcttcctgctgacagggggcactattttgggaagatggcagtcagatctcccccagaggcctagctaagtgtccccagtaaaagggagccatcgtctgtggttctggttgcatgaccgtttggagttcgatggcctacaggggagaagagactaacttctctgatataaaatcagtcctaactcaaccacaatggaaaagtatataaatgttgacatctgtaaatcattttcagtgctccagtcatataaccaagttagtagtgttctaccttaccagaggagaactgaagaactttgaactgtgaactttcccaaggaaaggtaagtcaaatttcaaatttagtgtataaaaactgaggagaactagagggtagtcagtgttaggatagccaagggagcagctggaaaggcacccaacgcagactaggacttcatttaaggatttaggagcctctaacctcaagaaggaatagaaaatacatggaaaatgtagcctggggaagagagttctaggcagctacagggaggtggtaagtttgggaatataaggttttcctgcagagatctgcaaagatgatctgactgaagttgtaaattagactttgaccccagcctccctgccatcaccatgtcctggccacagacaatggagacagcacagggcaggattaagattatgggctgtggagtttgagaggtagtaggactgaatttttgtctgcctccagagccatagagcagctctcaatttctgtaaaatgggaatgatgacatctacttctcagggttgaagtttaactgttcagttgttatcattactaacctatcccctgctttgtagccagtgtgatcattctaaaatataactcttgcttctcccccatttaaaactcaatggttccccattgcacagaacaaatactccaatttcttaacatgcctttcaaagttttttggtgatctggtccctgcttccctctccagtttcatggatcatggcccttcagccacattagatcatctcacttccccaactccccatgcctgctcagctttgcctggaacacacatctccttacccttcctcaccaaaaaaatgcctcctactcttcagacttcagctggacaatcttcaataggaaaccttgtatttaatgaatgtgtatattcaatatgtatatatgagtatatatatagagagtacacatatgtacatagagacattatcagttcatgtgaatttatctgtatgatactctacactaccttagaatgtaaacttcaaaattgttttaatatattctgtatatcaacacagtgtgcctagataattaacattaaacaataatgccaaccaatttactgtttcttgggagcaatttttataaatatggtagttgttttagggtctattgggaaataactttgttatatacacttttcattaaatagttcatagtttaatataaaatatacccaatcataaacgagcatcagactaaggataaccatcttgctacaaatcatggtagagtcagacaagtttttctaacttagagtcaacagtaggcaatgctaaaaataagatcacaggggaaggatgcaaaagaattgctggtaagtattcctttttgtgtttcaactgttttcaacagtgcgacaactgaaacttaggattgcaaccagaggggctcctcttacctctgcatcaaagcgcggatcctggtaggcatcactgatgttcactggaaggcctgttgaagcaaccagctcagcaatgctgttatttattagccagtcggagtatgatgatttctccatgctttctttgaaactatcagagcaccaaggtaggcaggaagaaaagagagaaacgtaagttttcttgaaaggaaaccctataaactacactaatatcaggataatctgtccttattaagaaaaaataagtgacattagtcacagaacaatagcaaggtaattatcagtagctacttcgaaatgacttacctgctataatgtataataattaaatccatgggcagaaaccatagattccctatgattcagagagactctaggctgtatttaggtcccaaagctggcaaacacatgtaaggaccaaaattaacaataagacaccaacaactaataaaattccatcaacttcccagcttgccctttttaattgaacagactagatgttttggcacaaggaagaatgaaacccaagtagggaaaaatcaggaagtaaattgggaatttaaaaaattacaaatgcagcaaaagaatgtatctagactatggtcttttaattagtaattatttgaaaaacaattttactatcttagtcattattttgataacattaatattttaataacttttagtatcttagttaactattttggtaattttagattatgtttcttaacaatagcccatataccacttacaaaatctcacttaaaaggctatttaatgcaacagacccttaacattaataattaaaactattttcatatttaatttgaacaaggaattttatgccaaatgattttttgaactttcccttgtatcattttcatgacagacactacataaacagaaatgctgtaagaattagttaatatccctcattcttctcctttccatcttttcttccacaagtatatattgagcactgccaggagccgtggagatacaaaattgagaactgttcaaattagtattggcaaggaaaattttcctggaggatgtctgatttgtcgcttggcaagtgataactgaaattatgtggatggatgcaagcatactagggcaaggttttcaagctgccttatgtggaaccctggatttcatgagatgttaaatgagtatactacagcaagaataatcatcactctattgactttttaatctaaactgcactatatgtaagaaaacactaaatgtgcacatcgtctttgttattatgcaataatgtccctgtgtaaaattatgccatgttgagaaggcaggaaactgcatggaaaggccattggatgcatgagtgagtgggacacatagacattatttaacatcattaatatatctcatctgtaatgattgctggcctgtgtctgataaattcagcatgtatttgtaatgttattcatcccttattgcatattaaacattaataatacataaactttattctctatggctctctggctgaaaaatggaagttttaataaaaagctgagtcttgtagttcttagatggcacctaaatcaaagaagtaaaaagactgagtacttcaaagagaagaagaagctttattttctaaaacaaatcaaaacaaaagaacaaaaaagtttttattttctttttgctgttttatatgcatctcatttcatgagatgaaattttatgttgtgctgcaatgaaagcaaaatctaggagaaacaagataatgcacctcacacaaagatctaaatgacttagtgaagtcatttctaagtttataaaagggtatgggctaaattctgacctttcagggattaattggcttgccagttcattctgcactgtgtactttattccacattttaatttttgaggtgttctgtgatcacaccgtttcgaagctgctgacctagagtgttctgtggagtgtgggaagcagcgctgcagcaggagctggggagaggtctgggcacagaagtaaaacggttgggtagggtggggctcaaggaaggagccagttttaccaataagtgtcaacaatcttcaagctgggtctttcaggatgagaaagagttcaacaaggagagattggaggagttagaaggaaacagcaggaacaaaagacacaaatgcagcagagtacgaagtgtgttcttggcacaatgagtaattgtatggtgggaataaaactgaaaaagaggccaaggctcaaaggtgaggccttgaccaagttgctgagaccttagttataggcaatggagaactgtttaagaatatggagcagggaagtgacgtggtttaagatgtgattttagaaagcttaatccaggtacaatgagcaagaagaactgggtaagagacactgaggatgggaagaggtcttgtaaaccacagaagtcatgcaggtgggaggtgatggtgctggtgactcaagaggtactgcagaagattccacaggctctgtggccagatagcagtggcttacattttgttcccgactgcctgtggccctattagcagaacacagttgttttaaggagtggggagataggggaaagatgacagatattctgtaagcctgggacatgttcatttttgaaagtccaggaacaaaatcctatcagtcctcaggactgaaaactctaatccagagttaggataattttcacggagaataaaatgcatgagatcactcagggacagaacacgtagggaaatctatatctagggaagggaaggaggagaaaagtggtaataaagggggaagggagaaagagaagaaattttaaggaagaaaaactgaaatttattgccatctactgtgggccaagggtcaggccagatactttacccaactaatttgttttgtcctcagataaatcctgtgagatggatatgcttctctatattttatagatcagaaaatggagacctaggatgctcaataactttcccaagtggagatagaattttcacctaaatctgaccccaacatcctaaattatagtatttttcctgttgcctttcagaaggagttaatggatagcgttatagcaagaatagtgggttgtcacctaagaacaaatagggaggggcagtccacatcagagagagtttaaggaagctgctaaagataataaacacttcactgtgagactttagtcacaggaacagggaggaaaaaccattggagttgataattaagagctttaggtccctacttacagaattcccaaagaagatacgatgacaaaaacacttactgagcaggggctcctgaaaaactcactctaaatctaaaacatgcttagaatgtggcttggttcagtatgcatactgaattgaaatcattgtaaaatcagtgaacagtgtagaaggaatattgactctgtgcaaggcagggttgaggccgtttctaaagtataagctatgatctctgctctcagggagtttgctacttaactggggagatgagaaataaacacactgacatataaacaatataaaaattaaatgcccacttcaaatttcaaatgaaaaatttttcacatagatgtgttgataagttaccaagtcaactgtaccaatcacgagtgctgaagacgtccatggagggagaaatgacttcaggtgttgtaatctagctaaggcttcagagaggaggtgagattcaaactgacctatataggtcagtgcaacagtgcaaacagattttctgaaaatcacctctgcatttcttcagtttaatgttgcacaggaacataaattaaggcctgagtgatcagatcctcagagagacagataggaaagttgatttgtcacttggtatttacatcactgtcttagtccattcaggctgctagagcaaaataccataagttgggtgacttataaacaacaaatatttatttatcacagttttgagactaggaagaccaagatcaaggcactggcagattcagtatctagtgccttcttgctttagttcagtgtctagtgccttcttgtcctcacatggtagaaagaatgagggatctctctggggcctcttttataaaggcactgattccattcataagagctccacccccatgacctaatcacctcctaaaggcccaccccttcataccctcacattagggactgggtttcaacgtatgaatttttgggcagacacaaacattcagaccagagtaatcacattctggcttacgcaccagctcaattttggaattccttttttttttttaattaattaattaatttatttattttttattgataattcttgggtgtttctcacagagggggatttggctgggtcataggacaatagtggagggaaggtcagcagataaacaagtgaacaaaggtctctggttttcctaggcagaggaccctgcggccttccgcagtatttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggcaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcagccgggcagaggcgctcctcacctcccggacggggcggctggccgggcggggggctgaccccccccacctccctcccggacggggtggctgccgggcggagacgctcctcacttcccagatggggtggctgccgggcggaggggctcctcacttctcagacggggcggttgccaggcagagggtctcctcacttctcagacggggcggccgggcagagtcgctcctcacctcccagatggggtctcggccgggcagaggcgctcctcacatcccagacggggcagcggggcagaggcgctccccacatctcagacgatgggcggccgggcagagacgctcctcacttcctagatgtgatggcggccgggaagaggtgctcctcacttcctagatgggatggcggccgggcggagacgctcctcactttccagactgggcagccaggcagaggggctcctcacatctcagacgatgggtggctgggcagagacgctcctcacttcccagacggggtggcggccgggcagaggctgcaatctcggcactttgggaggccaaggcaggcagctgggaggtggaggttgtagcaagccgagatcaagccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgcgtgcctgcaatcgcaggcactcggcaggctgaggcaggagaatcagacagggaggttgcagtgagctgagatggcagcagtacagtccagcttcggctcggcatgagagggagaccgtggaaagagagggagggggagaccgtggggagagggagagggagagggagagggagagggagaggctggaattcctaatggtctactataatgcagaatcgtaacactgagttagagctttcaaaagcttgcttctcttctttacaaacaaaaggtaattttatgttatgattaggatcatgagttttggcatacctcaatcaaatgtcccctttgctgatttctagcaaagtgatcttaggaaaacttccttggtaaaatgggtataatactactactgtagagattaaggtgataattcatgcaaagtgctcagcatattatttagcccatagcaaacattttctaaaagcatcacaacttttaaagcaaattctgcacatgacagtacccctttatacatttcagtgatgtggtgttgtgagtttaatcacaaaggaaagggcccaaattatttctgcttttggaaggacacatctaacttttagggtaagctctttcaaaaagttcctacagctcatcacctccccctgatttatgagggaacttttattcagtatggttttctcttttgcaattggttgctgttgggacagaacatggtaagatcacagacacagccacgtttagttgtgcaggttctgccttgcacacggatgccctataaaagggagaagtgggggtggaaattagtctaactgtgcttgtttgcttgaagttgcatccacctggagagggcaccttttcctaattctcacagagacatttgtatgggctttcaatggccctccttcaagcttttcttcaacacatctgaaaattgggcatgtaatctcaaatggagcaccatcagtgacaggaaactcactacctatcatatattacattatattttgtggcagctcagtttactttctaatagtcatcatccttggttccaagttccatggtttgtggccacagagcatggacctcattatctgacagccctcaaaatatttagcaatagttaacatgtcacccatgatcatccacctaacatcattcttctcccacctgtctccaattccttaagttactcctcttgtggcatgccttccttattcgtaccatgccagccctagatgtaaccccccttgttaatagtcctttggagtatgaaagccagtccagtccacagttctctccatggggtctgagtaggatgaagtgggtatgaccacctccttcattctagaacctatttctagcaacaaacatcaggagtgatagttcccaataggtcttatttttgataagtttttggaagtttaaattaatattaaccaactttcttgagtctaaattaaccaactttcttgagtctaaaaactcccaccagagatatcaaaggccaacaaatccaatactaagattttcagtttgggccagaaccaagatagagactcactgctgtttggaaacacaactacaccttgattacaaccaggcctccaaagcttatgggtgcaaatcagttcatgtcaactcagtggttcttagctgccatgtatataattgtaagacgacagacacctccaagtccttccctgacctccaacctttggggatacttattctttcattcaaggcccgttgttaaagcctactgcttagaaatcacttgagggagcctgacccgtagctcccagactgccaaagcttcatagaagaagggaagaatactgtctgccaagctctatgcagcatgttggtgcctgagccctaatgccatattgcttgtgcccacgttgtcactagtttcctatttaaacagctccttttgcctttgcccatacccctctctgtagacatagagggcagggctgggatgcccattcacattagacgagtactcatgtaccaactcattctttcagcaaaaagacaaagacccttatcaatctcctcatgcaagtgaatgtctagtgtgaatggtgtgtttgtgtgtgtgtgtgtgtgtgtagccaacacattaactgtacactggtgcataacaagaaaaaatggcatagaattcttagcaacatttatttgttgttgaagactaatggttgattgagaaaccattcaaatgtttctaaagtttttttttaaagcaagtcatttgtccatgtttaatttcacttgtccatatttaatagcttcatacatttaagtcacaacactattttgatccctacagtggggatattttaaaaaattctggcttaaaggaaaaaaacagcagacagtaaaaatatattgatataaatgtttgagaaaagtaaaagaaacatagttgacacctgaacttcagtgaaacttccttaaaaggtcatagttaaccacttaatagcttattttaactctctacaaagtagacctccctaagctcgattcacttcagcataacactctaattgtaaagaaatcctttatcttgttattttgctagaaaaaggggtataagaaaatgtaggtttttaagtgagtttcacgtaaagggctgtagtttagattcttctcagtggtatcttgcttccaaatgtgagactcaaactgacttcaaagagagcttcatgagctcaaatatattgactgtggagggataaaagagaattgccctattacagaaaacacgtaattcctgaaatgtggctgcccctgaagtgagggccggtgaggtatatataaacctcagggctgacaagttgcagagtcgtgtaggaggtaaatcaatacgagcaaagaaaaacaagacaaaataaaataccccagaacaagtgactcaacatctttaattgtctgaaagtcctggcttagctgaaggttcaaatacagagaactgtgtgaaaataaaaagactatcttcagcattacttttccaaaaaaaagagtctccacattagaagacaaaacatcttaataaaataatgctaatcattagactgtgcttgtgttcatgtttctcttctcaacataacagtttacttagatgtcttcattagaaactctcaagagtctttcaagaatgacaactagtttggcctctactaagtgctggacaggagtgagccaaatcttgcattaagcgaacaataaggatcttttccttgttgttgaaagaagctggcacatggaaacccatccttacacggatgtcagcccagcctagcccctacttatacagaaaggggtatgggcagaagccaaaggggtatactctcagggagctcacaatagtgatactgaattgtgataaatggcctaatggaaggatgtggaaggatgttggtctaagctggtctttagaggataagtaagagttcacctggaagagaaagaagataaaaacaattcagtcaaaactatagcatgagtaaagctttaaaaagtgtggggttttctccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaataccttttatttatttatttattattattattatttttagtagagatgaggtttcaccatgtagtcccagctactcaggaggctgaggcaggagaatggcgtgaacccgggaggtggagcttgcagtgagctgagatcgtgccactgcactccagcctgggcgacagagcgagactccatctcaaaaaaaaaacaaaaaaacctaggaatccaacttacaaggaatgtgaaggacctcttcaaggagaactaaaaccactgctcaatgaaataaaagaggatacaaagaaatggaagaacattccatgctcaaggataggaagaatcaatattgtgaaaatggccatactgcccaaggtaatttatagattcaatgccatccccatcaagctaccattgactttcttcacagaattggaaaaaactactttaaagttcatatggaaccaaaaaagagcccacattgccaagtcaatcctaagccaaaagaacaaagctggaggcatcatgctacctgacttcaaactttactacaagggtacagtaaccaaaacagcatggtactggtaccaaaacagagatatagaccagtggaacagaacagagccctcagaaatactaccacacatctacaactatctgatctttgacaaacctgagaaaaacaagaaatggggaaaggattccctatttaataaatggtgctgggaaaactggctagacatatgtagaaagctgaaactggatcccttccttacaccttatacaaaaattaattcaagatggattaaagacttaaatgttagacctaaaaccataaaaaccctagaagaaaacccaggcaataccattcaggacagaggcatgggcaaggacttcatgtctaaaacaccaaaagcaatggcgacagaagccaaaattgacaaatgggatctaattaaactaaagagcttctgcacagcaaaagaaacgaccatcagagtgaacaggcaacctacagaatgggagaaaatttttacaatctactcatctgacaaagggctaatatccagaatctacaaagaactcaaacaaatttacaagaaaaaaacaaacaaccccatcaaaaagtgggcgaaggatatgaacagacacttctcaaaggaagaaatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggagggactgtaaactagttcaaccattgtggaagacagtgtggcgactcctcaaggatctagaactagaaataccatttgacccagccatcccattactgggtatatacccaaaggattataaatcatggtgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaaggatgagttcatgtcctttgtagggacatggatgaagctggaaaccatcattctcagcaaactatctcaagaacaaaaaaccaaacaccgcatgttctcgctcataggtgggaattgaacaatgagaacacttggacacaggaaggggaacatcacacaccaggcctgtcgtggggtggggggatcggggagggatagcattaggagatatacctaatgctaaattacgagttaatgggtgcagcacaccaacatggcacatgtatacatatgtaacaaacctgcacgttgtgcacatgtaccctagaacttaaagtataataataataaaaataaaagaagtgtgggattttctgtattggtatagtaaataatagagctgacgcttaggatacacggtggaagtggtgaataaggctactgcggaagaggccaaccaatatattgtgtggtttcatgcacaagctttgtatcccaaactacatccatacagatgactctttctgtttttcgtttttaaaatgtctttttttttaacttttaagttcaggggtacatgttcagggcatgcaggtttgttacataggtaaacatgcgtcatgggggtttgttgtatggattatttcatcacccaggtattaagcccagtaaccattagttatttttcccattcctctccctcttcccaccctccaccctccagtaggccccagtgtgcactgttcccctctaggtgtccatgtgttctcatcatttagctcccacttataagggagagcatgccatatttggtttcccatacagatgactcttctctgtatcagcagcccctagagtccagagttccctatgtatatacctaagtactttctggggacttcctcctgagcacctcaaagttgccattttcaagatcgaactaacacactacccttgatgcactagtggtcattaatgaagagtgtgaccattaactaaaaatagaggattagggtgggactgaaagtttcaacataagcacaatctattttctcattaccaaggaatgattgtcagttgcccttctgacagcttgagtgttacccagtgaggggtaggagccagagaggcaaagagtcaggaactcaaataactatttgggacagatttctttttaatgctttgcaaaccaaatattgatttttgatctatatgatagtatttgacattttgtttcattgactagaggtcaatctgaggttgggttcacaaaaagaaactgcattccttacttttttccccctcagctcagcctgtctatccctggagcccttcctgaagcctccagctgtgcaatgctttttgaagttgtcttttaattaggagattagggaactaagtaaataccagtgggactcaaagctaggacctcagcaggaaagtctcgaacacccaggacttgggacattaaaaatcttttaatggcttaagtatatctttgaaggttattgaacaagtcttttagtcatataaagtaatgggagagagtgtaattaacaagcagagccagcctgtcagctcttaccctgtggtaggaaaagaagattctctaagttgcaggagttcctaaatttatcatgatctgttagtggagtcgcctttaatgtcttgcctgaggacacttcatcacacttttattcctctcattttaagcattctgtattaacagaaattaacacatggtgaccaaagaacacattttctatcttttatttcctcaacttctgcaattagaatgatgagatttatcagccggtgtcactgtgcagttgtgactatcagatgggtgtcagatgacattgctgtaagtgattggtatctaccatctagcatcatataatgacaattgcctgcttctgtcacagctgaataaatctgggtggtttttttgttgttgttgttaatcttggtccaacatttcctgtcagtgagattacagataattttattattatctctaatttttagtttccataatggaaaacatgggaaataaaactcactttgcagggctgtttggaggataaaataatagaatgttgaaggctgcatagcgcatagaaggctctcaataaataccggctctttatatcacaaagatttttctttaattaaaaacaccaaggtgagacatgctctgtttaactgcttaacttctaggacagtagagagatgttaaatgtttttgacggtggcatcattatcagatttggagaaatactgaggagaaaatgtgccagctggcaaaactgctgatactagagcagtcaggattctatcctgctggaggtttcaagtagccccacaatatctctctgtgagggtgctgtggatacctccatacatctctagattgagggcacaccttcccaacaagtcctgcatatatatatatatatatatatatatatatatatatatatatatatgtgtgtgtgtgtgtgtgtgtgtgtgtgtgtgtttgtgtgtgtgtgtgtgtatatctatatgtgtgtatatatatctatatatgtatatatatctatatatgtgtatagatatatatgtatatatgtgcatatatgtatatatatgtgtgtatatatatctatatatgtgtatatatatctatatatgtatatagatatctatatatgtgtatagatatatatgtatatatgtgcatatatatgtatatatatgtgtgtatatatatctatatatatgtgtatacacacacacacacacagcaagaaagggagcagattcaatttgttaaaatattaattaaagcatgttaaatgagagacctactaaagcaagacagtcaaacataaaaaccaactgctaaggtttctaaattgccataattctgtttactgcatagtattaatctgagggacagctgacctatataggctactttattatgcttgatctcagtacttattcacatggcttattatcatggaacatttttatagctttcattctcgtctgtgacagttttactagagtgacaagctcattggtctgaaataaataggggtaatgagagcatttgagtcttcatattcaatgccatgaaaaagaaaagatggaaattacatatgggtaagaggtaaagattagatgcttgaaaaatacatttccaaattcattaagatgaatttggaagatacacaacttcattaccaaggcttcctttccttcattgatgtttagctcttataattaatatcatgcaaatggggcacagacacatacttcactagtgccaaggagtatatttacaaaatagggttatttgtgggggaaaatatggaatcccagaagtatcaaagcaacatgattccctgagagatgtgcttaggtcaagcctatagtgtttcagtggatcaccccaacttcatacactccgcatattttttagcgaaaggcggcagagaatatctgggtaactttgtaacaatgaagcttcctggtaaatgaagtggctttgataccaagaggcagactcagaattcaacttctggcaccagtcttgtcttccattgagctaattcagacctgctcagccacctccttgccagaaagggaatagaaatgagcctctaaggttatctggatcacttgcttgtcaattgacaacattaaatattggcaaaatgaggttcagcaacccttaatatgctagagagtagtcaaaaagaaagtccttgtttaaaggaagttacatagcaacacaaatcttgcttacattccaagacgacaggtcgtggtagtgatggtgctgttttaattttttaatgttataaaggttttcttcatttccttgacattgaaatatgtagcatatttttgtttatacaaaacacctattacatccttcctagcagaggcacagtagaagaaagaagatccatgcagaagaaaacagaacaaatatgaaatattcattatatactgtggaaatattttgtctcatatcagtgtgtaagtttgacttacattccctattaccttggacatagagaaataaaagaaaaagtaaagagaagaggaaagaagttccagattggcagagtagatcactgaaaatttgcgcctccataaaagcagcgagaatactagcaaaaattgtcaaaatcaactttttcagaactctagaaattaaccaaagacttgcaataatccaatgagtatttattcaactgtagttgaatctcaggaaaaacagcaagatctatggctttttaatttaccttatttgcatctccctctatccatctctggggtagctgtgaaaatcagcagcctagcagccacttgcagaggaagaatgagtttggaactccccaaaagctctatccccagagaattgtcactatttgacctgtttggcagttccatggaaacctccattcacagaacttgtctttatttgacctgactcagggcttgtttattgagaacagcctttacccccagggatatttgtggggaaaagtcagcagtaattgtttaacatggcaattgcttcaggtggtgataacacttgcagctaacaagaagctgagcaaaaagcttaatgagataagcttgggaatgagatgctcccagaaggctttgaaaagcttgtacatattcatagacatctagaacgtatgcaacacacacacacacacacacacacacacacacacacacacacacacactactgtaagaatgtctgggaaagaactgagaaggctctcacctctagcagattttgaagctctgtgttaagtggaaaatgaaacctaagtaaaatccctgtcagaggattgaaggcatccctcatatgcacatagagctcctcagcaaaggctggaagacttattggttcaggcttttaaggaaatctctgtcccattagctgacaaccaagctaactgagcagtaccttcagttgccaaaccctcccaaaaatacagacttcaaagaattagttctggcaagtcactgaacagcaaatagcagtaacaacaataatagcaacaaacagaaatgacaacaaacattagatcgtggggtgaggggatagacttgatttccagagtttccacattacattatttaaaacattcagttttcaataaaaatttataagacgtgcaaagatacagtaaaggatactccatatatgaaaaaacagtcaattgaaactgtccctgagtaaaccaagatgttggacttactagacaaagtatttaaatgaactattgtacatacattcaaaatactaaaggaaatcatatctaaagactgaaaggaaaatatgagaaggctgtctcccaaataaataatatcaataaagagaaagaaattatttaaaagaaccaaacagaagttcaaaaattgaaaagtatagtaacagaaataaaaaattcactaggctacccaacagcatgtttgaaaaggcagaaaaaagcatcattgaacttgaagataggtcaattcaaacatctagtctgaggaacagaaagtaaaaagaatgaagaaaaatgaacaaagtctcagtaacatgtgggataccatcaagcatacaaacataagcataatgaggattctcagcaaaaaaggagacaaagggtcagaaagaatatttgaagaaataatggttgaaaacttcccatacttgattgaaataaacattaatctacacattaaaggagctcaataaactacaagtaggataaactgaaagagaaccacatctagacatattataatcaaactgtcctaagacaatgacaagaaaaaatcttgaaaacaacagcagagatgtaactcattatataaaagtaaccctcaataagattaatatctccatgatcagaaactataaggctagaaaacagctgaaaaatatatccacagtaccaaaaggaaaagactatgaaccaagaattctatatccactgaaactatacttcaaaaatgaaaaattaagacattctcaaataaacaaaaactgagaaaatttgtttccagtagacctgtcctgtaagaaatacaaaaagaaaagccttcaggctgaaatgaaaagatactagggagcaatctgaatccacatgaagaataaagagaaccgataaagaaaattttataagtaaatatgaaagatagtataaatgtatgtttgtaactcttttttctactatctcatttaaagacaatggcataatgcaaaaattataaaactgcattgataggcttatcgtatgaaaagatgtaattagtaggacaacagtaacacaaatgaaggggtagggaacaaagctatatggagcaaagtttttgtatactatggatacaaaagaaggcagtaaagaaggaataggggaatacaaaggacagaaggcatatagaaaacaaatacagaaaaggcaaatgtaaatcctactttatcactagttacattaaatgtaagtggactaaacactccaatcaaaaggcagagatcagtagaatggataaaataacatgatccaattttacactgtctacaagggacatactttagattcaaagacatgactgggttaaaataaaaaaatggaaaaagtatatatattataccatgcaaacagtagcaaaagagagctgaagtagctattcatatcagataaaacagttttttttaaaaaacggttactagagataaagaacaatattttataatggcaaagggtcaaaccaataagaaaatataacaattaaaggattccctatttaataaatggtgctgggaaaactggctagacatatgtagaaagctgaaactggatcccttccttacaccttataaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaatctactcatctgacaaggggctaatatccagaatctacaattaactcaaacaaatttacaagaaaaaaaaaaaaccacatcaaaaagtgggtgaaggatatgaacagacacttctcaaaggaagaaatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttagtgggagtgtaaactagttcaaccattgcggaagtcagtgtggtgattcctcagggatctagaactagaaataccatttgacccagccatcccattactgggtatatacccaaaggattataaaacatgctgctataaagacacatgcacacatatgtttactgcagcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctcagcaaactatctcaagaacaaaaaaccaaacaccgcatgttctcgctcataggtgggaattgaacaatgagaacacttggacacaggaaggggaacatcacacaccagggcctgtcgtggggtggggggatcggggagggatagcattaggagatatacctaatgctaaatgacgagttaatgggtgcagcacaccaacatggcacatgtatacatatgtaacaaacctgcatgttgtgcacatgtaccctaaaagtataataaaaaaataaaataaaataaataaactttaaaaaaatccttgtacaacaaatattcatagcagcatttttataaaagccaaaaaggggaaaaaaacaaaatatccatcaattggttaatggataacaaaatgtgatatatctatacaataaaatattatttgatattaaaaaaagaaaaataacaattataaataagcatacacctaataacacatccctaaaacatatgaagcaaaggttgagagaactgaaaggacaaatagataattcaacaataataatagtggagccttcaacatctcactttctataatagagcaactagacagaagattaacaagaaagtagaagacttgaacaacactataaaacaactagacctaacagacatctatagagcactccacctaatggcagaatatatatatattttaagagcacaagaagcattccctaggatagcccatactttaggtcaaaaaacaagtctcaataagtttaagagggctcatatgataaaaaaaaaaattctccaaacacaatgtgatagaattagaaagaataaccaaaaagtttgggaaattcacaaatattggttagtaaaacaatacttctaacaaagtaagagttaaagaagaaatcaaagggaaattagaaaatactttgaatgaaaacaaaataaaacataccaaaatacactggatgcagcaaaatcagtacttagaaagaaatgtatggctataaatgcttacattaaaaaggaaaaataaggaataaggtctcaaatcaataacctcaccctccaccttaagatactagaaaaaggagagcaaactacacctaaagcaaacagaaaggacataataaagactagagggagaataaacaaactagagaacagaaaacaatagagaaaatcaacaaaacaaaaatttgttttttgaaaaggtaaaattggtaatcctttagctagttttgccaaaaaaaaaaagagagaagtctcaaatcactaagataagaaacgaaagaggggctttaactactaactttgtagaaataagattataaaggaatattatgaataatggtatgccaaaaaattaggtaacaattatagaccatatgttaggtcataaagcaagtatcaaaacaactcaaggagaattttaaaattagaataaacttataataattagagaggttaaattaataattaaaaatatttccacaaagaaaagctcaggaagagatggcttcactggtgaaattcaccaaatgtttaaagaagactcttttttaaaatgtcagtccttaacaaactcttaaaaataaaaaaagtggagactgcttcccagctcattctatgagggtagcattgccctgacaccaaaaccaattatatcacaagaaagctatagacccttataaatatagatgcaaaaattctcaaaaatactagtaaactaaatccagcaatatttaaaaaggtatgcacaccatgactgaatggcatttatcccaataatgtaagattggattatcatccaaaaatcaatatatataatatactattttaatagaataaaagacaaaaatcacatgattatctcaataggcaaaaagcatttgacaaaatccaacatgctttcatgccacttaacaaacattcaacaaactagaaatagaagggaacttcctcaaactaataaaaggacacttaacaaaaaatgcacagctaacacagtaatggtaaaagactgaatgttttacttttaacaccaggaatcagacaaggatattggctatttaaccacttctatttaacaatgtactggaggttctagacatgcaatcaggcaagagaaagaaataaaaaggcattcagactgtaaagaaaaaagtaaaattatccctatttgcaggtgataaaatctcatatacagataattttaaggaattcagaaaaaactattataataaacaagttcaacaaggttacaggacataagatcaatatacaaaactcagctgtatttctacacactaacattgaacaaatcaaatttaagaaaataatttcatttacaataatatcaaaaagaaaaaaacaggaataaatgtatcaaaataagtgtaagtcttttacacttaaaactacaaaacattgctgaaagaaattaaagaagatacaaataaaggaaagacaacttatatacaggagttggaatataatcttgttaagattgcaatactctccaaattgattgacagagtcaatgcaatccctaaaataaactcagctactaattttggagagattgacaagttgattctaaaattaatatggacatacaagagacctaaaatagtcaaaatgatcttcaagatgaaaaacaaaaagtcaaaggactcacacttttagattttaaaacttacttcaaagatacagtaaccaagacaatgtgatactggcatgaagacatacagattaatggagtagagttgagagtctcataaacctatatatctatggtcaattgactttccacatgggtggcaagacaaataaattgggaaggaatagtcttttcaacaaatggtgctggaatactggatgtccctgtacaaatgaatgatattggaccccttatctcacaccatgtacaaaaatttaacttaaagtggatcaagggcctagatgcaaaagctaaaataatcagctcttagaagaacacatgggcatatgtattcatgcgcttagattaaacaatcacttcttagatataataccaaaagcacaagtaacaaaaaaattataaattgaatatcaaaatctaaaacttttgtgcttcaatagacaccatcaagaaagtgagaagacaactcagaatgaaggcaaatatacataaatcataaatctgataagggacctgtatacaaagtataccaaaaactccaagactcagcaataaaaagaccattaacacaattgaaaatgataaaggacctgaatagacgtttcctaaataagacatacaaatggccaataatcacatgaaaagatgcataacattgttagccattaggaaaatgcaaatcaaaactacaatgagatgcctctccaaggaactgtaaagtatacttactgcaatgaagaagtacaattatctctatttgcagatgacataattctggaatctcctaagattccaccaaaaaactgttagacctaatatatgaattgagtaaaattgcaggatacaaaatcaacatacaaaaatcagtagcatttttatatacaaataatgacctaactgaagaagacatccagcaaacagtcccatttactatagcataaaatgatactgagaaataactttaaccatggaggtgaaagatctgtacactgaaaactataaatcactgatgaaagaaactgaagaaaatacaaataaatggaaagatatcctatgctcctggattggaagaagtaatattgttaaaatgtccatactacctaaagcatatccagattcagtacaatacctatcaaaattccactggcattcttacagaaacagaaaaaaccatcctaatatttgtataaaaccataaaagaccccaaatagccaaaacaatactgagaaagacaaacaaaattggaggcatcacacttcctgatttcaaattatattacaaagctatagtaataaaacagtaagatattgacataaaaactgacacacaagccagtggaacagaatatagagcccagaaataaatccaaaccatgtatggtcaactaatttatgatgaaagcaccaacaggacacaacaggaaaataatggtctcttaaattaatggttctgggaaaactggatttccaaatgcaaaagaaggatattggaccattatcttacaccatacacaaaaatcaactcaaaatgaaaaagacctaaatataagaccaaaaactataaaattcctagaggataacatagggagaaaagtcctggacaatgccttggtcatgattttttgaatatcacaccaaaagctcagtccacaaaagcaaaagtaaataaatgggactacatcaaatgaaaaagcttctgtacaccaaaggaaacaaccaacaaaatgaaatagcaaactatgtattgggaacaaatatttgcaaactatatatctgacaaggggttaaccattcaaaatttataaagaactcatacaactcaaaagtggaaaaacaaacagcccaatccaaaaatgggcaaaaaatcagaatagacatttctccaatgaagacattaaaatggccaacaggtacatcaaaaggtgctcaacattatcaacatcattaatcatcagggaaatgcaaattaaatccattgtgagatacacctcatacccattagggtggctactatcaaaaagtcaaaagatgacaaatgttggtgaggttgtggagaaaagagaactctttacactgttggtgggaatatagattggtacaactattatagaaaatagtatggggtttctaaaggggttaaaaatacaactaccctatgacccagcaacccctcttctggatacatacttacaagaaatgaaatcaccaccttataaagatatctactttctcatattcattgcagcattattcacaagagcaaacatatggaaacaagtaagtgtctattgattaatgaagggataaagatattgaatattatcaagtggtacatatatataatggaatgttattcattcctaaaaaagaatcagatgttgccatttgccatgacatggataagcctggaggacattacactaggtgctacaggacagacacagaaagaaaaatattgcataatctcatttatatgtggaatctgaaaaaaattcaaatatacagagagaacaaaacagtagttactaggggtagtagtcagtgggaagaaaatagggagatgtaggtcggaggatacaaagtagcagatatgtaggatgaacaagtctagagaaataatgtacatgaggaccctaggtaacacaattgtattgtatgtggaattcatgctaaaggagtacaatttagctgctcttgcaacaaaaacaaagaaatgggcaactgtgagatgacggctatgttaatttgcttcactaaagtaacatttttactatctatatgtattccataacatgttgtataccttaaatatacataataaaacttatttaaaaaagaatttagcaagtagaaaaagtggtagaggagagaaaaatgatggtccaaatatagaagtatttgatgtgaattgtggcagagtttcaaagaaaataaaattacataatacgtgaaaaacaaagagacaaattgcccagcaaggatatggacacatcatgtacttcagaaatggcataaagggagataatcaattatgagatagcactcttcaaaggataaatttttagatccaaaatgatcttaagtaacatgaactatgttttggggtgactaatggatgggataacctatagtgttcttttattatatgcttgttttgtacacacgagggatgccataaacaaaatgagttcccttttgcattactacttaaaagtaatcatacgggtcattttccagtggtcattcacttcttgctactacacaatgcttaggcttagaattctgagcctgaatagcaccctaattgcaaaaagcatggtcattaaaaacaaacaaatcggccaggcacagtagctcacacctgtaattcagcattttgggaggccaaggtgggtggaacacctgaggttaagagttcaagaccagcctggccaacatggcaaaacccaatctctactaaaagtacaaaaattagccaggcttggtggcaggcaccttaattccagctactcaggagggtgaggcaggagaaccacttgaacccaatagacagaggttgccgtgagccgagactgtgccactgtactctagcctgggcaacagagtgagactccatcccctgcatcccccaaaaaaacaaaaaccacaatgaaatgctgtgtcacatccactaaaatggctataactaaaagaaagaaataaaaataaggattgataagcatcaaaatggaaccctcattctttgctggtgcgaatgtaaaatggtatagctactgtagaaaacagtctgacagttggtccaaaagttagacacagagttaccacatgacctagcaaatccacttctaggcctatacccaaaagaaccgaaaatctatgtgtactcaaaaatttgtacatgaatgttctcagcagcattattcttaatagccaaaaaagtagaaacaacatcatcaactgatgaataagaaacatatgatatatccaaacaatggaatattattcatccataaaaaagaatgaaggaataaagtgcatgtacacatgaatgaatagtgaaaacattatgttaagtaaaagaaaccaaacacaaatggtcacatattatataattccatttataagaaatgtccaaaatagacaaatccattgaggcagaaagtagattagcagttgctagggccttggaggagggaagagaggggagtggctgctaatgggtagagtttcttttttggagtgatgaaaatgttctggaagcagacagcaatggtatggttgaacaaccttgtgaatatattaaaaaccactgaattgaacaccttaaaatgttgattttgtggtatatgaattacatctcaagaaaaaaaaacttaaagataagaataattagcataaatatgataattacgctgccaagtaagattaataaaaattgttttggatagttgaacaaatcaagtgatacttattgagtagcctaccaagtgctgtggccatggagatgccctattcacatctccctttaggagaacctcatcaggaagtatagctgattgacacctccatctccacgcctctgggtccaagcctcccctggagctgttccccgtcaatgactgagcgtgatgagggcaggaactgggtcactcccgtgaaagcatgatttctccaactggcaaattctgctcgggacttcccattggccaggcagtgattttttccaaaccacactgtgaccaaagactctttatattcactccttacttgtctctcttcttccacagagcactgtggtcaaatgctctccccatctactgctgatcctgctctctttagctttcacatttgtttctcctgaaaaaccttttgctcatctaatattggcatgtgttctttggagagcagaagtgactcatgaatgtatgtctaagaaggaatatagtacaagacttgaggaatgtagctgaaaggccttagtaggactgaatgtgtctgcatgtgtctctgggattccagggatatattgtattcgcttgtactaaacagatgtataaaagacttacataaacaaactactctccaaggtgcctaattcgaaggataatatatgtatttgagtgaagtagttcttgaaatgcttgggaaataccagtttcatacaatcatggtacttaataataaccaatataggtactgactgaggccacaaacactgcatgggcaaatcagacaaggcctgtaagtctaaagcagtgtttttcacactttgggacactgcaaagtgtaaatcatgaaatcagttttgtgggtcatgacagcagatgttttagttttgtttttctttccttaaaagaatagataagaatataggtgcatagtaaaggtaagtatagtttcataaaatatttgtcttagatgtgtgtgtgtatacttgtgtgtgtatttatatacactacctaggtttggatatttttgtcacggattgcattagaaaagatttgaaagtcatgatctaagggacacacaataaagttggcacagtcagaatttacataaagacatttagtaacattctttaaagtaggaacagaatttctgattcccaaaagcttcaccagggttgcatgcttttgagtgataatgtccaagtggagtgagtcacataaaaccttctggtgcatagaggtgctcctccaggcccagaatcatattcataatctgattaggtactggagatcacctcatgtaacccaggtacatctcagagttataaaatgtgcaatatgggctgggtgaggtggctgacgcctgtaattccagcactttgggaggccaaggtgggcgcatcacgaggtcaagagattgagaccatcctggccaaaatggtgaaaccccatctctactaaaaatacaaaaattagctgggtgtggtggcgggcctgtagtcctagctactcggcaggctgaggcaggagaatcacttaaactcaggaggcagaggttgcagtgagccgagatcaccccactgcactccagcctgggtgacagagcgagactccgtctcaaaaaaaagaaaaacaattgcaatatgattgcagggtacaatcatagtacactccggaataaacaaaatcctcactcatcatacttcgtctctccaggctaatacagtctcttccaagtttattcctgactgtatcattgctgctggacaaagacaaagggtggtaacccagacatctctcgagtcttgctaagagctccttggactaactatagagctcatccagtggtttgcctcactagagctacgtctcatgggagtcaattctccttaaaagaatgataggatttgggccatggtggctggaaatctaaaggaagagtcacagagaagtcaggaatggttgcaaaccattgctagaaggggtaatctgttttgcaaaactagattccacacagatgtgtaaaggaaaagaaaataaaagtcaataaggcattgaaacagaagattcactcttctaacctaaaaaatgcaatgcacaaaactaatgttgagaaaagtcacagggctgtctcatcttaaaatttaaagaaactctaaactctcgtaggtgcttctcaaagttgaggtatatgtactctctgggggaaatcatagatgagctaagggatggaaaagccacaggaaaaacaaagcggctctagggtcatattatgtcattgaatctatgagagcatcgattgtaagatggactgttgttgtcagcccactaaaagaaaaaaatgctatgaggcaatgcattatcacttaaaatattttaatcttattttaaaagatatttcagattcaatataaattctatcatataccattcttgaaggaaaatgtaaaactatacaagttgattatacacaagggaaaataaagaatgtcactcttctgaatcaattctcaattcagagtcgtcagtgttcacagatcttatcctctaagccatcaggatattaatgatgcagcatgtatctttaaaagtgctctgctatcatctccagaaatttcttccaagctgctgacactctcttgtaagttttgaggccgtcacttattgaacttagtagaagataccattggagggtttttagataaaaccaaactcatattccttcctaaagtgatctttccttggtttgttggctgcaattttaagggttgctaatgtccagtcttgccactagaaattttttcactgtgcagatacatgtctaaaaatgcaccaacagctaacatcactttgaaggttaagtaagactcctggccatctttccacatggctgtacaccactcattcatcagctcacctgtcattcatctctatgtgtgtgtatgtgcatgcatgcatgagtgcacacacaaaagataacagcattgagttcaatctcattttcatctgagaatgggttcaaactcacacactaaaattgcattcatttcccatttctgcataacaaattactatacatatagcagcttaaaacaacacctatttattatctcagagggctggaagtcacaagttcatcatgacgtgctggatttgctgctcaggctcttataagaccaaaatcaaggaattgacagagctatattcctctctgaaggctctggggaagaatggagctcattcaggttgttggcagaattcaactccttgcagttgtatgactgaggtccaggtttccttgacatttggccctgtctatatttaaaccagcaacatttgttgaatcctgctcgtgcataacatgtctccgacttttcccttctgttgagccttttcagcttccttttgtgtcctcaactgggagaaggctctgttttaagggttcacatgattacatcagactcacctagacaatccagaataatctccctattttaacatcaattgattagttatcttaattatctctgtaatctctttggcttgtaatgtaacgtgaatatatgacaagtggtgaggatcttgggggtcaacattctgcctcccacacttagtttgatattgttcaaaatgaaatatggtgacaagttttgaccacctgacaccatgcatgacatcacattgaaatgctgtacattttgtcatctatgttctcagtgttaattgttttagcactcttggcattggcaggtatgtcaaaggacacaggttttctcagcatttcctatttgactaaattcctagtttttcctaaatgaattacatgtcactggatgttaagcagtttccaatcagttgaaaatttttgacaaattgatgttccacaccttaataacagtcctgcatcatgcacgagtttagttatatcagcctcttgttttgaaatttatttcacttattataagagctttggcaatttctcctgccttcagttgcataacttgacatgtgttaggtgacccgtgtagatgtatttcagtaaccaaatatagcaccacttcatcttcttgagagtttcttccttcattgttgctttgaaagaacatacagaaatgggaccagttttccaaaaacaaatattttcatcactaatatcaaatttacactccacttcttatttctacgtttttctgcaaaacaataacttttcatttcaatgccagaccacactgtaatctcattggacacacatattaaccagcatttaagtccaatctatgtagtaccaacaacgtacaatacacaattgaacagataacacaaacagctctgaccaagtttgtacatgcacaggcaatagctgtgtcaccaactgtcactaagacatcactggtagtaagataccattctgactttcaacatgttaagtgtgagaaaaagtgccttaaaatcattgagcaactactatgtgccaggcattgtgctctttcagcaattctactgaattttcctggtaatctacttgcaagtaataaacgtaatggctgagaagattagtgccagggccaggctaactgggtttcaaatattgcctctgtaacttactgtgttaccctggacatatttcttaattcttatctgtaatataggaaaaaaacgggataattcatgtgcagtacttagcacatagtaaaactcaaaaatagtgtcatgttgtttctgttgtttttaactgagcttaagagctggctccttttcttcccatatgctcatgaagcaaatacctgtattctcccagttagtgaaaaagtattcattctggaaatagaacctcttttagttctaattccttattgttctaaaatataccagattatctcatcctgccttgagtgtactggttcactaaaggacaggagccatcaatactcatgaccagggaactcggagaaaatacggtgtttaaaaaaggaaaaatgtccacataaaaggtttaacattcaggctacttaacactctgtcctccaccttttcttttgtgcatccctttccctatatgcacttggatctctgtgggttaacatctaacaaaggtttaggaattaaaaggtctgtaaaaaatggggtacactcggggttgtttaggggctaggcaacagactatgacacctgggggagaaagtgagccttcttcccatttctgcacaaatgacccagcctgtcccaggttcgtgaaggtcaccagtgcacctaaggtagtgctggggagctgtggcacagcactggtgaggagtgcagttatgcccgtgggaattccggagtgggcaaggaagcccacatcatagaacgctgctctgtcatggccagagggagaggatttatgggtggtcacttggaagaaatgatgagtcagtagtaaattattattattattattattattattattattattattattattattttaaatcttaggcttggcatggtggttcacgccagcacttttgggaggccaaagcaggaggatcccttgaggccaggaatttgagaccagcctgggcaacacagtgagactcctgtctctacaaaataattttaaaattagccaggtgtggtggcatgcacttgcagtcctagctaattgggaggttgagatgggaggattgcttaagcccaggagttcaaggattacagtgaactatgattgcaccactgcactcttgcctgggcaacagagtgagaccctgtctctaaaaaaagaaatcttagaaactccaggaatacttcaaggatggcttttacaagggactagggttcttatgttacactacataggagaaatgcttaagcagccaaatatataaattataactattaatgtgactctatttatttaaagccatagtctggaggcctggtgaaatctggttatgtttgtattatatttttaacccactcccaccactgttcattgcccttgagatccttgaggacagagactgcttttaatttttaaaaaatctctgtagccctatcacctagcagagaactcagcacagagtaggtactcaatatatgactgttgaaggaaggaataactgcctccaaacaacaaatttagaataaacagatagaagttataggaatataattcaacataaaatgcctttctaactactagaatcccttataaatgcaagaagtctatcatgacatagtgagaatcctgtcactagaggtgttgccagtgataccctggaagaggagcacacttcatggagggagatggattgaatcatttccagctcttgaattgattggtactcattgcatggagaccaacaggagactagctatgacaaagcagtgaaagacactaagcagaagtgatgagtcagcaaaactggttattatttaaaaatggcttcaaggactatctataaaaatcagcaagcctcaaaccagagttcatcagaattgaaataataccctgaaacattgttacaaggagccatagaaattgtcttctaaaaactacactattataactctgactgatgttcagaggactaaagtatctaatagacatcatctatagtgatgatgttaaatgatgaaaggttaaaggaaagatcagactgtgagatcaagctgtgatttttagactcatagcccatttcaatgtcccttccatgtcactggtgaagtaaattctggagtcacttgtcttggttcctttaacttccaataaatgactgaaggaactcagatctacacgaggagaattactggacaatgatggaaaggtcttctgagataaatgaacattctacattaatttaaaagccataaatagaatgatgaataggactatctcataatgtcaaagttcaaaggcacttttcaaatgtctctttaaagaaaacctgacctttctttctgtcttttattatcagaaagtttgccaagagcagtctaggtcttgggtcatttcattttgacatggaagttctctcaggattaaaaataataaaaaaacagaagtatttaactctgaagtgaccatgagaacatgttcagcagtataaaaaataacaatattgaagcattaggacttcaaaagttgtgttttaataactacataaagcttcccctctcatatatgagagatataacttatatgaggtcatgaatagctaaagatatcagcatgaatagagatttttctatcgtatttcatgttgttttataacattctatttaggaaaattgctgagtatactactagtaactttctatgctaaatatcttggttaggtatagattagctggcattaaatatagatgtgaatataaatacatttttatgaatataaaacctcttaccaaagacctctttttcccatttcaatttccattttaaggtattattaacagtcagtaaaattcacccttttttaggtaaatttctccaagttttgacaaatacagttgtataatcaccactgcaagcaagacacagcgtggttccatcacaaccctctacccctttgaagtcaacccctctctccatctcctgtccctggaaatgaactgatttactttctcttcctataattttgatgttttaagaatgtcctgtaaatgaagttatatagtatgtagcaaaggccccttttaaacttcatgcatttgataaaaaataatttactttttatttttacttactggtttctatttcctgaatttaaaggcaataatggatataaaaatcaaattactcttgagtattacatcttgaaataggtaattacccagagggcctttagaacatatagacctttaggacttcacttctgcagtactgaatcagaatctctcagtgtatgttctgagaatttagtttctactaaactttctaagcctgattctgattgacccattagatttgggaaacattaacctgacaggtattcactagatgagatcaacaagcagattttaaatgacgtgtggttatggaatcaaagttcagaggttgggagagtcttatctaagtgaccttgtccttggtggctaccacttgctggttgcagggcctcaaacaagttacttaaacttgatgaaccttggctttctcctttataacatggggggaatgcctacttcaaaagattgtttgggggattaaatgcttataaatcatttagcatactacatggaacacataacagtcaaataatggaggttgctcatattttagtatcaatatcttcatcattgtcatcatcatcatactgccctgagtgctttacgattctttctccatgtctgcattttggttaatttcactattttttaacccttcctctagaggcaaccaaagagaatttttgtagcaacacagctattattcaaggcagtaaaaagctaagagaaattcactgattgcttgcaatcttcacttctaccctgttatagcctcaaagatgccaatgagaacaagaagtgaattactggaaactctctcagtcttttttccaagcggatgttattggccaattatggacaaacaagagggaggaagagaaacaaagagcaaaaataaagtaaaaaattaggctgtctgtacagctaagatacatctaaaattttactttttttattggaagatttagtcaaatatgtgatgtgaaaagaaactgaaactgttggcttaatgaaaacaggtttgctccagtactattccatattaacttacctaaataacttggattcaaagttcaggagtcagcagagtatcttaagatttatttcaaaacattacaaggtggccgggcacagtggttcgcacctgtaatgctagcactttgggaggccaagacgggcagatcacttgaggtcaggagttcgaaaccagcctggccaacatggtgaaacccagtctctactaaaaatacaaaaattagccaggtgtggtggcatgccctggtaatcccagctactcaggtggctgaggcaggagaatcgtttgaacctgggaggcagaggctgcagtgagccaagattgcagtgcttcactctagcctgggtgacagagcgagactccacgttaaaaaacaagacaaacaaacaaacaaaaatttacaaggttcagggaaaagaggaagctaaaggcaacattttaatcctattacaagtactaaaagttggccctaaaaactgattgcaagctagatgtatatgcatttatttatttatttatttatttttattttatttttttgaggcagagtctcgctctgtcacccaggctggagtgcagtggcacaatctcggctcactgcaagctccacctcccaggttcactccattctcctgcctcagcctcccaagtagctgggaccacaggcacccgccaccatgcccggctaatttttttttgtattttgtagtagagacggcatttcaccatgttagccaggatggtctcgatctcctgatctcatgattcgcccgcctcagcctcccaaagtgctgggattacaggctgagccaccgcgcctggccgtatatgcatttatttttaagatatagttttaatttaagccctgaaatacagaagagtcacgatatttggttgtgcttgctaatataaagaactactactatcttctaagaattatgcaatgctgctaacaccaaggacaaaagaacatcaaaagacccatgaaccccacaagccctacctgttctcagcatcagcactgcactttggggacatcaattcaaaggatttggtaaatttcaccacctgtcgcatagaaagataataaatccaggtcaattaaagctttattgccgtttaaaataatgtaataaacattttcatctttataatgattataatacttggagattatagagagatttttaagtggagaaatcccaagacagagtagaagaggagaatcccatcctacatcttgtatcttatttcttacaaagcatacattgtcaaagttttaatacatttcactaaacatgtacatatttttacaattaggtgtacaatgagctatggaggtcaggtaaaggaaaatctcatttgaatacttaaaaagaaaactgttcttttaacaacccaatcaacagcaataagagacccaggtagggacagaacacccctcaaagaagatgccctctgtcaaccccaggctcctgaagttagttcatctttaagcttggctcatcattgttctcaggtgagcttcgtggtaccaccacctaaagggtaaagaggaagccaccttattcaacaatcattcttgtgtggacacttcctctctcacctctccagtgaaagtagcataccagtgcgagagttgaccaaggcttatgttgagggggaatttatggaacagaaaatgtcaatgtagtttttcttattattagctaatattgagtttacactgtaaaccaggccctacagcagaagcttttttgattatttctttattataaatctaaagtagagaattttatactcagtctatagatgaggaaactaacccctaatttttaaaaagacttactcagtttcacacaattaaataaggcaactggcatgaaaggaattctctctgatgctagagtgctagctctttcaacactacaaatgttgagtgagaaatgcactatttctggcccttgtaggggtggacggaaacctttccttctaccctctgaaggtttgctgaaataaactgacaatagacagattaacaggagaacaagcatacaaatttactaatgtgcagaagcacagaagccatataaagtatgagactcaaaggagggccagatggttgaagcttaaatagcatcctctttataggggagacggacgggggatgtaggcaattttgaggggtagaaaaaaatttcagaggaattaaatgagcccaaagaacagacaatgaccagggacaaagtttctctgagctctggaggaggtggcagcaagttaggggtggaacttcactgcaaacaaaggttatctttttttttttttggacaggttctcactctgtcgcacaggctggagtgcagtggcccaatctcggctcattgcagcctccgcctcccgggttcaagtaattctcccacctcagcctcccaagtcgctgggattacaggggcgtgtcatcatgcccagctaatttttgcatttttagtagagacagggtttcaccatgttgaccagggtagtcttgaattcctcaccccagatgaggcacaagccttggcttcccaaagtgctgagattacaggcacgagccaccgcatctggccaaaggttatcttattatgcagataaagtctcccgggtaatctctcagagtgccctcagaagaacagatggaaagtctgtctgggcatggggacattcctcagtcttcctttctgtgatatgcgaataatattctctggttaataaaatttcagggaggggatggaagagagttccatcttgtacttgtgaggaggaacaagaaaaggttagaaagttcttggctctgaggggactcagttccaaggccttttaatttcctttagatcaacgtgctcagtatgccaaggcaccatgctttgaagtctccttttctgagccccaataccctcttttgacaagatataccacatgatagaaaaacaagcccctatagtgaaaggagtccatctgaatgtcatagaatgcttccaaggttgacatttagattttccttagccgtacgcagtcatgcttcaaaggccttttaaattaaccacttacaaggaattgatgagcacctgagaaaatgatttggaaaataggaatagattaaatatttaaaaaagctttatcagtgaggtaatgaactcaagctaggcaaatgcaacattagggaaaaaatagaaaagaagggctcatcacaaagaaaattctgtgtgaccagatgaatgtagggcaatgacaatagctcaactgcaaggaaatacccttgacaactatagaacatatttcatttcatattgtaatatgaattaagcctctacagaatcactcattgtggcaaattttattttccaaagatggtcacaacaatatcttctatcccatattcttctcttccatgtaaccctgccactttcctaccaagtggtaggatctacgtcctctctccttaaatccggtgggcttctgaaagcttcaacaaatagagcatatggaagacatgctacatgccttccaaggttgttgtaaaatgcaacacagcttctgccttgcctgatgaaatatgtgtgcttggagccctcggtcaccatgcaagaagtgcaactaccctcaggccactatgctgaaagggagccaaaccacatagagaggacattttcctgcaaatgagggatttttcacacattataaacaatcctttatgcatgtatcaatgcttacaacatcccagaaggtagattttatcctcattttattgacagcaaattaaggcttagggggttaagtggtttgctggaagccatgcaagcaggaaattgcagaaccgagatttgaaccatgttgttctgattccacagctccagtgatcccacttctcactgctttaataagcaagagcaagtgttattgcagcagcaaattatttggacatgactccttcaaaaccagaataaactctactttatttactaattctacaaatatttattgagtacctcctatatgcccaaatttgagtaaacacagactaaaaagtaacttgaagtaaaacacttggcttggtataagattaatcatattatcaataaactgttaattgtttctgcatttcaaaattgagcaggacatttttttaattcctgatctgataaatgagattaaattctccaatattaataagaatgcttcatttggcctacttcttactattgattagaataatttacagcgtggtaagagtagatgttaatttctgcaaatctgatagcaatacaaataaattttatccaagtaaagatgcaaatgatttctgtgcaggagaaaagaaaagctcaatggttacaattgtattatcctgactggtagtaaccattttaaaaagctaatctagcaatcttatgctggcattctttcagtgcctattttagaaccaactttgccactctgcggtttctctttttgatgagttaaacaaatctttgatacatgcttgctttagatttctgcaagagttaagtttttaactttttgaaaattatctttcaatacaacaaatacgtaccgtcttatgtgtcaggcagtgtagtgtacaatggaattacaaatgtgaaagtaaaagaaaataaaatctctgcagttatggagcttgctttatggtagggagcttaatttgccctggctcctcaaaactagtgctccctggaaaaaataagtgcacttctggtttcacatcttaagaaaacaaatgtgagaaatgtccagagaatgaaagaaaataaagatcttttaaaaatattttttccatctgaggaatagcaactgagggatataagaaatggaataggaaataatagcgtttcaaagccatagaacctgtagatctacagagaatggataagatatatacatctcttaatgaaatgacaggatgtttgaactcttgtaaaagaagttggagaaactactaaaaggaaaaaacacttttttctaaaatgttagaacatcttactccaacataaattacaagctgaaaagaaaaatagggacaaaacttttatttgttttgttttctaaattcatttttaatgtataaggggaaagtcaaggactatgtatcattcaacttcagcattccatagaatgcattagctgtgtcctccagtaaaatggcttatggtgccatgatcaaagtcagacactgtattcatgaaccacgattgaccttgtatgtaggaaagaactgaaccttccctaaagagaggtctggcctttgtccttggctcctgagagataatctctaaacccttgtaatgcctgattaatgtgcaaagagtaacagtgtgatttagaatgggggcttcaagccacaccaacaatatgatttgggtgggagctttgggacacatggtatcagttgaccactggaggaaaggagtcagaggtcagccgcatgggcaggtcaaccctatttttgtgatcaagccccaataaagactctagacactaaggctcaggccccggttggcaaaatttcatgcatcttgtcacacatgatagccaggagacattgacactatccatgactccatgagcagagtccacatgtggaattttcctagactctgccccatgctaatgttaatctgtatgatttcctgtagtaaactgtaactgtgagtgtaacagctttcaatgagttctttgagcccttctagcaaattactgaaacttagcatggtcttgggaactccaaaactcataaatggtgtcaggaatgaggaaagtattgtagactatgttccctaactttacacttatatcataattcttaggttcctgtgtctttagaagaaaaatgaagatactaatcttcattagtgtctttagaagaaaaatgaagatactgatgtttactgatctttggttaaatattgattatccagtgtgtataaagtactggatagcacagggagataccaaagaaataataaataaggtctctaaccttttaagacttaacatttgtgatggttaattggtatgtgtcaacttgactgggctaaggggtgcccagatagctggcaaaacattatttttgggtggtctgtgaagtgtttctggaagagattagcattcgaatcaataaattgagtaaagaagattgtcctgagcaatgtgggtgggcattgtccaatccactgagggctcagatagaaaggaagaggaagggcaaatgtggtctctttgtttgagctaggacatccatttttcccctgtcctcagacactgggactcctgattctctggtctttgaactcagactgaattacatcaccagctttcctggttctctagcttgcagacagtaaactgtgggacttcttagcttccataattatgtgagccaattcctagaataaatatctttatctctatctatctatcatctatctgtctatctatctatctatctatctatctatctatctatctatctatccatctatctatctagtctcctattggttctgtttctcaggagaaccacaactactgcaacattttaaagaagaaaaatttaaagtgcaaggtgagttgacctctgaggttagattcacagccaaattgaccctgagtcatcagattatttggcaaggcaatatacatgtggcattagtccgtgatgaggcagcaagatgaacagttgagaagtaacataattctggagatgtaaattcatctgccagcctctcagtcctcaaaagcaggagtgggcaaaggatggcccatgggccatatctggcctaccacctgtttttattaataaagtttcattgtaacaaagccatacttattaatttaagtattgtctgtgcctgctttctactataacagtagagtgaatagttgcaattgagatcgtgcaggccacaaagcctaaaatatttagtagacagacctttatttttaaaagtttgccaacttctctggtgtagagccatttctaggccagatcagttatttttgctaaattgttaatggctaatgataggttaatgtattaatattcccatgtaatatagctatattcagaaagaggattcttggagacataatcttttaatttgaaacagtattgcaatgatagaaattttaggcaccagggtaagtggtaagagatatactcgaggatatatccccagttggcaggggacagttccactccaattaagcctgttgtccagggacaattattaatagtgcccactttcacgctcacaagtgtctttgaatagcaaattctaggcaggcaggccattggctgctcctcaaagcatcagacaacttatatttttaaaaagaattgaaaatataatgcattcaaagagaaaattgtttatagtcagatacctgggttaaaaaataaaacagcaaaaacggcttaaatatttggatataatttaacgggatatatagaatgacattgcagaaattatgaccaataccaaataggtgaaggcataaataaaatagaatagaatttatgctttattcctgacttggaccaattatataattcttagttttattaattttaaaagtttactatctaaatccaactttgattttattatacatttactaaatgaacatggattaaataaattaatatacacacactaagtaaaaaagagaatcttataagggaaatatcagaagtggtttctaaatcaatgacacaaaacaactggtttcaagcttcctttgctgctgatcagccctgattattgcaccctggggaagggagtgtacctgccaagtgaagtaaacaaaacatctccctgcttgttctttggaaaagctccatggacagaagtctttttgatttggatatttatcaagtgctagttggtctggcttctctctgttcttttaacttaaaaacaagttaaaaaaataaaaactatactcaaatagatattccgggcaccaaaataaaaattatctactaagtaatcatgatttttgttttctaattttctgaatctctatttttctataagaggactactcaaaatggcaaaagaatgaattaaataggccaagtgtggtggctcacacctgtaatgccagcactttgggaagtcaaggtgggtagataactgagatcaggagttcgagaccagcatgaccaacatggtgaaaccccgtctctattaaaaatacaaaaattagccacgcatggtggcatgcacctgtaatcccagctactcagcaggctgaggcaggagaatcgtttgaatctgggaagtggaggctgcagtgagccgagatgcaccactgcactccagcctaagtgacacagcaagactctgtctcaaaaaaaaaaaaaagaaaaagaatgaattaaacaatcatctcttactatgcttcttaataaatctcttacttatgccaatttactctaatcatttattcatgcagtcagcatttatcaaatacttagtgcaccaagcactgctataggctctataaacaccaaggggcacaaaccatatcctatccttgagaaactcacaacacagtacagagaagcaaacagttcacaaatgtttcaccacaatgtatgtccaaaatgctaccagtgcacagaggaaggtgttaaggaagtcttcatgtgaactgtgtgacaagcaggaacgctctaggctgacaagtgggggaagtttcccaggctgagggaacaaatcagttcgttctgggagaaaatagagaactctcaaaagagtttaactgaacataattcaataaaggggcaagctatagaagtgtgggtagggtgaaaagaagcccataaggaatggtgaggcacccaggcactagcaactttggaaagcagttaatactcctaggtctgaggttacacaagagggagggaggggagaagggaagggtgattttgagatcctggaggtgattttgatatccatgtgaagagaagccatggaaagatctagccaccactagaactggtaaacaaggaatgaggaaaataactacacccaatgtctttcactcctctggcccttaaatcttctgctcataccttctatttgtcaaacccaactggcagccagaggacaagaaagcccaagtggtgtggtaagcaaagatcagccctcaagggcactgaggtaaagacagaaagaccaaccataggtagttggggagtggagaggttccagagagtagccagtagagttgacaatgttgaactttacctgagctctgtgctcccccaaaatagtaatgataaagaaatctccctatcactgttccagaattggctatcctcaacagaccactctgccctagcacatttcaaaataagacatttctccatccttcctcatgactcctgtaaggctcatgaatgatgtaggtaactcccttgtctatacgtttctgtgaaaccccatctttttctttgagatgttcaccattaatgagcattctccctattgcaatagccagatgaaatgatcttcattgtctggtgcattttgtctttcactgggactatttgcacaaagatatgcatcttttgtgttaataggctagtacatgcttaggctgaccatggggaggtggggtagaggtgaagtaaaggatagagcaaggctgaggaccagagaggagaaccgcaagttaagttagaagcagaagtgatgggccttgaatgttgggtagtgtgagcattattatacaagcaatagacaactaccaatgttttgaatcataggagaggccagtgcatgtttaaaaagaagcagtaattgaaaagaagagtgccctctttgcaagcaagaaatgagtcaggagaaaaatgtcctagtgagagatcagtaaagacacagtgaagaaggtggtagaaagagtgagaaggaagggctagaaatgatgtttcaaggtagaagcaacagatcatagacacaagtgaatgtagaatagtgagaacgacttagaaactactctacagtttttagcttgagttacttactaaatggtgatggttctattggctaaataggaaatatcagaggtggagaagatttgggatgggatgtaatggagatggacagtggggttaggggttcagtagttgaagattatataaatatatatatgcatacatatgtttatttaacatataaatgattaatgatgtgagttgatttactatattgatatacagttattaataaaatgagttaatatgtatgaacaagtaatatgatacattaatgatgtgagtgtgtgtgtgtgtgtgtgtgtatatatagtactatatatgcacattttttcagttaatataattggccctctttatccatgggttctgcatccacaaccaaatgcaggtcgaaaatacagcattcagggcaatgtgaaacctgcagatacagaaggctgacctttcatatctgtgggttctgcagggctgactgcaggacttgagtgtgcatagattttggtatccatgcgctgtcctggaaccaatacccaacagatactgagggatgactgtgtatataacaataatagtttgggtaatcatcagaggatttttttttaaatactctccactttgcacactagaaaaacacttggagcaaaaatcaaactgaatttaagtgggcttctttatagggagaaggaaaatcaaagaaggaaaggtagggaaatggaaagtaagtgatatagaaagcaaaggctgaggcaatttttgcaactcacttgagaaggagggcactgaattacggactgccccagaacaatcggaggatgctcgccccatctcttccccttgagtgtaggattcaggaagactgtctagttcattggcttaactgtatgtacatttacataaggaccaaggagctaaggaggatataagaaaacaagtgtgcctagctagcttatgcttcacagttttgtaaagaaactccagacactagccaggtatttataagcttagttagaaagtacttcgtagagttcttaacaacgaaatagctgccagccatcaagatgatacatgagaagagaacacttgtaaaaactaggacttgagacagtgccttaggacataagattaaaatgtctacattcactttccttgactacacacaaaaataaatagaaataatagtaaatgcatgagctggaaagaactaagagaagtgataggaattgcttagacaggttcataggatggaataacagtaagcagggaatattcagttcaaggagctaaatagttcctaatgttaacagcagcagccagctatggagcaatctttccttcttcccagtctaatggaaaatgccattgacaaaatcacttaaaatcaatggactgaaacacttaagagaagcaaaagggtgcaaaatattaattttgtcaggagaaagggctagaacagcattcctcatttctatttttggcatccattcagtaaactgaacagtttacacctgagtgcctagcttaaagaccacaaatgcagtttctaaacacagagttaagatcttggtgaatcaaagcttctacaaccagaattaattttttctcccttattcccttcaaatataaaggccataaaacataaatttgcaataagcagtttttttaagtattagaatcacaaaatacaaatagaacttttgttttcaggaattattctaataaaatagaaataaaacttacttttggagggagaaacttttattttcctgaatgatactgttttgttttctaattataaaagtagtgtacagaatgccagtagagatggtgctataagttcatgcttttacacatctgatcttttccaaaaacagagcaaagactgataaaacacagaggaaatcagaaagacatttagagattgaaaggaagagagaagaaaaggagagggaaagggaggagaagggaaaggagggaaaagatctctaaagtcacaagcctgaagacatgtaggcctgctgaactccaagtccagaaacaggctggcagtgatggtcggaatttcagctcctgctggggtgtgggaaacaggtgacccagcttcaccccaagaaactgaaccaagctgcctctagcttggtgtaatattactacatagcaggaaatctgagccaccagaataagtcttggtttttgattaggggtcaggaagctgggcaaactattagacaggtaggaaagagggcaagagagaaagaaagaaagcaatggcataagcaaacaaaaacactctcccatccaaatcagctgcaatcccaaattcaaaaacacataattaatacaaacaactaaatcaacaacctacataattggacaaaaaatactgaagaatctgttaagctaaaaatttgaacacacccataatcagagattgatagatgaagaatagaaaagtattaagaatatagatgacttggacaacatttcattcttgattaacggggtcttaggaaacgtcggctggacaagccgttaaaaaagaaaaaaaaaaaagattttcctcagctgggtgcggtggctcatgcttgtaatcccaacactttgggaggccaaagtggaaggattgcttgagcacagtggtttgagaccagcttgggcaactagtggaacctcatttccacaaaaattagctggatgtggtggtgtgcacctgaagtcctagctacttgagaggctgaggtgggaggatcacttgagcctgggacgtcaaggctgcagtgagctgtgatggtgccactgcactccagcgtaggtgacagagtgaaaccctgtctcaaacaaacaagcaaacaaacaaaaaggattttgctccctgagagaaaagagagggatgtgaaaagaagtttctctttcttctcctggacacagttatgtgtggacgtgctgcctagtgcactataaagggaaaagccagctggtgatggccaaccactgagacaaacagagggcaatggacagagcctgggtccctgatcacatcatctggctgctgcgtcatccccagaaccacctcctggagacttctagtcatgtaagttaataaatgttctcagtgtgaaagccacttgcccttgaatattctgttacctgcaggagtcacccaaattgatccataaattagatacatttcaatcaaaatctatacagagttttcatggaatttgctaagctgctattaaaattttatggaagaatgacaggtcaagaataagcaagccagttttaaaggggaacaacactgaggacttggcctatcagatatcaaaatgcattacaaaattacagaaattcagatagatactggtgcagaaataaacaaatagaccagcaggacaaaattgtgagctcagaaacagacccaggtatatatggaaactataattttgaagtgccactacaaagtggaggcaaaacagttctaagacaattggttatacacatactgctttataccccacacaaaaacattctagatggataaaaaagaccatgcataccaaatggatgtaaaaagatatacaataatgccattatagctaaaggtagataaagatttttataacaaaacccttaaagcaaaaatcaaaaaaggaggttaataaatttgacacattaaaattaaaatattccacaaatatacctgttgagagaggcaatccacaaaaccaagccatgcatgtcaggactttaaggccctagttcagttctcaggattgtatttgcagtgagcaaacctgggagatgaagtaacatctttccacagacaaacatcaggcttgataccactccacagaaaagggatatatttcccaagcacagtgttgtaatacgacctcttctgtaatatgacccagtgcatgtgcatgcccatacccacctgttgcacctgtggaacttggagaacatggggaaccagcaccattgttatggtttacaatataaggtttacatttgtatctacaagtatatgctccactgtttttagccttacttcgatatttaaatacattcaatactcaatacccatcttacttatcccaacttccccactcatcacctgcttggctagatttcaaactctcatacttttcaggaagggcttcttagaactacatttgctgtgctcttctttgtatatttgaaaatatctctctgcaacttgtgtaattgtctatgagtttggctttaaattttggatttaaaattatagggtcacattttctttccctgaggactttgtagatattgcccattgtcctccagcacaggagactgcaactaggtagtctaacatcagaatgaattttcctgcaatagatgctttgatttttttgtgtgtaaatgcccatatgcttttttcaacatctttgaagtctattaacaccaaatgtgtttcagtgctaagcagtcggtatcagttttgcctgaaatggtgtgttccttcagtctgtaaatccaagattgcctttatttcagtaaaatgtcctagtgttataattttgaatgttttttttttcctgttccatttgccatgttctctttagagttgcccagaatacttagtttggacctctgttattctgattccatttttatcattctccttttttaatgctttattattatccattttattttcaattttattatttgtgtgcctaaaagtattttagaagtattatttcttcttgtttttaatctagtattcctttctgtgcagctacatatttttcttctactttttttcaagttctaccaacccagtttcttatcttttatactgcttatcatttattccttaagcttttgtatctctttcttgaacaactttatttttcctgagagatcttattattttttatctcatttcatggaaaactttaagcatttttctggtgtgtgtttttcacttggcttttgttttcacatcccttcctacttctttttttggagtatctttgcatgagcccctgctagtggctctttgttgtgtgttagtgtttaaatgaataatggatggggagggtgaagtcaggggaatgatttagggtggctgcatttgaatttcagtttattgtctttgagtgtgttctcaccaacactgctctgagcagccatttcagcttctgcctggtgagaagtctcctgtgcttactgtaaagtccaatatgacatagatatttttgtgtaatgaattagccttcaaatatcttcatctggccaagataagcagctgcagggtgacttgccatttgtgttcctatttatcctgatacatcaacagccttgtttccaggatgacttgtctgcaactttccttgttccactcaccctggccacaccttctgccaatctatggcagcaaggaggactcaagaaacatccccgagcctgcccaggcacctgctcttactgtttcaagcaagtatacatgacttattttggtgaacattgtgctctacccaagatggctgaagggaagtaacctcactcagccttttattaaatacttcatcttatctaatttctactgaattaagtagccctcccaaccttatatggggtggaagtggagtgatgacttgtggcatggggttatgagaacttcttttgtggattatggagtctgcatgtcttgtcctgggtccagattggtctttaattgctaaaagataaatccatttagcaaatcctctctcctgacaccctgacttttaagtttgttctcttgctaagaggttgactacctgccctttccttccatgagatgataaactcatgactccttctggaagagaagatacaagaaaatatgactcaaaaggagaaaattcaaagctctgtcaatttaatagttgtgaaaatgtaatctcatttatgtacccatgttctgataaaaacagcttctttttatatatgttgtttctcccctttattattcacctaaaattatatcaaagacattgtttctatgaatatagtcatatatcattgttttaaaacactacatagaatttcattaaataaacttctattgatatttgaattatttacattttcactactataggaatgcagtaagtatccttatatactcattttggtctcatctccatccatttccttattctaaattttaagaggaggagttgctgggtgcaaaggttacccctttttcaagttaaaatatattttcagctattcgggaggctggggcaagagaattgcttgaacccgggaggcggaggttgcagtgagccgagatcatgccactgcactccaccctgggcctccagcctgggtgacagagcaagactccatctccaaatatattttaccaaacttatgaccataaaagttatcccaacttaagttcccatatcagtaatgagaaagtcaattttctaatgcccatactcacactggttattataattattttcaagctttaccaatctgatggctgaaaaaatcatagagctgtttgaaagtgcttattctcatcagaattgaatgattgttctaaagagcctttacctacctagtgaataaaacatattaaccagtatttttgcatttgattttttaacattgaatctttgattcttctgaagtttacattggcattacagaaataaggcaaaaagctgggtactcatttttcaatgttataagacggcaaaggattatctagaacagtggtctgtaaacccttgtctgctagtcaaatctgatctactacctatttttgtcaataaagttttattgcaacacagccatgctcattctttatatgtattgtctatgactgcttttgtgttataatgggccaagttgagtagctgcaatagagactgtgtgacttgcaaaccctaaaatatttactctctgggcatttacagaaaaaattgccaatttctgatctaagaaatgtacttagttccttcctctcactggttaatacagataaaagactccagatttagtgaaattacatgttaacttgtacctttctctggtagagatacaagtcattctctccaaaagaaaagataatcttgaagattatagtttatggcttagttttgtctttaaccagtattgtttttaaccttgaaattgtatcttaacattgcccataaacacctaacttttcaagtgctctttggactggttttaacgtcatattggctccctcatacattaatgagtttaaaaaatcttcaacttgcatttattttatatttatatgaatcataattttgccttttataaaattatatttttataggtatgaactagaaatccagcttcttacggtttttttccaaattgccagccatttgcttccaaaacattcatagaataatacatcattctccccatctatctaattgttatatatgtggattgaatacaagataactaattagagaatataatttgcatattgattatagatttaaaagttcacagatacagctatacaaaaaagtaacatattctttttctataactcaactaaatttatctgcttaagcctcaagtctgcttattggcagaagacaaaagagattactccagttaaactcagccacttcaggttttctcagtcatttcagatttagactcatttaatactgaaattttcaccaaggagacatgcacctttctgggtgcttggaggagacatggctggcctgcagtcacctgctcacccagactggcctctgttctgagataagaaggccttgctggccctcagcacagtcattcctaacactggatatgcataaatatccacagcccctccaggactaggtcacaaccctgtcccttcctcatcctgacagccaggcttcttcaggccccagccctcatctgttaatgtctgccaggaaatgggaaaagttgcatttgcctctcatgctcctttgggactctagaaaagctgtcaggctctcactgcctcttactgcctctgacattgtcacctcttttttcctgccatgatgcctgggggaagtttcaactccccccacctgctctccaatgcccaccaccaccactatacggagaattgagtctgggagcaaggttaggaagactgacaacctcacatttattattctcctctccacctctcctcccttagtccaggcaatccaagaatgggatagtctagggcttcatctattctcttttcattctactgttttgttcataattttaggttctgattcattcaagcctttaggaaaaagttttggttttccagaataaccctgctataaattttatattatttatttattcatctatttattgattgattgattttcggaggtgttgtttcactattttgcccaggctgtccttgaactcctgggctcaagcaatcctcctgcctcagcctcctgagtagctgggactgtaggtgcatgctactgtgcaaagccctgctataaattttaaaagcccgttttggaacctaaaaacccatttagctgttcctgtattatgagtaattcctcccctgaagtaacataccacatgcttactgtcaagttggggaggggtgtggacagggggacttcccttaaccccttgatatcaatctttttttcctgaaatttttgttttatgttatgtagataactattggttataacacatctaaaaatggaactagcactttgcataaggaaaagctctttggtgtttatcataaataccaggggcatcagaggtgatgaagactgtctaagaagcatcctgctagtgatatgttcattgataataataaggaaagaaaggtcataagtaatatggaaaaggtataattgtggatttgcttggtaatattgagatcttatatggattcccttattattataaaaatatacctattattgaaatatttccagtaaaaataactttgtcaagtttgaaaatcttctaatacagtagattagaagggtggtcattcttgctaatcttctaacttggactagtttttatggtgtggtctaactctttggcagatgaccaaaaatgtacagatgatggaagttgatattgaatgtgggggcagagataaacagtttcctgtttatcctggcttcttctcctgaatgtggtgggactgtttctagtatcctttctataatttctactgtacaacttgggtggtgcacagaactgtgacacctacaagcctaaaggtttgagaagcctttggtgagaagtgtattaaaggaatgcctagtgttggtaagttttctgctggggatgccacataaatagatacctttaccccaaacttctcccaccacctccacaggcagcagacttgccaaaaagtcttcactgcttctggaataatactgagcagattaatattttttttcacctggttcacttttaacctttagagttcatccgtatggtgttacaggagctcattctcactataaactaaaaataaaatcctactctaactgaacagaccccctcttggccaaggggacccaagaaaaaccttaaaaactgaattcctggccataaatggaaggaaagtcgaatagcctcctcattattcaccctccgttttggagttcatacacagctgagcagcattaatgttcaaatagagatcataagactcacgaaacagactctttgtggcaataatataccaaattataaacaagacctaacaccatgtaaggcaagggttaagtcattcctgcaggccaccaatcttgctacatagcatccttatcttaatttaaaacattcctttctgctgactctaagttctagatagagccttactcctttaatcaactgcaaattaaacaatctccaaacctacctgtaacctgtaagtccctgcttcaagatatcctgcccttcggaccaaaccaatatacaccttccatgtattgatttatgtctttgcctgtaactcctgcctccctaaaatgtataaaaccaaactgtgatccaactaccttgggaccacttattcaaggcttcttctgtttgtattttccctgggccactgtcactcatattggctcagaataagcctgtttacctatataacaaacttgcacatgtatacttgaacttaaaattaaaaaaaaaaaggagtgagtttcatatttcaagagatgcttttttggaggtgctctgagggacttgatgacagagaaaactttcaataataagtctacaaaatacacaaggtaacagaaacaattatccatttaaaaaatgctattctgggccgggtgctgtggctcacacctgcaatactagtactttgggaggccgaggtgggtggatcaactgaggtcaggagttcgagaccagcctggccaacatggcgaaactctgactctactaaaaataacaaaaattagctgggtatcgtggtgggtgcctgttatcccagcaactcaggagactgaggcaggagaattgcttgaacccaggaggtggaggtttcagtgagctgagatcgcgccattgcactccagcctgggggacagggcgagactccacctcaaaaaaaaaaaaaagctattctgcctttaaaaagaataacattttgtaatttcaaacaacatgaattagcttgaaggatgttaagtgaaataagccaggtacagaaagacaaatactggatgatctcacttatttctagaatttaaaaagttgaactcatagaagaaaaaagtagaatggtagttgccagaggctaaaagtaaaagtgagtagacagttgttggtcacagtgtacaagtttcgttagatagaaggactatgtttttgattatacatatacattacaaattatacattaataattatcccacaatatatacatgtatcaaaacatcacactgtataccagaaatacataaaattattatttatcaattaaaatttagaaaattagaatttaaaaaatcaaaaagccaaaacaaaacaaaaataaaatattttatggagtttggtttttccatcaatatcactttggagggggatgggtaagaaaagagaagaaatgatgaggagtggttcagaattttctgccccaacattagtcttagaatgttcagcagtgatagcaaagaggccttttgaactttcagtagaataccagccagcgctgttatcgtttgtaccatctactctatctagatggtgtattttgatcactcctcttcctactttataccatgaagatactgctgtttctactgctccctccagctctgccccaacattctatatcaacttccatcatctatatttttttggtcatttgccaaagagttagaccacaccataaaaattagtcgaagttagaagattagcaagaatgaccacgcttaactggtttaagttgtttttatatctgtttacaagtgagctagcaaacagtgagtttgcctgtgtccagattccagcctgcataccccagaccctcacccccagccacttgctcccacagggaccttggggtggttcaggttatcctggcagccaaagccccaacagttgccccttcctgcctttgtttaatgggggcttctctgtggccctgaaatctgccaggtattaatgagcacccctaccacttcccgttcctttaaggggctttagagtcaggcagtggaggtgactggcaagtcacacaaccttctgagccttatttcctcatctataaaattattataggatgatagtaacacctaccttataagataaggattaaaagaatgcaaatgtttcacaacgtttctggaaacactccataagtatggcctattggagtgtgtgtgtgtgtgcatgttctcccaaggttcagctgagatttatacaatcacaggatactttccaggctattgtttgtgtaaaccgcactgactgaaacagaaataaccccaatctctgctaaaatctggggaaacactcctaaacattttagacatatacagattttaaaagatactcaatattgtaagtcttacaatacttattaaatgtccaaaatttaccctaaggttcctattctttgaggaaaacaaacccaaaggcaaagggaataatcttttctaagtaaagtgtggcaaaataacattctgtcaggtattaaagcaaataattgctacacaattcccgatctttgaagcaagttctcagcaaaaatattaaattgctgccaagggtttagacatttaactttcaagaatttagattgatgatgattattatttcaatattgttgcttatctacccagcagatttccccctgaaagccaaagggcttaacaaaaccagaaagctggccacaaattgccacggtgaggcagccctaaggctctgaacgagatgtttccctatggagcagcaggaacccctgcagggaagtgaacagcagcccccttcacctggtaaggctactttgtgccagaattcgcaggttaacagcagctgtgaaagaacctggaagcctccacaggacaaatctgctgcagggaagggcccagcttcggttggccattccattctgctcgagtccagtttgtctgggctccaagagctaagggtactgaatctccactcatttgtttgcttcctccttgccttaagaagaccatggagcattctctggactgaaatccaccccccgaaatgctgagggccttacccttcataggtaaataaaatgtgagacagacacttgagtttatcttctaatggagctgtgtgaggttgggcaaatcactgaaccccttagttccttcatctgcaattacaaaggcctgggttagatctctaaagtccctgttagcttaaaagtctatgtttctaagttgactgcaaaaagagaatgaaatacacataaagaaaataaaaaacttgtttgatgaaaagttgccccatggttgaagagtcacgaagagtgaatcaagtcacaatttcacaagtttaattataaataaactcaactttattccattcacacagtcttcaactttaaaagataaaagataacttactggtgattcgatgtcctctaggagtaaaacagaacagcgttcacatttcagcagagtttgggcccgatgcattattttcttgacaattttctccaggtcagtctgttcttcaaagaggtcattaaccacctctagcaaagcctagaaaagatgaaatagatgtatataagtggatgtaaaactgaaaaaaagttgcttttcttcttaaaatttaatctttgcttcaataaaatatagtaaatctttttgtgtagctaattttaaaaaattttatgattgttttgacatatttttatctctcaattttagaacacatgcttaaactgcaaaatacaacttgagaatagagctagttcttgtaacaggtgtgaagataagtaattcaaaacctaagctattggaactctagattattttgagtcttaaaggatgctgattataggggtcacttgagaggcaggtgtaaccaaggcagctataacccttgtttctcttgactatagattagccttcttccttaccaaaattgtttggtaaaatgttgaaaattactaatgagcaccagagaataccccttccctcttcactgttgatcttcattacagattaacttccctcttactcttctcacacaaggactccatagccataacattgccttaagatggaatgttaaatatactcttttaaattggaaagaaaatgaaaaccagctatgaagaaaacaagctgtatagaaaagaaaacaaactgtaactaattatattgctataactcatacaccggccttgtatagaaaatgctgaaaccctattaaatttctttactttgtgcctgtagaagcaggagcttaacttttaactttggaacatttaccccatttctctggagtctgtatctcccgaattggccattcccagcttttcacttgaataaactctttaaaactagattctgattattaatatttcagtttgacacagggatcatataaccattagctacaggcatttccacttttctgtagtgatttttctgcaatgcaactaggtacaaacccaatattttggccgggcgcagtggctcatgcctataatcccagcactttgggaggccaaggaaggtggatcacaaagtcaggagtttgagaccagcctggctaatacggtgaaaccccgactctactaaaaatacaaaaaaaatttagccaggcatggtggcatgttcccgtagtcccagctactctggaggctgaggcagaattgcttgaacccagggagcagaggttgcagtgagctgagatcgcgccactgcactccagtctggacaacagagtgagactctttctaaaaaacaaacaaacaaacaataacaacaaaaaaacaaaaccaaaaaacattttataaataatgaatacctccaaagcacatggatttcagaaacttacaaagcagcttttcctcactatcaggaagaaacaggttcttggtcaaacttgagacattttcactaatacacatcccttacataactctgaaagaattagagaggtgaatgctaattaagtttcagattcttaaatatatatatatatatatgtaatttacatttagtctttgctaaatataaatacataaattacatatataatataaatatatataatatatacatacccttcatatatataaaatatatataccctccatatacaaaaatatacatatatacacacatacatatgtaccctccttaattcctctacccaagaggaaatactgctttatcccaaactgtccagaagaacatttagatatttatatatcaggaaagaaaacacattaatttttttttaaaacagcagaatgaaaagcagacaacttagaaaaaaatcttaagctctaacttgaaaactgtgtacttatttaaaaattaaattgtagtaacccgtggttttctctagctaagaaattagctgcaatttttttgcattgaaataatgtttgtttgctcaggtcaggtatggatttgtgaaaaataaaaaataaataataaataatatttgtttggaatttttaatggcatggatgtttccagagatttaagattagtaggttatgtacaggtggtagacattatgcttctctcagagagcaatcagaaaattacatagtcagtgaattgcccagagggcacttgattcaacagaatgtagaaagaggtgcaatctcaagtctgacctctcacaaaaggaattcatgaattgtcaaattcacatctattcatcatggtgctgatcatcatctcagggacatgactaattttcaacttcaataatgaatttgatttgtcctgaaattatttgaaatgtgacaatttcttctctgaatctattcaggtaaaaaagcatttgagtagctgggtgtggtggctcatgccaataatcccagcactttgggaggccaaggcaggcagatcacatgaggccatgagttctagagcagcctgggcaacatggtgaaaccctgtctctactaaaaatacaaaaaaattagccaggtgtggtagtgcatgcctgtagtcccagctactcaggaggctgaggcaggagaatcacttgaacctcggaggcggaagttgcagtgagctgagatcacgccactgcactacagcctggatgacagagtgagactccatctcaaaaaaaaagaaagaaaagaaaagaaaaaaacatgtgaatgagttaagaaatccatgaaatgagtccagttcaatgagcaattgaaagaggaccaaatatcctgggtagggttattgaaaccaccattgcaaaattataactgggctgacctaaccagctccatcttgcttctaatctccaaactgtccttgttcatttctgggcataggctgaactaactttgggaggaacacagtttatagtttattgtttaaaacaaagatgacaatagccctttcccaaacaaacctccttcttccctggggactagaatgccttcgaaggactaacaaattagccacaagatcagaaattatggcttaggagtcatacagctgactcttcctaaactgcttctcagatcagtgcttgagatattttgcagaccccgtacctgatggatcagctggcaccacccagatcgataaattggctcatctgatcttgtgaccccccccatccatgagctaactcagggcaagaggacagtttcaattccctatgatttcatctccaacccaaccaatcagcattccctactcactggccttcccccacccaccaaattatccttaaaaactctgatccagggagactgatttgagtaataataaaactccggtgtctggcacagctgaccctgtgtgaattactctttctcttttgcaattcccctgtcttgagaaatcagctttgtctaggcagcaggcaaagtgaacccactgggtggttacattatctctaaagaaagactgaacagagctaaggaccatattgctccatgatcccaaagcaaacaggaacatcaaaaggtgaaaaaacttttaagtgaatcttgatatttggcatttggacagcaaatctctgtaaggggtcaatgaacaataatttcatgtttagacattaaaaatgagacaattgtctcagtaattacaagcaaaaagccctgttattaatggggaaaacattatttctttaatcatctagactatttcttcagatggatcatattaactgaacaattatttaacttttcaatttgttgtgattgcatggagagagcctctgggatccatatacaagaatatttatctcagaggaaaaattaattgtgccttgagtcttgcactgacaaatcacattacagtaattttattgtttctaatttaaaattgctttattaatgagtgatggaagttttacaaataacaatgcagactagctccaggataggagaaaaagagaagaaaatctaggataatatctgttaggcctctgagcccaagctaagccatgatatcccctgtgacttgcaagtatacatccagatggtctgaagcaactgaagatccacaaaagaagtgaaaatagccttaactgatgacattccaccattgtgatttgttcctgccccaccctaactgatacgatatattctcccccgcccttaagaaggtactttgtaatattctcccccgcccttaagaatgtactttgtatgcctatcccaaacctataagaaacaatgataatcccaccaccctttgctgactcctttttcagactcagcctgcctgcacccaggtgaaataaacagccttgttgctcacacaaagcctgttggtagactctcttcacacggatgtgtgtgacaatatccaattcaacagataatggaagtattttacacagttgaataggccctgcttcttgatgtcacttgccttccaggaaatgagtatctgcattttgtccctccttctagtgaccttcttttgctcctggatgtgtccttggagctttccattctcttatctacatattcttccctaaattaacccagctagattcctggctttaaatagcctttatatgctgctggttcccaaatcttaatctccagtcctgacatcttcccagagctttagactcctgtatccaactgtttacttgccagctgtgccagccaagagtctctttcactcatttcccatatcagcaagcccccacagatttcaccactgattttggaggaaatctgtcacttctcactgccctagtcccagccatattattttttgacttcaatacagttctttcctaagtcctctcactgctccagccttctccctccctccccagccagtttattatctccagggaggccagagtgaactctattaaaagtaagtcagactcagctcaaaatcatctaatggctttccattgcactcagaatgaaagccaaagcccttgccatgcccacaggcttttctaccatctggcctgcctccacgtcctcattttattttttttccctttcactcttcccctttctctctgctctctaaacacactgaccaagctttctcctgccccaggtcctttgtgtttggtattccatggccagaaatgctctccgcagacctttatgtggctttgctccttcttttcattcaagtttctgcttatagatcatgtccttatacagacctttttgataaccctctaaaataaacatcctcccaactcagccttcctcaaccctttatccctttatctcactttatttttccttgcagtatttattgctacctatactatgcaatttaaaaaaattgttttcttatctaatatgtattgttctcatgaatagtaagctccgtaagggtagggatttggatagacagcatgtgaagggaactacataatcaatacttgttgaatgaataaattaattgtgccatacacaagaatgcaaagattaatcatatatgaagcttcacttaaggagttcaaaatgtagttggagaggcgggccctcctcaaatatcataatacagtgtgataagtattcataatagaatagtggcagtagatacaaggcaaaaccataagtgaagaagggaagattaatcagaaagctgagctgggtcctgaagaatgtgtgaggcacatgatgtggttggaaggagttggattgacatgaggcattgaaggccgagggaggaatacggctaaaggtatgatcaaatgaaacagattgtttgctggaaattggggactatattgctggagttccagatgaaagcaggagcacggtaagacatggggctaaagatgaaaagaagatcaaaacagagaaaagatgtggtatgtcatgctaaagaccatggctatattagtcaactatgttcatctgtttactgataaaaatatccataaatcataataattagcaaatgaaattttaatcaacttgatggccagattaattagggtttcaaacctttttgaacatcgttttgttaaatatatttctaagttgttacagtaatcttcctatatttaaaattagaatgagtataatataatttaatctctatttgataatgtagcattttttgagtactagactttgccttttttgcaacttagatctatagctcctgaaggtataaaagagctctctaagtgtttctttataatactgtaaaacagtctttgcattattgttccaagtatctagtgaagggcactttcagaaaccctttcaatccaaaaatggtttcaatccaaaaattgtttcaattcaaaaataaaatctgggaagtgggggtaagatcatgtttgtaacataacttgcttcttaaaggaacttagttgtaaaagcatcaccaaattgtgttattgcttcaaagccataagtaagcaaggatatatctgctgccttatagtatagatgtgatattaatctcctttttttttttttttttgagatggagtctagtctgtcacctaggctggagtgcagtggtgcgatctccactcactgtgacctccgcctcctgggttcaagcaattctcctgcctcagcctcccgagtagctgggactacaggcaccaccaccacgcccggctaatttttgtatttttagtagcgacaaggtttcaccatgttggccaggctggtcttgaactcctgacctcaggtgattcactcaccttggcctcccaaagtgctaggattacaggcttaagccatcgtgcccagccaatttcatttttaaaagaagcttgtaccccttcccccaaataacaacagataatgtgtatccacttccatttgggcttattgcttaaagtgtatcttcaaccacagccttgcagaattatacaaataaaaaagattcctgtactattcaaagatcattcattggctgtttttaaaagacataatgacttacagaaaccagaaagagagttttgaggagtgtcaacaatgtttttatttactcactctgcttctttcatattctttccttgaggcagcaaagagctgagcgttagatatggcgattccacaaaatggaagatacatctgcataacctgggacaaagagagtagtaagaacattaaaacataagaacattgatacatcccttgtagactaaattgcacacttcttctatatgcctgattgtaatactttatttgcatctatagagattgaatacagagagttgttgatactagtattttaacttcattatgaatatttttcaaagttaactaaaatatgttgtaaatcaagctttaactagagaattcacatctatgaagacataaagtgaagcaacagattatgagggctgtgacataggaactgtgtctaaagcagcttgtattatttcttggataaaagaaggataaataagtaaatgaactgtgatatacctggaatttaaggcatgtgcccatactcacatttggaggtaggcaggatataagtcaattctttcgttggcatatggcatataccatatgtatatggcatacaattcacatctgtagcagggatttcagcttgattctagacctatctgctaccagttttaaacatgcctgtcaggatgggcccagtgggaactaggggtcagcaggcctggcagccttctgcgacagagttctaattgtgtctgccactgtgtagacataactggacacaaatcatactggtgggatgcttctgcagaagcctgatgaggaaaggctgggagcctgtaatggagaagtcctcctatgggcagaaacacccagccgtgatgggcctacccctaacaaagactttctcatcatggaggtttaggcatagggatttttactactgccttgcactctcaagaaattcatctccagaatctctgattccagagagatagaatgctccaagtaaaaactgaaagaactatttccctaaattcttcgcaatgtagatgaaacaagtgacatacttgggacttctctaaagcaagagggaaaaaagcatgtttatatcatagactctatgtctctctgtctctctctcacacacacacacacgcacgcacgcacgcacgcacgcacacaatggtgccctaggaagaggtaacaagcgctggcaaaatagagcaattcctgctgtaaccagcagagggcagtgcagtgcccgctgtgggtgagggacgacagcagcctccaccaactcaggaagcacttgtgaagcacccaggacatccagaaaagaatcacctggagtgcaaggcaattatgcagaggacttgaggtacacaaaagatgaagggcaattcacattccctatcgctgaatttcctattaaaatctttccttggttacctgggcatgatcaactctgacctagggtcctggaaagaatttcagagccatataaaaactaaagctatgacctcatttttaaagaagatagagaaacaatgggatccgaattaagaagacatacaaaaatcaatgatttttgcagatgttttggggataaattccttccctggattttcacatgttgccttctggaactagatgttatttctgttaccccctactctcccctttcttgctactccccctcataccttagaaagtctgtccataagccaagataaagctgttggcataaagctgccagatattccattagaatttccctgcctttaggcagaatgggaccactttcaatatcacctacacatagagcaagcactttccttgtagttttctggaggttttgtttttggctcattgtttttttctgccatggagacaatgactataacggggataaaagcaaggaggagacttattttaactttccactacttatttgttttatttatttttgccttcaggggacaaatttaaggtggttggtaagtcaagcaagtaagaggagagtgatcaaatgaagatgtgaaatgttttctaatatatcataggcttgcttcacttcatttgtaattccaatatttactgagttccaggtattatgttaaattaaaaagaatctgaattttaaatcaaataatctttgttctttttacagttttgctgtgtgaagtgcaacaaatcatataagctcttgaacctattttcttatctgtaaatgccaggtttatggtcttttttagttctaatctttggtgattcaaataatgcaaaacatcattaagctgcaatattctatttactagagaaaacagaattcagtaaacatgcttgcaccttattcaagaaaaaataatttataatagtaattgccattggctaagcccttctgtcattgtgtcaggcatgatgctatgtgtcagggatgatgttaagcattgtatatgcattacatctgttttatattcacttatgttttaccattaatcccagtttgcagattagaaaactgaggctttaagaacttacccaaagttcttgggagataattctctatggatattttatgtttctgtacacgtggcagagagaggcactggctgtatctttctggaatgcttatacaatgaacagccttggaagatagagatactgtctcctttcagagcaaagaacagaagtgtttactatccagtataataaagacaatatctccctctagacagaggtcaggcaggctcaccgttcattataaaagatttgggttgcttacatttcaggttcctctgctgtcatgcaatctactatatgtgctattactggggtcagggaaccagcaaaaatgctgatgctcaaactattgctattgttgtgagtaataaactgtttttttgtcactgatccaggagtctcatgtcttctgtcagcatccatgagactgtggcagactaacttgctagcctgcatgtactgtatagtaaaatcagactctttacaaatcttaacaatgtcacctagatagcaaatggagaagcttaatttagaatccaagtggcctaaccctaagatctaccttcttaacttctacattctccagcttcccaaagtcatacatatctttcatacaattaatatgatagtctggttaactgcaatgcaagatagatgactaagactagcactccattattccagtgtatgagcagtcacaggagactgcagaagcaggaagcagttctggtagagcaggcaaaacccagtttccggagataacaaggcaaccattctcagggggcaatttgtctagcagatggtgtaagggaaatcctaggtagagagcagaccacactgataggcatcagagtgtggttatgaaggccagagtagaaagttggggcagaaaagaaactgagcctgtcagcaggtagcagggccctcgcctccaggtggagctttaaggatcagcttatactcttggtagtgaaagggagggaaatggcagaagaaaggaaggggcccatcaggtatgaaatgtgaggcactatgttttaatgagacacagaactgctcacagataggggctgtggcaaagctgggcccacaggtgagggtcctgtggtgtgcgtccagctatagcgtggaaaatgaatcagggaccaggaaccaggctgtgttccacacatggctagagaggttccagtcttagcccagtgggaacactgcagtgtccccggaagcctaggaacagcccaacatcaaactgtcagtcaatcacaaatctcttcatcctcatccaatcttgtttctgttaaacctagtttttaatctaaaaatttagaatttgcaaatactttttccaagtagtataagctattcttcatgaatagtacaatgtactatcaagaaagcatgcaaatcagatcggtattagttcttttcatctaccccactgtgtccgacaaagcacccctcaatttagtcctgacagatgaatggtatttacttgtcacaacctcaggaaaagcaacaccacaatcttcctccattttacacatctagcaaatgtcactttcatgaaattttctcatacaaatgtaacaaactccttatatcacaatatacttccaattcttatcctttagtggagatgaaaaacaacaaaaactctgccattttaagccaattacaaggcatttaacatggcattttgaatggcaaaagagactcctgctgtcttgttttgtgtactccaatttttcaagttaatgctcctataacagcatccaaacaaaagcaaatggcaaaatgaacacccaactcactgtactgggaatgcacagatcagctcaatttaacaagagccgcccgactgccttctcccgtcaggccctgggttaatatgcagcccgtacactaaattgcatgacaccattactattttcaagtttaccactagtttcagctacatccctgagaggattactagccagctcaaattccttcaatattttcacaaaaatacaggctaaagttcaaatttcaactccctgttaaggccttccaaatgttggccctattggacattactactattgttattattaatgtttgtttagatttacccacatgtgtaccagttttttcctcctcattccttccaacacctccttccttctttctgtgatatagttttattttttttccaaagacaatcctttagagtatcttttagcattggtgataaatgcttttagttttgtatgaatatgtttattttataatcaatcttaaaaggtaaggtagttgggtatgcaatcctaggcttacacttattttctctcagtacttaaaacatattattcccttatcaagtgcaactgatgctgctaaaaagccagctgccaatcaaaatcttggtagattatctgcctttgtctccggtttcttttaggtcttctttatgtcattggtagccaatttgtattttgtcagcctcaatcaaaggcttaattgaatcatggtaacctccaatgtatatattggccaaacattactgtggatggagacaatattataccttcatgactcattgcacactgagagagaatctttgttaatgtaggaaatgttctaccctgtgtcattcattggcatgacaattcagccctctggggtcagactcaattgcacaatgtatacgcatatgacagtatgatctatggagtttctaaagaaatgtgcaggagaagcaggcaaatacatttttgaaaagaggcagtaagaaaaactgaagcagtgtagaaatagaaaatgaaaaacaaaatattttaatcttttttttcagtcccagtgttacagatgtctctctctctctgtctctctctctctctctatatatatatatatatacacacacacacatatatatattgctctattctgctattctgctctttctgaagtccctcatttccaaaaaaaccaactaatttggccttcactatgtagtttcagaatgccaaaggtctaaaaagccttaatgactaagaagcaaatgagtctgtacacgcttgtgcagcacttttcggcttgaaagcactttatgaacattggctaattaatctttacaacatcccactcagaaagagagttaaactgaaaatcattaaacagtgtaaaaaagtcactttagccctggaaactcattaaactatcactaatatgcatagaatttgagcactgggccttctatcaatgtacacaaaaaaagacagtaggtagccagccttttcaaacttgcaagccacagagaaaggctattaaagccccattgtgtggtctggtccaattatacatcattgaagaatgccgggggtctacactggagaatcttagtgaagggggccatcccgttcgtggaccctacttgtagaaggcaaaacagcttgaagagccacatcactgtcagctaaatgaacaggtgaaaaaaaggttttcccacctacagataacacctcctccctttgtgtagattctgaaaacaggactcttaaagtcacttctgccctcaggcagtaactatatgataaagcttcactgatttggagcccactgatttggaactggggatgttttaagacagttgtgattcaaatgctgaataaactcttcaagtagagtaatttagaaaataacatatcaaaatatgaaagcagtcacattattttcatacgatgaaatactttcagagcatttttaggaatataatattaaaaataatttttaaatgagtttgcagttttccagagattccagaggaaagccctgcttccagaggtatagcttcattcactgcaattttgtttctacacaaattcaataaagatgaaagatggagcttttattttaagaatcagaatcataaatgacttttgttagttcataccaaaatatatgaccttggctaaggcatgcctttttccaccagtgttccgcccttttcaaagaaaacagtctccaaaagatacaaataaatataaaacattgttttaaaaattgtaatggggccaggcgcggtggcttatgcctgtaatcctagcactttgggaggccgaggcaggtggatcacttaaggtcaggagttccagactagcctgaccaacatggtgaaaccccgtctctaccaaaaatacaaaaattagctggccgtggtggtgtgcacctgtagtcccagctactcaggaggctgaggtaggagaatcacttgaagctgggaggtagaggttgcactgagctgagattgtgccactgcactccagcctgggtgaaagagtgagactccatctccaaaaaaaaaaaaaattgtaatggaatagatgattcaattacatgtcttttgaaattgtccactatgagaattgacattctgaagaatagggtgggggacttcattcacaaaagacaagggagaacaagagggcaaataaaaaagaaggagaagctttgttttttggagacagaaacaaggacaagataatggatcagagatgtggggagggaagcaaggaaagcaaacccaaggtgggctcctcactggtccaaatttggggcagaacacatcctaaagcgtgaatctttacaggctccccttctcctgtctaggcgtcctcatcactcttcttccatgttcccttcttaggacagggaaattgaggtgcttctacttctgtccctgagtattaaagctgggaccccagggaggttggaatgagctcccttccactactctagcccctctcctacaagctagtgttggctaaaatatccccaggaggctatccaggggcagagatgctgaattcagttcctggcaagtagcctagtagcatcaacatctattctctttgactttttagaagctctggtctactgagtgcttgaatcatgcaggtactactcatatcactcaataaccttatttctatttggtcctatgtccacccccacaactttagggaaataaccttctcatgtctgggggcagtttttaattcccaccctcttatttccagaccctcagggaaaaccctgaaggaatctattgcaggacccatgtcctttctaaaataatttttttttctgatcatagatttcaagagaaaaaaaatacccatatttctgccactcaagggtaaccattattaacattttggaatatattcaagttttcttctctctttttcctttcacataaagccaaataggctaatcctatacataatattttatcagcttttttcactttttataactagctattacctattatgaccagtttctatggatgcaaaatatcccattgtatggtgcagaaacataaaatttatagagaaggaaagtagattagtggttgcctgggttagcagcagtaacaggatttgctgtaaatgggcataggggatcttattggtagtgggttctaaaacggatttatggtgatggttgtacctctcataatgttactaaaagtcattgaattgctcacttgaaatgtgtgaattttatgatatataaaatatacctcaagaaagttttaaaaattaccataaatactctgttcatggtatggattaatgtagtttacttagtcaatcatagaacgttggacatttaggttgcttccaattttagattaataattctggggttaaacatcctagaaattaaatctctccgaatcccattattattttcttagagtaaagcgttgatattggaacttactttattcaacacacaacttatatagcgcttttctgtaccgggcaatattctaaatgctttactaatattaattaattgagggttgtgtaccctttaaaataatccttaacaatataaacacatttactttttgctaaaagaaaacagtagagaaatgcatagagtaaagtaatgacagttcccccttaatttcctgtcccactacccactcccttctcaaggtacaaccctgctagcatttgtagtgtgttcttctggatgttttatggctacagtcacacaatatctagttttagggttgtttgtaaacataagtgggatcacactatgttattttcgataccttctttttcacttggcaatatatcttggaaatctttacatgttaattcaaagagaacttacttcattcatcttaatgtctgcagaatattctagggggtggttgtatctgttactagacattgccattgtttctaatttttctttattacaaataatgctgctgtcaactttcttacaaataaatcttcatgcacctggacaatacttctgtttgacagtttcctaaaagtggaattttaaggttgaagaacatatgctcaaaaaatcttaattactactgccaaatcatcctccaaaaaggctctaccaatttatactcccactaacagtaatcagaggattcatttaccccaactcatacaacactgggtattaccattcttttaaaatcttgtctatccgacagataaaatcagtactcatttttgtattaactgacatttacttgattaatagattgaacacttttcataatttgttggttgtctgtattttaaaatatggcctcttttgcttattttgtttattttttagtggacattcatctattacttattgctcagtaagtaccctttatgtgctaagaatattaaacattttccattttcacaattcatgaatcttacttgataatcaaacagtaattgtcatctgtttgatataatccattaggcctacaagctatgagcgctttgtctaagatgaataatattatggctccataaacttggcctactctctctcacagtgtgaagatcttttacaaagatatctgcctatataactctgccaaggttatttttataagcaggttgacctacatatatcatcctgcccatttattccatctgcctttgtaactcacagcttctgcaaaaagttgttttgagctgctgtttgatccaagcattcttgagttttagttattaagatcattatgattccccacttacccagcacaggtataaatgcaggaagctacacaatagagtaacttagtcaaggtgtcaaggtatcaacaccctgaaatgctagaaaaatcttattatatcacaatgaacatacgaacataaaatttcctcttacactattttctgatgagaaatgcctaagtttttctttaaatttgaaatacattcacattatttcctcctattagtagcagaaggcttttcttcactgtctcgtttatcaaactccttcctttttataattcctggttcataaagtacaggacattacataaaggcagaatcatatagcatgtggccttttgtgtctggctgctttcactttgcatgctgttttaagggtccatttatattgaagatatatcagtactttattccttttaaaattttgttttaaagaagtagattttttttagggcagttttaggtttacagaaaagttaagtggaaagtacaaggatttcccatagaccctgcccaacacacagtttcccctattattaacatcttacattagagtggtacatttgttacaactgatgagtcaataccgacacattattaactaaagtctagtctacaaagtctacaataggttcactctttgtgtcacacattattcggattttgacaaatgtacatgttcaccattacagtatcatacagaatagtttattgccctaaaaattccctgtgcttcacctgctaatccctccctccttctccctcagtctctggcaaccactgatctttttattgactctgtagctttgccttttccagaatgtcacatagttggaaccacgcagtatatatccttttcagattggcttcttttacttagcaatatccatttaaggtacctctacataatttcatggcttaatagttcatttctttttatcactgattaacattccattaactggatatacccatgtttgtttatccattcacctattgaagagcatctcaattgctcccaagatttgacaattatgaaaaaagctgctataaacattcatgtgccagtttttgtgtagacataattttttgactcatttggataaatatccaggaatgcaattgctggattgcatggtaagcgtatcgttagctttgcaagaaactgctaagctgtcttccaaagtggctgtgccatcttgcattcccaccctttcctatgtctgggttctccctgtcccttcaaaggaggagtgtttcccttcatttggtattgcttccaccttcactgtgtaatctacatctgcttcgcttcatgtcctcactccctgtcattttgcttacagttttgcagtcttcagaaatggctggcttgtggcctgtctatgacatcccaattacccgaacatgaaatacacctataatacattcttattttctgcagcctttaacacttgatcaccagctagatatgaaactttggcttccatggactatacacccctatttaatctttttctacgtttctgacactcatgttcaagttatattcccgggttcagtctttggtcttctaactgtccctttctacattctccctctaagcatttatttatttctacaatataagaatattacaaaataaagtgggttggctatgcaggaattaacctttgagcaagagtcagaaaagacaacaaattcagtactgccatatatttaaggcagctgagaagtcttcctccttctgctcttgaactttggtctgtcacgaattccctctgcctctgatttcactttcctacatccctaaccccacttctaatcagccacatctgctacctttcagacccacgtttcagtctctaatccagacacagcttgagctctgaaaacatttgcttcctctatcttatagtctaattttagtattcctggtcctagactgaactgaactctgaattcaaccatagtgaccgaacaggcaccaaagtcccttccttctatctgtgtcttctgtagttacctctggaacgattctcaaagtgggctctctagtgctgacattttctctgtgctctggcttcacatcaccaggtgcctagaggacatttcaacttgaaggttctttttattttattttattttattattattttaattatttgtttatttatgagatggagtcttgctctgtcgccagggctggagtgcagtggcacaatctcagctcactgcaagctccgcctcccgggtccaccgccattctcctggctcagcctcccgagtagctgggactacaggtgtctgccaccacgcccggctaattttttttttttttttttttttgtatttttagtagagatggggtttcaccgtattagccaggatggtcttgatctcctgacttcgtgatccacccgcctcagcctcccaaagtgctgggattacaggcgtgagccaccatgcccggccaacttgaaggttcttatactaccacaaactcagcattctgaaaccaagtttatcatctcaattccccttgtccttccaaagaaagagggcttccgcctccaaaaccaccctatatgtgccaaaaaaaaaattaaagttcaaatcacccaattccaaatcctgggagccatcattgattgctatccagatgtaggcataagcaattcaggagcttttgaaacttctgttcccatggccttgatttcccctgctccagcactgccatcactcaccatctctggtaatagttcccagatctctcaccattgctgcaacagtagccaagatcctttcatccttgcaatgtgacaagaacccagtaacctttgtttcccatccaggaaagctataaatttaaacacactgactatccatcccaatgtgctccattgtcttaactttttaaaatgtaaggtataaatatgtcttacacatattaaatactagtctttttcaaactacatttgcgtgagcattttcataccacatacagtatttttaaaaatctcattagaagctcatcagaaagtatctccaatatttaagactgtggcttagcattttacagacactgtggaagatatgtaataatctcaggaaaaataataaggaaatataaaattgctatttagagaaacacatgagacccagaggggattattctacttatatatcttttttttaatttccaaaataattcatcatccaaatgcaacactaatgacatggataataaaccatactattttttaatttccagtaatattctccagtggagtttaaaacagagaaggctatgaaaatatgcttagagcattaatatttaattaatgtaatagtaccctaaaatgaatattataagtgtaaaagccttgatataattcgtaagttgtatctatgcaactaaaacacaaaagtggtacctagtaaattcagggcattcttaatggatagccttgaagacaaaaagagctttaaagtttggcctaacaacaaacaaaactttgtgaagggccaatcatttattaacaaactggggtatcaatccaaaatagcagaggggaaactgtctacatgagtcatcagtaattcagcaagatttctcatttggtatcctagaacagtctaacttacaaactaagatgctagcttcaaagccaaaatactttattgcccctattcacagtttctactttccacccatattcagtctatctgcaacagagtctcagcctgtcctttattgcttcctttctcttcatggttcagctatttattttgagggctcaattacatacaaagtaagcagaaagaataaatgataagcctaaagacagcagaaggaaagaattaattaaaataaaagcagaaaatagtaaatgagaaaacaaccattagaattgataaataaatccagaaatagctcatgtagggaaaagcaataaggcaaataaatcactagctagtttaatcataggggaaaaaccccgaaaatatactaaaacagaagtgatcaaggaaatagagtcacagctacagaagaaaatgaaaagaactataatagacattttttgccataatctcaaacttaaatatttgcaaatctgatgtaaacttgtatattttaagcaaaatataaattaacaaaactgaatcaagttcttcaagaagacctgagaatttctgagtaaaatagtcaccacagaaataataaagaaacttgtaaaagactcattctcagaaaaggggctagtccaaatggcttcataggcaaattctttcaaatcttcaagaacaagaaaattcctatgctattcaaacaattccagaatccagagaaggagactctcaaatattttttgaagacacattatttattactgatagcacatcatgataaaaataatgcaaaaatcaaacctacagaatagatcccttatgaaaacagataagaaacattctaaataaaaatattagaagatttaacatttttttttttttgagacagagtctcgctttgttgcccaggctggagtgcagtggcatgatcatggctcactgcaacctccgcctcccgggttcaagcgattcttctgcctcagcctcttgagtagctgggactataggcgcgcaccaccatgcctggctaattttttgtatttttaacagaggtggggtttcaccatattgaccaggctggtcttgaatttttgacctcgtgatccgcccacctcggcctcccaaagtgttgggattacatatgtgagccactgcgcctggccagaagatttgatatctatacatacctgtatattagaaagttgaatttagccaaatattgaaaaatggaacatgactaagaatttatatttagaataaactgattgttcaatgtttcaagatcaattattccaaactttcatattaacttttaaagcaaaaaaatgatcatcttaatattctaagaggtcatttgataaaatccaatacccaatggctataaaatttttaataagttataatgggtattaaagattttttaatggaaaaacgtgccatatttctcaataaaaagatattgaatcaatattaaaaagatatcaattacctgtccaaattaatctataaattttattctagtgaaacttagaatgatatttttggaatttaaaaaaaaaggtaattctaaaattcaaatgaagtgaaaaatgtttaacaatagtcaatattaaatgaaacgagaaataagaggaaccaattgtaaggttatgatgaccaaaacagaatagtactaaggacagaataatcatgcaacttaaaggaacagaagtccagaacaaaatacataaaataagctcatatgtaagaaaaggatggtttcatcaataaatcgtgttgggacatagttcatcatttggaaaaaagcctaaaaattagaaaatcctttttgaaaaagcccagggaaattaaagatagaataaaaatatataactataaaagccataggggaaatatggtaaacatttacatagttcttcattgtgaaaggcctttccaaccataccctatatgtggaaattatatgagagacttcacactcatttaaaattgaaaacatctatatctcaatatgtaaaataaattaaaaagcaaaacacactgggaaaattatttgcaatgtttatgataattatgaacctctaagtaggaaaaaatcagaaaaaaaaatacctcaaaaatggtcaaaagatataaacaggaagtttgccaaaaagaaacacaaatagctaaaagaagaacaaaaagtgttcaggacactaattatcaaagaaatataaattaaaataacaatgagctatcagatttctcctactatattgacaaatattatcattaaaattaatacccagggccaataataatatgggaaaacaagcattctcatataattattgagggagattcattggtgcaacaattctgaagaacagttttgcaaaatatataaaatgcctttaaaaagtacaggccctttgtctttacaattctattcttagaaatttatttattatttattatcaccattagtactatttattatacttaaaaatagtgaagatggtaaattatataagtatattttgcttcaattaaaaaattgttttgggccaggcgcggtcgctcatgcctgtaatcccagaactttgggaggccaagacaggcgaagcacgaggtcaggagatccagaccatcctggctaacacagtgaaaccctgtctctactaaaaatacaaaaaattagccgggcgtggtggtgggcgcctgtagtcccagctacttgggaggctgaggcaggagaatggtgtgaacccgggaggcagagcttgcagtgagccaagatcgtgccactgcactccagcctgggcgacagagcgagactccatctcaaaaaaaaaaaaaaattgtttcaaaaataactttttttttttttttagtattaggaaagaaatcataatgtacaaggttttttttaaattgacaatatcccaaacatcgcaagatccagaaacgtagcatatttgtattaatttttccaaatttttgacagcatgcttttttattgcctctgcatgtaactataaattttaatattattttcctatagatatacagaaaataattccattttcattagcatattgatacaaatgagctttatattatttatgatgggatgcataatacatacaactttacccagagacacatttcctatttgcactactagtactggtttgtgtcctacaaatgcaggaattccaataaataatattttgcataattctcatctaaaagcaaaaaaaaaaaaagaaaaaaaacatgtttatcatggcatatgctgcatttttgagtatgctcctgataggagagcataaaacttctatttgaataggcatctatgaaaaaccacattttacgagtctgattggaagattttttttccatagactagtttctgacttcgtacatttcaaaccttgtttctccttcactatacatattcttccagacccacatactatagaccaccttcatatcaaaatgcaaccactgaccttgtatatctgcatcaagatgttgagtgaactgggatggtgagcaaaagaatattcagaaaagccgttcctacagcataaagctagcaacaactttccacaaaagggattgggaaccataaaaattatcctactaaactcaaaagtatctacagctggacttcttccctagctacatcccaagaatgtctgtggcctgatgaatggggaaatctgacagacaggaagctggaagggaaaaagaattatctcaaatgaatatcattaaaatatcttacttttgttaactttacaaaactttcctccttctcacgttcctttgcagaatgacttttttcccatctgacttactttttagcattcctcgaggcttgattctgagacttcctatctcactctcctctctttctaaaaaatcttatctacaacactggattaaattgacctctgcatgcatgactctcaagtttatatttctaacccaggttacccccttgagcccaagatctgtgtgtatccaacagcttactcaatattttcacttagatgtctcaaaagcacctcaaatactttatgtccaagacagaactcataattaaacaccctcttgacgagttaatgggtgcagcacaccaacatggcacatgtatacatatgtaacaaacctgcacattgtgtacaggtaccctaaaacttaaagtataataataataaaattaaaaaaagaatatataacaacaacaaaaaataataataataattaaacaccctcaaccacttatttctcttccaagaggagtatatcttagtgaaggcaccatcttgccacaaagggctgaacccaaaaacctggagccatgtcccatacctgacatcactgagtccggctaattttacctgttagttatgtctcaacattgtctgcttcctttaatcatcacttcccactccctcacccccactccaatccaagctacctttctggctgttccatggcttcctattgcttacagggcctacactcaaagcccttcataatctattcccaacacacagtggacttttcttgactcatcttccagcactcttctccctctacatttcttgtattccagtcacaatagattatccatgcccatgtacaactaagttgtatacctctgtctttgttcatcataattccctcattctagaaccttcttgcctactttgtgcatctgtcagactctacttattttacaaggaccagttcaaatatctcaataaaatctttctggacttttcgatttgctctaccattgtctctctgcattctcctcattccaccaaagaaatggcactttatatgcttttatagctctaatgcttttatagctctttgtacatacctctaatgcagtacttttatattaaatatttttaatttattaatttattatttattttcatttaatttttttaaaaaatacagggtcttgctctgctgccaaggctggagtgcagtggcacagtcacagttcatggcagacttgaggtgagaggatcacttgagcctaggagtttcaggttgcaatgggctatgattgtgccactgcactttagcctggatgaaagagcgaggctctgtctctcccccagcaaaaaaaaaaaggagaaagaaaagaaaagaaagtaagtacaggggtagggctagcttcagtaagtgatgaataagaccttgaatgaggtcattaaaattctgacccatcctccttttatctcagctgtccctcactctcattgacctaaattgggtcacgtggtcattgttgacccaatctctgaggccaaagaaaaccaatcctctagtagacttagccagaacttagccatatgcccatgattgagctttgagtagagctttgggctaagaggtggggacaagatagttctccagaggaaaatcaaatcctcctatcaagatgctgaatgtccaagataataaatgtacacaaatataaagttatttgagaaagttataattaaccttcatttcaggcagaattctcagtgttacctcacttatttagatttcataaaatttgaaatctacttctaaaaatattccggaattcttaagaatgttaggctgatgtttctgaacatccagcgcaatacctagcacagagtggtggctcaagcaatatgtgttaaataaataaaagaatcaattaataaataacacagtctgtaagaggtctaagataatgtataaaaatgtcatatataaagacatatattcaccaggtcaagaaacccagatatctgctttactctaaagtgtaatttattatttaatgagtaagcaagtcggacacagcttgtgttggcttaaagaaacatctgtagattttcgccacctccttttttatttttcctttaaaagaaatagttcagaatatgagccatggctttaaattcttgtcttcacttactcaaataaatgtaatatgatcacatatgaacccaaattgtactttggatttatattgatatattatagcatccatggccatgatcaaatcagagcctgacctaagctgacactacagaaatgctgactaccaagtagagttttgcctgagccaaaagcaatgatgcctgtttgtattggtcttaaagggcagaaattttccttacgaatatctctggcagactaactcttgcaagttagtttgattccatgacttctctaacacttattcatggccacgagagctagagaaggccatcactcaaggaatttataagatccagtgtcaaatcatgaagagaaagtgaactccttgatatcagagtcaatattttatttatttttctctccttctaaaacagggcacaatctctggtacaatgcttctcaagaaataattcttgagttgacatacacacatacacacaaatatatatctttatggctttatatgttgattcacattctgccggctgttaagctttctttttttttttttattatactttaagttttagggtacatgtgcacattgtgcaggttagttacatatgtatacatgtgccatgctggtgtgctgcacccactaactcgtcatctagcattaggtatatctcccaatgctatccctcccccctccccctaccccaccacagtccccagagtgtgatattccccttcctgtgtccatgtgatctcattgttcaattcccacctgtgagtgagaatatgcggtgtttggttttttgttcttgcgatagtttactgagaatgatgatttccaatttcatccatgtccctacaaaggacatgaactcatcattttttatggctgcatagtattccatggtgcatatgtgccacattttcttaatccagtctatcattgttggacatttgggttggttccaagtctttgctattgtgaataatgctgcaataaacatacgtgtgcatgtgtctttatagcaccatgatttatagtcctttgggtatatacccagtaatgggaaggctgggtcaaatgttatttctagttctagatccctgaggaatctccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttttggctgcataaatgtcttcttttgagaagtgtctgttcatgtccttcgcccactttttcatggggttgtttgtttttttcttgtaaatttgtttgagttcattgtagattctggatattagcccttaggcacaatcacttaccaaaggaaaacgtggggcagatcttcccatacacacagctaccaagaagcttacaaggcaggcgtgggttggggtagataaaggatcaacttttacattatgcagtcttttcttgtatacaatcttccctattctttgaagaagaaaaccttgaaaaactaaactgtgttcttttaggtcaacatggaagatcaaataaaaaaatgaaatcttttttcttcaggacactcgctggagttttcaggggaacctgagtgttgcagagggggagaatcaggacaaggctagccaacttttctctgcaagtgctaccagcctgggttctgtcacagtcacccaaatctccttcctccatttgaagaaaaataggaaagcagcaaaaattctctctaaatatatatcaacttagcaagataataaagatagtagaaaccaaaacaaataaacaattcctgtcattggaagcattatttgtgtaaattccacattagactcagcactaatcttattttgccaacatctcatagatagccattctcaatatatgctttaagctaatttcagaagtattttttcattgtctaggaaaaaaaagattcttgatttatcatctgtacttctactaaatttttttaaagttaaaaaggaatttatgttttccttcttgatttcatgatactttagggaaagtttatagcaaaatactagcttcagatgttcttatctgtatactcttactgtctcagaaacaaattctatgtctaaaagaatcagcttaaggcactggttcactgatacataactcagtatctcctcaatctttatgttataattcagtagatagaactcaaataagcaagtaagaaattaaggcactgagggcgaacagctctagggagtaaaatatgaagcacacaaataagagatacagcaagtttcagattttaaggtttgaaaggtttgaagaaaggattgcttctcagatatgttccaaagaggagttgataatttcatagtatttcatagctatttattgattttgcttaagtccaaaatgtggtacagataatattttatttattattatctacatttcctggttttttttccttctactcagtctcccactattcagatattttggggcctatgtacttaaaatcctggctcattctgaggacccgaaggcctggatcattctggtaatttttttactccacatctgcaaatcctaatcaatgattacctgcaccatgagaaaaatctcttcactggtctttctgcctccagtgtctccctgctgagatctcctcttctctctgccaccatttactccccagatctgatcatgtagtctctgcttaaatgtccccagcaactccctactgccttcaggtcagggcattcctggaccttcacaatctgactccaacatatattccactctcattttctcttggccttcgcacaagtgaccctgacccacacctatgaagtgaaatataaaaccaaacaatagctctcttcctttcaatcattaatttttaaaaatcaattattgccatgacagctagtcaaacttttcaggtcaacctttgcatttgaaatatattctctttcttggttatttagcattaaatttcaaaaaatttgccttaatgtaaacctgccacttgtcgtacttatgtcaaattagcaaatacttcctaaatgtccaatatccaatatgaatatccagcaccgattttgttctatggaaatgtgaagaggaaagacattcatttcttaactgttgagattataagagaacaaaactctcattacactccaggataccagactgttggttcacattgtcaaaggtgaaactcttccattaggtgcctggtaatgaaagagttaagagtaaagtgtttaacacaggagttccagaaaaacacattttccataaacctttgctgacaatatatcaaatcattggtaaaatgggacaataaaataactgttttagtaacccaatctttgcattagtttgtctacctttgagaaagaaatactaacattaactgctttcataaagcaaaagagtatctcaaatctctgacttattatttaaaatacaataatgccaagttcatcatatattattacagtggattttaaaagaacatagtccggatacggtggctcatgcctgtaatcccagcactttgggaggccgagatgggcagatcacctgaggttgggacttcgagatcagcctgaccaacatggagaaaccccgtctctactaaaaatacaaaattagccagatgtggtggtgcatgcctgtaatcccagctactcgggaggctgaggcaagagaatcgcttgaacctgggaagtggaggttgtggtgagccgagatcgcgccattgcactccagcctgggcaacaagagcgaaactccatctcaaaaaaaaaaaaaaaaaaaaaagccatgagatagaggaaacatcaattggtaaatctcatctaatgaatactcacaaagctttatgacaatcacttgacagaatgtaaagattttacttatgtgattctaagaataaactgtacactttggtaggctgaagtaggaggatcacttgaagccaggagtttgagaacagcctgggccacaaagtgagaccccatctctataaaaaaaattaaagaattagtcaggcatggtggtgcacacctgtagtctcagctattcaggagtctgaagcaggtggaccacttgagcccaggtgttcaaagctgcagtgaactatggtcttgccactgccttctagcctgggtagcagatggtgaccttgtctctaaatacgagaaagagagacagagagagagagaactgtagaaaactaatataagtgcagtatctccagttcctatataagttctgattctgactgaaactgaagaattaactttgtttaaaataacagaatagccaggcacaatggctcatgcctataatctcagcactttggaaagctgaggcaggaggactgcttaaaaaaattctttttttaattatctgggggtggtggcacatgcctgtggtcccagctacttggaagcctgaggtgggaggatcgcttgggtgtgggaggtcaaggttgcagtcagccatgattgtgccactgcactgtagcctgggttacagagaaagaccctgtctcaaaaaaaaataaatacataaaaataacagaatagtctatacataatcttgaagttaggttttcaatatttatgttccttaaagtgaaggtgtttgagaaccttgaaaaagtaaactgtgctcttttaggtcgacatggggggatgattaaaaaaaatgaaatcttttttcttcaaaagacttgctggagtttgcaggggaacttgagtgttgcacaggcgaaaaatccagacaagcctagccaacttttctctgcaagtgctcccagcctgggttctctcacagtcatccaaatctcctaatctcctccctccatttcggatggctcttccctccttcccacaacagcagtgtgcaccagcccacagggtgtaggctcataccctgttttgctcctggcacttcaagaggagttcacactctctggggtttagagaccatattttgagataccacttttttgttagctgagaatctccatttgctgggcaaaatgttcaggaacactgattcaatgtctctaagatcagacctaaacagatatttagtaactgcatgaatcctgagaagggaagactactatactctgagtaactgtatgctataactgtattttaagggctgcatcagtattttaaagcctgctaggatgaacttgaagcttcatccgtacaaggacaagactcttgttccagttcataattcccatgaagtggcttctgtggtctaccttccctttcaacatttggcattttcctgggtttcttttacagttaatctcaattaaattacttcaggaggctgtatgtgggtgaatgtgggggtgtgggaagagagagttaattttgtagttgaataaattccacttagaactttataaagctttccccccaagtctcacatcaagctcacagcacagaaatcatagcccaccatgttgcttttctttcagtctgctcctgtgtgggactctaaagacagcaataggatctgtaaataggtaactgctgtttgagcaataatcctaccattgtataagttatttacttaacaaaccagagttccaggataaatatgattataataaacaaaatacactccctgccaagtaacggcaatgaatcaccatttacaagtttgatagagtaagtgtgggctgttcattttgtcagtatctgtatgtgatttggcagttaatactttagatttctcattgctcaatttaaagcttattcttaattcaattgatcgattaattatgtgaaattcaacagccctctcacaatatcattatatttgtgctgctattcataaagtgactagtgtttctgaagctaatttttctgataaatttgagaaaacagattagaggctgttttacttttaaacaagttccttcagtgcatgtaggagacagactgtgcatgctcataaaatgaaaaggcctgtagccaagcaggcaagcaggtattagcagctgtacaatggctaccttgcaagtaaacaaccatattcaataaaaatacctggatgagttgtaaatgagcttaatacagattagaatagaccaaaaaaaaaaaagtcttggcatgattcccagtatgcatcctagggaagcccagggtaaaggcagaagcagtaatcagagttaaaagtagaatctgaataactactctgagtaacagagaatactgaatagtatagaaaactgaaaaacagcctccatggcccaagcctcttctatctggaaataagattcacagaagagtagaaaggataagaaatctcatcccacaactattcatagggaagctaccacatgcactgtgtaggacagccacggaaatggccaaacacagagaaagtagagacaggcattgactaacacaaggcccagggttgttttgggagccctggacaaatgcaaatgctcatcctgattaacacaccctgaatcccaaagaggatccatgaaccaaccgggacctactaaggatccaaagaggatggtagaatgcttagcctcaactggtctctgaaccttaattagaaaagccccagaactttcatatgcagggagtcttgcactgtggctccttagccaggatcacctccccttgggactcacatagtcacaggctaatccatagatcccacacttttccccaacaagaacatctttttgttatttttttccttatagatactatgttttaaaatctccacctatctggcagtaagccaagattgcgccattgcactccagcctggacaacaagagcgaaactccgtctcaaaaaacaaaacaaaacaaaacaaacaaacaaacaaaaactccacctatctctaattttcttttgttgtcaacgttctattttatttatttttaattgacaaataaaaagtgtacatatttatcatgaacaacatgttgcttcaaaacatatatacattttagcatggctaaactgagctaattaacatatgcattctcccacatatttatcatttctgtcgtgagaacacttaaaatctactctcagcaagtctcaatacattcaaaaaagttgaaatcatgaaaaaccatactcctggactacagtggaataaaaatagaaatcaataccaagaagagctctcaaaaccacacacttacatggaaattaaacaacttgctcttgaatgacttttggataaaagacgcaatcaaggcagaaataaaaataaatctttgaaataaatgaaaacagagacgaacatacccaaatctctgagatgcagcataagcagtgttaagagcaaagtttatagcactaaacgtctacctcaaaaagttagaaagatctcaaattaacgatctgacatcacacctagaggaactaaaaaacaggaacaaactaaccccaaagctagtagaagaaaagaaataactgaagtcagagctgaactgaataaaattgagacccaaaaatccacacaaagaaccaacaaaaccaaaagttggtttttgaaaggataaacaagatcaatagaccactagctagattaacaaaaaaaaaaaaaaaaaaagaaagacccaaatagatccaaataagcaaaatcagaaatgacaaaagtggcattacaactgatcccacagaaatacaaaagatcctcagagatgattacgacacctctatgcacacaaactagaaaatctagaggaaatgaatatattcttggaaacacacaatctctcaagattgaatcaggaagaaattgaaacacaaaacagaccaatatcaatatctgagatagaatcagtaataaaaatcctaccaaccaaataaaatctctggaccatatgaattgaattctaccagatgtacaaagaagagctggtaccaattctactataattagtctaaaaaattgaagaggagggattcttccctaattcattctatgaagccagcatcaccctgataccaaaacctggtaaagacacaatgaaaaaagaaaactacaggacaatatctttgatgaacatagacatgaaaatattcaacaaaattcaacaatacataaaaccaaattcaacagtacatcaagaaattaatttaccataatcaagtaggctttatttctgggatgcaaaattggttcaacatacacaaattaataaatgtgattcaccacataaatggaattaaaaacaaaatcaaaagatcatctcaatagatgaggaaaaagctcttgataaaaatccaacatcccttcatgataaaaaccctcaagaaattaggcattgaaggaatattcttcaaaataataagagccatctatgacaaacccacagccaacatcatactgaacaggcaaaaactggaagcattcctcttgagaactagaataagacaaggatccccactctcaccactcctattcaacatagcactggaggtgctagccagagcaactaggcaagagttaaaaaaaaaaaaaggcatctgaacaggaaaagaagaagtcaaactatctcttttcgctaatgatatgattctatacttagacaatcctaaggactttaccaaaaggctattagaactgataattttagcaaggtttcaggatgtaaaattaatgtacaaaaatcagtagcatttctttacaccaataatgtataagctgagagccaaatcaagaacataatcccatttacaatagccacacacacacacacacacacaaataaaatacctaggaatacatctaaccaaggaggtgaaagatctttacaagaagaactacaaaacactgtttaaaaagatcgtagatgacacaaacaaatggaaaaaaattccatgctcattgattggaataatcaatatcattaaaatggccatattgctcaaagcaatctataggttcaacactatttctatcaaactaccaatgtcatttttcatagaattggaaaaaactaggctaaaattcatatggaaccaaaaaagagcccaaatagccaaagcaatcctaagcaaaaagaacaaagccaggctgggcacagtggctcatacctgtaatcccagcactttgggaggccgaggtgggtggatcacctgaggtcaggagttcgagaccagcttgatcaatatggtgaaaccccatctctactaaaaatacaaaaattagctgggcatgatggcttgcacctatagtctcagctactccagaggctgagacaggagaattgcttgaaccagggaggtggaggttgcagtgagccgagaccacaccactacactccagcctgggtgacagagtgagactccataaaaaataaataaataaataaatagccagtggtattactcaacttcacactatcagactatactacaaggctatagtaatcaaaacagcatgtacaaaaacagacacatagaccaatggaatagaaaggagaatccagaaataaagccacacacctacagtcacctgttgttcaacaacatcaacaaaaataagcaattgtgaaaggactcgttgttcaatgaatggtgttgggatagctggcgagccatgtgcagaagaatcaaactggacccctacctttcaccatatataaacattaactcaagatggattaaagatttaaatgtaaaacttcaaactgtaagaatcccagaagaaaacctaggaaacaccattctgaacactggccttgggaaagaatttatgactaagttttcaaaagcaattacaataacaacaacaaaaaaaattgacaaatgggatcttattaaactatagagcttctgcacaacaaaagaaaccatcaacagagtaaacagaccctacacaatggaaaaaacatttgcaaactatgcatcagacaaaggtctaatatccagaatctaagaggaacataaacaactgaacaagcaaaaaacaaataaccccatttaaaaataggcaaaagacacaaacagacacttctcagaagaagacatacaagtggccaagaaacatgtaaaaaaatgctccacattactaatcatcaaagaaatgcaaatcaaaaccacaatgagataccatctcacagcagtcaaaatggctattactaaaaagtcaaaaaacaacagatattggccaggctgtggaaaaaggagaatgctcatacactgctggtgggaatgtaaattactgtagccactgtggaaagcagtttagagatttctcaaggaacttaaaacagaactacaattcaacccagcaatcccattattgggtatatacccaaaagaaaataaatcattctaccaaaaagacacatgcatttgcatgttcatcacagcactgttcacaatagcaaagcatggattcagcctagatgcccatcaacaatggatctgataaagaaaatgtgatatatatacaccatggactaccatgcagccataaaagagggtgagggcatgtcctttgcagcaacatggatacagctgaaggctattattctaagcaaattaatgcatgttctctcctataaatgggagctaaactttgggtactcatggatgtaaagatagcaacaacagacgctagagattactagaggtggaggggggagtaagggttgagaaactgttgagtactatgctcagtacctgagtgacaggatcatctgtaccccaaacctcagcattttacaatatacccaggtaacaaaactggacatgtacctcctgaatctaaaataaaagtacaaaaaaaaagatattgataaaattcccaccaaaagcacacaaaatatcttgttctatttaatctacatagacttgttctggttaagcatgttgtctctcttagtctttttgaattatgtaattactcatggccctccaccttttaccaacacctcaactcttacccaccactacttaccaccacttctcagactgcgaggggtcaggagttactgtgttggaaattgttgggctaaatagccacgaatttgcaaaggtccagaaaacaagagtagtttagctgcagtgaatgtcattgtgagacatcattttaccatattgatttatatataaaattttcaaggtagtgcttttgcttttaaactgattgcctcaaattgcccccttagtgcaaagttgtatttgttctgaggcatgacacaacaaatcacaggcagtacccaagagaccacacaaaccaactacccctccactccctccacactcaaggtggggcccttgcctcaccctgccagctggaggccatgtcctgagatccttgggggaaggagcaaccagaggcagatctgttggggcaggatgctcaggggcatgccatggaaggagcttgagacttggagccagaagacctaggtttaaggcccagctctgactataacacctaccataaatgcgatgttgagcaaaataattaacatcagccaaaagggagtaatagggatcttagccccagctccctatctccaagagatgtcagaaagaccagaatacctaaggaattggccattcaacacagcaacctgatcagttctcaacctgctccatgatgtgtctgggaacataaaatcactcctcaacacacgttgtctcttctttatataattttgctttattttctcctaaactcttttgggaaattcaatgtcttctaagacatctatgtatttatcttaacctaccgtcttagggaaccacagaaaaagatgggtggaatgttatttgagagagtgagatgttgacagagaggaaaaaggaaagcgcctgttttacttggcagattgaagtgtgaaaaactgagtatcgaaccataataaagaatgttcttttacattttttgttcttgctctcccagaacatattgctaaaattttccatgtctggtctattttgaacttggctgtattttggtatttgtgtgacaatgtcagaattgcagcccatcatttcacattctgcgagtgacaccagatctatttttcattcaggttcaaaaaaaaagctcacattattttcattgtttggaaccaaggccagaaagccacccctgtgctcttgatgtagtttaagcaaagcgtttcacttatcaactgctcacagatcttccctaattgaaaaaatgctgagaagaacaggtctctaaagatttcccatcacagagggtctaccacagataggtggctatttgaaaactgtcttggattggaaatttattaatttatttcaggactttaaaaattaaggaatatggccaggtgcagtggctcacgcctgtaatcccagcactttggtaggccgaagtgtgtggatcacctgaggtcagaagtttaagactagcctggccaacatggtgaaaccctgtctctactaaaagtacaaaaattagctgggtttggttgccagcgcctgtaactccagctactcaggaggctgaggcaggagaatcgcttgaacccaagaggtgggaggttgcagtgagttgaaatcgcactattgcactccagccttggtgacaagagaaggattccatcttaaaaaaaaaaaatttaagggatacttttattaaatatttatattttaatatctttttgatacttctcggagcttcaattttctgaaagtttaggctgctgttgaactgtgtggactagttactatgcccctaaaatatttgtgaggcatctctttacacatttcaacagaagaacgttgtacgtgcttttacagcactctaattagagtgatcatacatcacagtttgggagtgacctggcttctgcctgttgaaccacctccttttgctcacagttggatgatacactatatggtcactctacctctaatgcacttagttataaatgtcaaccctgggggagacatgaaagacacacaactgattaaaaacagaaatttcataataaattgaaagcttttttttttttttttttgatggagtcttgcactgtcacctgggctggagtgcaatggtgcaatctcggctcactacaacccctgcctcctgggttcatgcgattctcctgcctcagcctcctaagtagttgggaccacaggcacacaccaccacacccaactaattttttgtattttcagcagagacggggtttcactatgttggccagactggtctcaaactcctgacctcgtgatctgccagtctcgccctttcaaagtgctggaattacaggcgtgagccaccgcgtccaggcctcttggcaagaagatatgactcttttcttgtgaaatctactttctaagttgatttaaatttactttctctcttttctttccaaaaacctacaatgggaagagcaagaacactttaactttgccttgatctccaaggtgaatagaagatcctgtataccccagacaggatgcagattcatctgtcactcaatacaaggggcacttccaggaaagtttctctttttccaagaaatagagaaaaaggctatagatttattttctgaagaggagcctcaaccagccaaaagacactgacataaacactaggtgcaatgcaaaagacaaaaggacatatcatatgaagacaggcagaaattggtaactgtgagtattaccaatatttttctttgacctccaacctcagggattaatagataaggagttactaggagaagctaaaaattttagagtgaaaaaggaaagaatgacaattaggataaaaggaaggatgtaggagtgaaagggaaggttggaagggaggagggaagagtgctagcagctgggtttggagttgttaaatatgtttaagagacagagtttaggggacatgctgcttaggatgcctccaaaagtagtggcagaaatatgagcttagggtttcttaaaagggaaaagacttatcatcacacatggaaactccacagtaaggaggtagggttaggtgattcagattccaaaggctcttcaaggacgtccatccatccctctgctctgccatgcctaccagtctaaaggtgtgtggtgcaccagcaggctggcttgcttccatcaggttccagcagaagcagttctgtttcttctcctgtgtcttctttctaattagtgagaaccatcctcctcagaagcttctcggcagcctcctcacatcccattgacctggctggaactgcatttcctacttatgcttacacaattccctggcaaggaaaataagaccaccagatagcctagacccaccataattcacccacctgtggctcagaattaggttcccctacctgggaacccatcgtagtgaggtgtagtgtagattcctattaaaaagaaagaagaggaataaagggtgtttggtatgtgtgattgctgaattgttttcccccacaaaaccagtatgttgaagttcctaaccagcaccccaataccacataatataatcagggctggtctttaaagtggtaattaacataaaatgaagtcacatgagtgaactctaatccaatatgactggtgtccttagaagaagagaagattaggacacagacaggtacagaaggaaaacaatgtgaagacacaggaacaagatggccagtggcacaccaaggagacaggccttagaagcaacaaccatgctgacaccttgatggtggacatctagcctctagaaccgtgaggaaatacatttctgttgtttaagccattttagtctctggtattttgttattccagccctagcaaacttgcataacatgcaaccaggaacttctataattgaagaaatcggagctgggaaaggatttttaagatgttttgctaggctaaacattgtttatcaacaactgctaacattacaaaaggagagccaagcagacattatatatctcctggcagaggcatactacactacaactaataaagccatattaccaaaagaagaaaggaaggaaaaaaggaagaaaggaaggaaggagggagggcggaaggagggagagagtgaggaagggaggaaggaaggagggagagagggagggaaggagggaaggaagaaggaagggaggaggaagggaggaagaaaggaaggagggagggagagaggaaggaagaaagaagggagagagggaggagggaaggagggagggagggaagggagggagggaggaaggaaggaaggaaggaaggaaggaaggaaggaaggaaggaaggaaggtaggttgactccgaatttaaccaagacactagatccaactaccaatttacagaaatagatagttacagagaaaaatgttagctactggaatgcaatcagcaaaatccatattgtgggaagcattacagggcaaatattcttggattgagggactgtctaggacatgagactttcagtgctaacacaggaaaagtcctaggcaaaccaggacaagttgggcatgttagccttctctttaacagacaaatcacaagagaaaaaaagagagaacaaaggaatctatactttaaaaatatttaacgatgtatcagccaatcataagtggaccttgttctgaacaaataaacttataaaattttatgaagcaattaaattatcgttaatttttaatgcaaaaatagtttttcaattttttttaaaagagtgaatccttctgttttagagatatataacttaaatatttgtggataaagttgaatgacgtttgaaatttgcttcacgataacatgggaggaggaggaggaatgggtaggagtggagatgaaataggatcgtccagaagtgaatggttgtacaactgggggatgggtttactatactattttatctaatctgcacaggatgaagctttccataatttttcttaaaacagtatcttttaaagattttttttcaatatattaagaatacattctccaatttggttttttcttcagaggttgagtatctaaatcaacctatttgttgttgggttatgtttttttgaagacatccaggccaaaaggcagccctgatgatatttggaattatatttgaaaaagtacatgaaatgataatcaggatttaatagagtcctgagaactgattctattttatttattccagcatagctgaactaagaaggtaggatttcagcagcttcttgaaggaaggatgcaagtcctatttataataatttgccttcctatttgtccattgcactcctagctaataccattatcaatttcatttagaaaacatatattctggtaatttttaaaatacaagcaattcactttgcaaataataggaatcaagaaatcaccctgaagtgtgttctgcatggtattaatagctgtcatgggataagggctctgtcaaataaatttaaaaatcactaaattaaacaaaatctgggaaaatacttttcattccctgcacttgaatatataccgtgagtctcttagtaggacatcgtttaccctctatcttgcagtctagaagaaatggtgcttcatgatgcacatgctgggaagcactgacttgttttcaagtttacatatttcttagtcaaatcaaagctttacatgaccatatttcagaccagaccaatctggactcaatatctaaataaagagaatatgtagtaaaaattaacaccagttgggagaaggttagggctcttaatcttctccacaactcccagctgaactccaggtaatgaaagcgcctttctcagctttcctgccagcactcgttcaatccctgctgcaagctgaaaaccgtgctaggtgttttgaatagagtatctcatttaatcctcacggcaatcttctgatttaggtattactaactcattttgacagactaggaaactgtggcttgaagacatcaggcagcttgccctaaactttccacctagtaagtgtagaagctgagattccaccaagttcaatactttactttcttctaactcgcatgaggacccctttatcagttaaattcctcaatccccaaaccctaaccccctccacccttccacatcttttccacctatccttttcctgatgcaagtgtttgtatagcagcatggcaatttttcctggattgattcaggtgtagagattccaattttttcccaaaataccgagtaccctgaatcactattattgccccacctgacagggtaatttaaaaagcaccttaaagcacatttcaatctctctacaaagagatctggaatacagaatgcttcaccagtccaggcaaacggggttctggaattacctttatttgacctgattacaccagctgccctctccttcctcccctctccccatgctgccatggttattttggtgcacacggattggagatagggaaaagtaacatgttctactttaaggaaggaaattgttggccatagtcaggactcagaagatgcagggacagaacgtggagtgttgcagaatctccaaacatttctccctgtggcagaagccctggataactttgtagctgcaattctagaggatattttggcatatgatttacaggctcaggcagcataaatggaccttaaatatcatctagtccatctagttgagataagctcagggaatttcagtgacaaaagcagggtcactgtggctacggagcaggacttcatactcccattccagtccttctgtaatgagggccttcctttcccatattaattattttctacaagaaatgctattgctttaaacatgttcatctacattagccttgtaatataatagctatgaacacaggctttgcagccagattgctgaggttgggaccctggcttcatcattccctcattttatgaccttggacaaacttcttaacctctctgaatctcagttccctggttgtaaaattggggtaataatagattctacctaatagacctgttgtgaaaatgaaatgagattaaccatgtaaggcatttaaaacaggacctggcacctaacaagtgcccagcaaatgttagctattattccttacaccatccattgaaaccattattttttaaaattatttttttttttttgagacagagttttgatcttgttgcccaggctggagtgcaatggcgtgatctcggctcaccgcaacctctgccttccagattcaagtgattctcctgcctcagcctcccaagtagctgggattacaggcatgtgccaccacgcccagctaattttgtatttttagaagagatggggtttcaccatgttggtcaggcttgtgtcgaacttccaacctcaggtgatccacccgcctcggcctctcaaagtgctgggatttataggaatgagccaccgcacccggctaaattttttaattgttgtaaaaaaaacacataacataaaatttaccatcttaaccatttttaagtctctagttcagtagtctaagtatattcacattgttgtacaacagacctttagaacttttatctcttgcaaaactgaaactttatacccattaaacaaccccctatttccccctcctcccagcccctggcaaccatccttttactttctgtttctatgaattcaactactttagatacctcatgtaaatggagtcatacaatattgttcttttggtgactgtcttatttcacttagcataatgccctcaaggccattcatgtcgtagcatgtaacaggatttcttccctttttaaagctgaaaaatattccattgtaggtgtacaataccacaatattgtttttccatttatccaccaatggccacttagattgcttctacctcttggctattgtgaataatgctgccataaacatgggtgtacaaatatctcttcaagaccctgcatttaattctttgaatatatatccaaaagtgagattgctggattatacggtagttctacttttaattttttaaagaaatgccatactgttttccagagcaggtgcaccattttacagtcccactagtacttcacaagggttccaaatttctccatatccctactaacatttggtcttttcttttttctttgtttttgatagttgccatcctcgtgggtgcgacatgatatctcattgtggtttgaattttcattcctttaatgataaatgatgttgagcatctttccacatatgcttcttagacatttgtatatcatctttggagaaatgttgtctaagtcctttgcccatttttaaatcatgttagtttttgttattgttgggttttgcaaattctttatatagtctggatattaactccttatcagatatataatttgcaggtattttcttctgttctatatgttgccttttcattctattcattgtgttctttgacacccagaagtttttgagtgtgatatagacccagtctatttttccctttgttgcctatgcttttgacgtcatattcaaaaaaccactgccaaattcagtgtaacgaaactttccccctatgattcctactaggttttatggttttgggtcttacacttaggtctttaatccattttgggttaagttttgtgtaaggtgtaaaataaggccttagcctcattctttgcatgtcgatgttcagttttcccagcacaacttattgatggagccacttttaaatgtcctttacacattcagaagttaatgttgagtttgtttgttttaatgtgtgtttacagtatgctgtcaaacgttctgaaaaaaatgatcagagcatgggactttctttgtcatttctgaggttatttgcatgatttattctggaatctacaggaaagaagactgtatggtaatgtgaaagcaggcttctagtctatgaaggatgaaaataaagacctggacccatcttttccttccatcctctagaaagagacaagaggaaaggtattttaccttagggcaggagaaattttggattagaggatatggaaaatataaccaaaataaccaaaaaccaaataaccaataatcaaaatataaccaaaagaaagttctgtcaatgtgtaactggtaaagtgttctgaaacagccttcatcattgatctttgcaacagatagggtgccctctaactgagttatataacaaggtggaactacactaaggattcttgcttatgtgaatttacttttcaagactctgcttaaaaagctgatggaaatttaggttgcttcacattctttgctatacccaacaattagaaaatgaacagttttattagatctctgcattgcttgatctgttacacaatcacttctataaatatatctctactttaaaatcttaattttagaagttcctcagctacgactaccaggtacctcggcttcctccctcctccgagagaccgccgaggtgcgggctgtgagagagggagcgtggagcctccgaggccgaggactcggtcccagtttggacagatagaagatgcgagcgctctccctctccctctccctctccctctccctctccgtctccctctccctctccccacggtctccctctcatgtggagccaaagctggactgtactgctgccatcttggctcactgcaacctccctgcctgattctcctgcctcagcctgctgagtgcctgccattgcaggcacgcgccgccacgcctgactggttttggtggagacggggtttcgctgtgttggcccggccggtctccagcccctaaccgcgagtgatccgccagccttggcctcccgaggtgccgggattgcagagggagtctcgttcactcagtgctcaatggtgcccaggctggagtgcagtggcgtggtctcggctcactacaacctacacctcccagccgcctgccttggcctcccagagtgctgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagtgcctctgccccgccgccccatctgggatgtgaggaggcctctgcccggccgagaccccgtctgggaggtgaggagggtctctgcccagccgccccgtctgagaagtgaggagaccctctgcctggcaaccaccccgtctgaaaagtgaggagcccctccgcccggcagccgccccgtctgggaggtgaggagcctctccgcccggcagccaccccatctgggaggtgaggagcgtctccgcccggcagccaccccgtccgggagggaggtggggggggtcagccccccgcccggccagctgccccatccgggagggaggtggggggtcagcccccccgcccggccagccgtgccatccgggagggaggtgggggggtcagccccccgcctggccagccgtgccgtccgggagggaggtgggggggtcagccccctgcccggccagccgccccgtccgggaggtgaggggtgcctctgcccgcccgcccctactgggaagtgaggagcccctcagcccggccagccaccccgtccaggagggagatggggggtcagcccccccacccggccagccgccccgtccgggagggaggtgggggggtcagccccccgcctggccagccgccccgtccgggatggaggtgggggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgccccgtccgggagggaggtgggggggtcagccccccgcccggccagccgccccgtccgggagggaggtggggggggtcagcccccctgcccggccagccgccccgtccgggaggtgaggggcgcctctgcccagccgcccctactgggaagtgaggagcccctctgcccggccagccgccccgtccgggagggaggtgggggggtcagccccccgcccggccagccgccccgtcccgggaaggaggtggggggggtcagcccccccgcccggccagccgccccgtccgggaggtgaggggcgcctctgcccggccgcccctactgggaagtgaggagcccctctgcccggccagccgccccgtccgggagggaggtgggggggtcagccccccgcccggccagccgccccgtccgggagggaggtggggggggtcagccccccgcccggccagccgccccgtccgggagggaggtggggggggtcagccccccgcccggccagccgccccgtctgggagggaggtgggggggtcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccagccgccccgtccgggagggaggtgggggggtcagccccccgcccggccagccgccccgtccgggaaggaggtggggggggtcagccccccgcccggccagccgccccgtccgggaggtgaggggcgcctctgcccggccgcccctactgggaagtgaggagcccctctgcccggccagccgccccgtccggaagggagggaggtgggggggtcagccccctgcccggccggcgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtgggcaaaagattgagaaatcggatggttgccgtgtctgtgtagaaggaagtagacatgggagacttttcattttgttctgcactaggaaaaattcttctgccttgggatcctgttgatctgtgaccttgcccccaaccctgtgctctctgaaacatgtgctgtgtccactcagcgttgaatggattaagggcggtgcaagatgtgctttgttaaacagatgcttgaaggcagcatgctcgttaagagtcatcaccaatccctgatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaataaaaaaataaaaaaaaaataaaataaaatcttaattttaattttacattaaaaagaaaagcaacatgtattcattacaaatttgaaaaacacagaaaagcatgaggaagaaagttaaagccacccacccttcagcgatagccctccatccagagatagcctttctcaatattttcttttgtttccttcatatatgtatatagatcatgatagatggtaggcaggtaggtaggtaattgtatgtgtgcacgaccttttttttttaacagagtcaaaataatactatgtgcatgtgtgtatatgtatacactacgttttcatttaatataacatgaaaatccttttgtgttattttaaattctttgaaaacatgatttaacatctgaattgggatatatagtttatatgcttattctcttactattttctagaaattttccaattttttgatttcataaaacactgtgatccttgaaacttagtatctgtttgcatccatgattattgccttcaagccaaaccttagaagtagaatttttggatcagagatgaagaaaactttaagaatcttaatatacctgtcgaattcttttctagaaaaataacactttttctaatttatactcctatgtacaatatataaaagctccatcccagctggtcttctcaaactctagatagaaaaatgataggtagaaaatagtatctgtttatttttcattaactttcacttctgaaagttgaacatttttcttatatatgttaatcaactaaatttctttgccaattttctgcttatttttctactgatttaaattgtttaaaaaattaataacaggctgagtgcagtggcttgtgcctataatctcaacactttgggaggctgaagcaggaggattgcttgagtccaggagtttagaatcagcctgggcaacacagtgagacactatctctacaaaaaataaaattcaaacactagccaaaagtggtggcacatgcctgtagtccttgttacttgagaggctgaggtaggggggattgcttgagcccaggagttcaaggctgcagtgagctatgattgcaacattgcattccagcctgggtgacagagtgacatcttgtctctgaaaaaaataatttaataataaaacttgattatatatattaccaaaagtcttaatctttttgcatggcatatggagatctttctggggtttgtttgtatttaaaatgtttaatcacaagatataaactaatataaaacatcttaaaaagacaggaaaaatattctagtgctcatcctacacacacagtatttgacaaggtgccgtactctttaagaatgccaaatttcagtctcattcctgccccattctagagctaaaatcagtcatcctaaacaaattttgtgattgccatttatactggtgagttatagaagtgatctgttacacaatcacttctataaatacatctctagtttaaaatctttattttaattttacattaaaaagaaaagcaacatgtactcattacaaatttgagaaacacagaaaagcatgaagaagaaagttaaagtcacccacacttactgaagtgtggtgatagccctccatccagagatagcctttctcaatattttcttttgtttccttcatatacgtatatagatccatcccagctggtcttatttgagtaggcatctggattaaccagacctgttgagccagggggaattcagagcttctccagcctgcttcctgctctattataaaatggaggtgatcataataataatacttctcacatcatgtgttgtgagaaataaatgtgataaaacatgtgatgtgcataatgtagtgcttgccatatagtacttaatacctaatgacaatgatcctgtatctgtaatgacttgattaatatgactcccactaagggcctaacctagcctcatcacagcactcaaaggaaggagctgttgggtaactgggaagtctgcattattcaaagacagtagagtcatttcagattgacaatgagagctttcacagcttttctactatcattcttatagggcgtgatgcaaatacaaataaatatcttagttgcctttgacagtggaatctaggtctcctttattttatattcctcttttcatattaattctggaatagcaggaaaaataaagataatgctctttgttgagaacatgatataacagtttgtgtataacttaaagtactgatactgtagatacgtgatctacgtgattcaaacttacaataatgttgcattcaaagaaccacgtttcaacagctactttcttctgacactatctccaaattacaaaagcaattttatttcttaattacatagcttgggaatcctagtagtaactcttaacaatactttcctactttctgttctctccttcccattttttttttgcaccttttccagactctccagagctcaatttgctagagttccccaggaatgtcttgccttcactctttcttacctcttgttttagctctccttcttctttacctttataactcacttttgcttagttatttctctcatcttctgctacctgggttctgcccatctctgtctatgctttagtcttcatcctcaaagtctggtatctggtctaaaaatgacaaaatctccctgaagtcacagggcagcgtacatctaagtaggcatgaccaggctattatcctcagtattaatagtctagcctaggagagaatgaggggcagagattttcaggatggggagaaatgggaagaaaaggatatggggagttgtgacatccatgtcaataccatgttaataatgcttcgtccttctcacgcctgtaatcccagcactttgggaggccgagttgggcagatcacaaggtcaggagatcgagaccatcctggctaacacggtgaaaccccgtctttattaaaaatacaaaacattagccgagcgccatggcaggcgccgatagtcccagctacttgggacgctgaggcaggagaatggcatgaacccgggaggcggagcttgcagtgagctgagatagcggcactgcattccaagatagtgccattgcactccggcctgggcaaaagagtgagactccgtctcaaaaaaaaaagaaaattgttaagtctgtagggtaggtattaatattctgtttttacagatgaagaaactgtgatatagacaattaacattattgatatatgcaaacacaactaatattttaccaattcaagtctgtgtaactttcctgttgtgaatcttttatgttagatagaaatgttcctctgagctaagtgtaaacaagtgttacttaaaaaaaagtatgaacagaaataaaatgagaagtcttatacaaaagtgaaggaaagaagaatgatatttataaggagccaggtgtccctatggtctaactgaactactaatttcaacttgggcaattttagttgcctggctaagtacatgaggctttaatagctggattctagtgaaagtttattatgacagtatcttcttgatcactgaatatgagaatgtcttaaatttaataagtgttttccataacttatcaatggaattcaatgacacaaaatgttgagaaagatagtttatatttttttcaggtgttgttattgtcaagacagtgaagaatctaaaatcctaccccacttgaaatcatctagttagcttgtcataattttatggatggtgacagaaggcatgagattcctgggtcagagacaaagaactttacttcttagagtaatagtggtaatgagagtatcagcatttgtgaaggttttctgagactcaatcccaaagggcaatgcaagtgggatatgtgacacctgttcatgcaatgggcagtgctatgggggaggaattctgagcattatggaagagcccaactcttctataatgggcagtaagcttacctgacagtaaaccccagaggaagatattatcttcatcgtacttggcagaaacaaacttgccttttcctcagagagaagtattatctttatcttccaaggttattttctttgcaaacattcttagaggattgtttaggggaaaaaaaggcaatttttaaaaaatactttaagttctagggtacatgtgcacaacgtgcaggtttgttacataggtgtacatgtgccatgttggtttgctgcacccatcaacctgtcatttacattaggtatttccatatgaagatctttcttaactcacctcctgccacttctcactacctaaacttcctcatttatagtttgttcccaccatattaaatgtcttgccattacatgacaaagtagactcttttatgactgtttattccatgccctctatttagaaggccattcttccactttccacctaagagactcctacttatattccaaggattaagtatcccttcctggaacagacttctgttatttttgcttgatagcatccattccactttcttccagtaattgcactttgatttctctttgggaattacccttccctcattgcatacagttttgattgcactgtaaatcaaagtgcctcccctgtcttatctaagtggtaggcatgtggcccacaccggattttctcttgtgaatcttgagggaggcaacacaaggacagaaaacatttggagtcaattcatcctatagtaactccccctaggaactgtcctttagtttctgatacctagatgctcagaactcagcagtttgggtactttctgaggcctggttcagctttctttcttttattctttttctgtcagaaacccatatccttccaggaaactgatccctctttattttctttcttttggcttgttatcttgaagaggttgctgttacttgtaactgaacaggtgatattaataacttacattcttgcttcttgcagcccttttcaactctctcagaggtctctgccatctttctgtggttcgcccccactctgtacattgcacttacactatattatagttattagttttctatttcccctctcatatgtgattccctgacaggcaattactgcttttcctggaatgcctaacacagaacctgagacattttagacagtcataaatgtgggcttaatttaaaatgattattaagcttcacaactcaaccatcatttgtcttcctgaaaagcaggaaaatatttcagatttgttgccaaacctctgtgagtatgttagtttggcttaaattaaaagcaaagtccatcaaagccacggaaatgaaataggcaggtaactcatgaactcaggtgtagaaattttataagatagaaaaatgtgaaacaacagacaagggcctagctgtcacaaaactataatctccatcagaaacaaacaaacaaataaaaattccaagaatgatgctgaagcacattagaaagaagggcaactttatcacagagcttcctggtgaggttcctacaattaaaaaagccaatgtaaagattaaaggcataaacataatctgcatgcatttttcattccaaatagaaaatcactttcatcataatatattcacaaagaaaaactgagaaatcccttagccagaaggaaagaaaagtgaatatcataatgttttaaagaaaagtgaatatcctgtttttaagaaaagttaatatcatacaagttacattatatctttctgaaaatttattttctccagactgagaaagcattatgactaaagcatagatactaggaaaataatcagttccaatttttttcattaatgttgagtacaagctgctacttcaaaaatatcttcatcagatttaaattattctgtaactccattccctatttcccatctcctaaaatgatgttaatttatcattctcaggaatgcattctcatcatcttagaggaaattgtaattaaataaacccttggtgagttcatccctgaggtgaacatgaggtgagtacaaatccttctaattcccatggaaattcccaaaagtgagaagataagtgcccagattgccagagatctcctttagaaaaggatagttcgcaaactaaggttatttttcggaaaactgcttgcaaaatcgaataatgctagagtaccaaatagaaaaatctgaatatgtaattgggcatcaatttgcaaatatgccttagtggaaagctttacaaatggaaactttatcatgggatttcacttcctttacttggtgaaaggcatactagtgactgtatattatttcccatctagaatgctctttcctattctctttgaaatcctgaatcctacagattcttatgtgttctggtctataatgcttccctgtttcctttgaaatcctcaatcctacagattcttatgtgttcttagccttgtaaaatgtcagaggctgttcattctataactccactatcagccaagtacttctaatgggggggaaatgttacttacaattaacttctttagttatagcacaattactcatttccatcattcttacagcatatcaagtatcctccataaaagagcccaagagagaggtccttttcaggtttattgtatttgaaaagtcactcgtaatataaaaatcagaaagcttttctgagatggactggtaattagagcagcagacaaaatgctggaagattcaatagttcttgaagtcagttccagatttggacagcttctttgtacatcagcctccatttgacaaaatgaagaaagacagaacagcagtgcacatatataatgatatttcaatagaaaaagggatttcattgcccagggggaagagaatcaagtgccccttagttaatgcaagacacacgattccccagtaaggccattctggaatttatcaaaaacattgctctgtgcaaatggttcttaacctggctacactttaaaattacccagggagagttaaaacaaagtaaaacccagtaaacctggtctccacccccaggggatctgagaatctgattcaattggtctggggtgggatgaatctaatatgcagccagggttgaggagctctgtcatagggaatcaaagtaatcaaaatgatagttaaggcacaaaactcacattatggagacatttatttttaattaccctaaagcatgcaagacatatgagtactaaaaaagcaatattctcctaacctaccacatcaggaccagtggagcataattcaatttttgggaattagaaagctgcttccaaaaattcctggtctctgtgatcaattctctagtcaatttgattctttttattaaaacaatgggaaaggcttattgatgttttctcttagatttttcccgggtaggaataataattctgtaactacaagagtcatccaattccatgttttaatgagaagcatggtggtatttatggttttatagcctggaatggctaacttgtttgtttgtttcctgagaatttaatgaaagctgagtatgtgtatacatatataattttatgtagaatttcagtgggttcacaaatcacccacaattccctgagagttcacagatcccaggttaagaagtcctgctttgcagacttctccataagttactggtcatgagtgataaaagatgaaaaggagaaagggcaataaatgaagctagaggtatagcagttaggacctggaaattcccaaagtattctaggacagtgcttcccaattaatgtgtctaagagacattgaagagctggttaaacagccagtaggtctgcaatggcctgagattctgcatttctaacaaggggctggtccacaaaagaacaaagctggaggcatcacgctacctgacttcaaactatactacaaggctacagtaaccaaaacagcatggtactggtatcaaaacagagatatagaccaatggaacagaacagagccctcagaaataatgccacatatctacaactatctgatctttgacaaacctgagaaaaacaagcaatggggaaaggattccctatttaataaatggtgctgggaaaactggctagacatatgtagaaagctgaaactggatcccttccttaaaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcatggcgacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacacatttacaagaaaaaaacaaacaaccccatcaaaaagtgggcgaaggatatgaacagacacttctcaaaagaagatatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacatttttacactgttggtgggactgtaaactagttcaaccattgtggaagtcagtgtggtgattcctcagggatctagaactagaaataccatttgacccagccatcccattactgggtatatacccaaaggattataaatcatgctgctctaaagacacatgcacacgtatgtttattgcggcactattcacaatagcaaagacttggaaccaacctaaatgtccaacaacgatagactggattaagaaaatgtggcacatatacatcatggaatactatgcagccataaaaaatgatgagttcatgtcttttgtagggacatggatggaactggaaaccatcattctcagcaaactatcgcaaggacaaaaaaccaaacaccgcatgttctcgctcataggtgggaattgaacaatgagaacacatggacacaggaaggggaacatcacacactggggactgttgtggggtgggggagggatagcatttagagatatacctaatgtaaatgacgagttaatgggtgcagcacgccaacatggcacatgtatacatatgtaacaaacctgcacattgtgtacgtgtaccctaaaacttaaagtataataataataaaataaaaaaaaagaaaagagcaaaaaaacaaaaaaaaacaaacaaggggctggtccatagatcagactttcagtagcaagatacttaaaattatgtcatcaactgcactggcttctcgtagcacaagagaacataaatgtacaaatatttccacttttcttgaaaactcaatactgtatataatatatgctattttttcccaacaaaaaaggataaagaagatggcaaacttaattctttattttcaatggtctcagaacttccatggttagaactgttaaattcagtagtgtttcttttcattgaaccaaacattatcaattcaatggaagtaatttttttaaatcctaaaaacaacaacacaaaacaaaacaaaaaacttcccctgggtaatgttgctcaggaagaaatgaaatcccattatgtagtacattgtgatttttaaaccatttttgtctggaaaacaattacacttcaaacccagttgtgaacctgaaaccagcttttctaaaccagaaaataaaacagagcccattgagctatgtgattctccaggttattagagataagagatggaggccctctctcttgtcacactcaaaggtgccagagggttggctgctcacagccacctttgggttttagttacaataattctttcttttaaatagtattctttttatgattataaaagtaataagaataataaacaagagcaatacatgttattgttttaaaatctagaaagtcttcaaagatgtaaagaatacaaaaatacctgtaactccaaaactatttgttgaagaccacctatacattgctctatcctttacctttgtttttccaatgccttttttttgagacggagtctcttgctgttgcccaggctggagtgcagtggcgcaatcttggctcactgcaacctcccctcccaggttcaagctattcccctgcttcagcctcccaagtagctggtgcgcgcaaccatgccctgctaatttttgtatttttagtagacacggggtttcatcatgttggctaggctggtcttcaactcctaacctcaggtgatccacctgcctcggcctcccaaggtgctgcaattacaggtgtgagccaccgtgcccggcctcaatgcattttaaaaaataaatagaatcctctagtacataaagtattgcagcatgtttttttctcctcagtacataaaaggatgtaaaaggatttggtaaatgaccttgacggagaaatgtttgtgagcagcacaaggccatcccaagaatagtgcaagccctttgtgaaacttcttgcattttatctctgctttgagtgtttgtgcaattttatttaactgttgaacaagtatattttattttggatgtggaaagaaaattcagactaacaaatctatacctacaaatggaaataagataaggctgagaggggtaagttattcccttgtaaccttaaagagacaatcatggaatatcattcttgcatacactgggattaattaatctccctcttttggtttctgcactatgaaggaagtacagagaatggctatcaaaagagaaatgctaaaacctcaaggtgaatttcaccagaatcaagccttaaggaacggacataattccttaaactgagcaactctcagagctgggtttagtagagaaaagtgctatttttttcctgcctctccatataattccagagttagagattaatagtaacagcaaactgaaagaaactgagaaaaataactaaaggtttgtctccttaaatttatgaaataaaaggagaaaaaatactgaattaatagattgactaattgaacaaaatttattgagccccttttacattccaggtactgtgctaattattggaaataagaaattcccatgaagataaggttgctgttctccagtagcttacatgccatagtggaggaggtagagatgggcaataaacaagtaaatgaataactacgctgctataagaaaagagtaacttgaaggtcaacggactaatttggaaaagatctcccagggaaggggtattgagtgaaaagaagaagctgatctggaaaccagagccaagaagaggaatgaagacatgtaacaaccctaagactagaatgagcttggtatgagtcaggaacagaaaaatccctatggctggagagtattgaacatgatggaaagaagacggaaaggtgtctcaaaggaagacaggcctagatgatgcaggacctcggaagccagggctgagaatttggatacagtgccaaaagtgcccgtggcagttttttatgcataaaagtgccatgatctgatttacagttttaaagtatctctctggctaccctaaagagaatacatagtcatggagcactagtggaatcaggaggacccaataggaggctataccaatagtccagacaagaaatgagggtggcttggatcatgatcaggatggtaactgtataaacagagagaaagcagagactgtgatatattttaagctaacagggacttgctgatgaattgattaatttgagtagtgagaaaaagatttcagggttgaacaattgggggaatggtgtggtcctttattggaataggaaaggctttggagaaaataggttgcaaagaggcctaaaatttgatatatcaatcggatatccaaaactcaaatcaagtagagttggatttagataaggaagcaaggagttacaggtttattaagtattggtgagaaggttatatattatatttctttaaattttactccaattgtaatgccttcaaaattttcggtattagaaatactggttaatgtttatgattagaataaataattatactatccttttaataaagtaacaataaaattcatactctttttttcctaagtagctaagcattaatcccagcttacacagcaatgtccttgcttactgatacataactaaaggtttagaattagcccagcacctcctggcaggattgatgagcaatcactgtcattattttttttttatctctggaccacttaggaaatttccccgtcgcttaaagtttccattatctttttcatcattattttagagtttcaaagtgtcaccagagaatgatataaaaataaattaaagcggactttaatttaaaaccctaattgtagtagagacgggggcccaaagttctccttttcatccacctagaagacagaagacaatttgaaaatagttccactttgataccattgtgtatcaaagaagaagctaaaggtaccattttgaaactcattgggaatgaaaaaatttcaactacatcgtagaattaataatggttttcattatttatgagtattttttgaaattgaatttcattataaaacattagagtcatttcatgtctacttttttatagccaaacttgtatgtaaacatacttcagaataaacttaggagaactactcccaggttgctaaaaatgcccaggctgcccacacgagagaattaaagcaaactatatagaatggaatttgagattttccatagtcttatataattgtctaaaacagaaaagctgccaagtcaagaagaaaaaaaaatgaagcacatgaaaacaaatctaatataacacattaatcacaactcttgtacatgtacaacatagctatttagagaaaataggtctgccctaaggaaaactattgaaagttatcttgggctgcccagcatcccatatttaatattagtctagtcttgccctagacatgacccctttatatggatccatacatatcctaatgttgcctcccgactggttggtctttcaggtcacaagttgatgcagaaccaccgtcagtggtaaagaagatgtcaatcttagatagcaaatgcttcagtaattacagtattgagactgtcatgctaagagacatatatgtgatccagacggcttttcagaaccttcctgatcattcctccaggatgctgcccccaaatggagtaaaatgcttcctcttacaaacagcaggaagagtccaggtttctcagcccaacattcaatgtcctgtgtaattttcctctctccagttgatagcttcagaccttcctcccatcttctcctacacagaacctctactccaaactctttctctgtcccagaagagaatgtgaattttggcctccaggtttttttttttaatcggtgagaatctcacctaaggcatgaagctcacccttctctctgcccagtctcaagtcttcatggagcctgccctgacaccccagcctgctgagacctttccttctctagtatagaggctgtatcgctggcaacatgccttgttacaaataactgtatgacatttctttcatccgtctccaaaatctcagtattcacatacccttcactattttttcccatattcacatactacctgttacgttttggtctttattactttcttgaaaccaattcccacatttttacttacatttaattttatagaaatttttagatcatgaccataatggaaagtcaatacatactacctgttatgttttggtctttattattttcttgaagccaattcccacatttttacttacatttaattttataggaaattttagatcatgaccataatggaaagccaataacattttacataaattgaagataattgtaaaatataaccattaatataaaaatgtttgtctatgtaggccgggcatagtgattcatgcctgtaatcccagccctttgggaggccgaggttagaagttcaagaccagcctggccaaatgatgagaccacatctctactaacacaaaaattagctgagtgtggtggcatgcacctgtaatttcagctactcgggaggctgaggcatgagaattgcttgatcccgggaggcagaagttgcagtgagccaagatcacactactgcactccagcctgggtgacagagtgagacactgtctcaaaaaaaaaaaaaaaaaaaaaaaaaagtttgtctatgcctactacctaaaattatctcacatatctcagtttgggaaatgctactttatgttgtcatctcatattgcaatttaagccttgcatcatgtaagttattatgtgtgtatatctatttccctgaatataccataacttcctaaagaaggtcatatattatacttcacattccacagtgtttttagtccagtgtgttgcacttggtaggcattaaataaatatttgttcagtaaataaatgtccacaaatgtatcaatatccctagtcacagtttgtagttatacaatcggtaaaatgaaaatactcaaacttaataagcccatttaattatataatgaatttatatagtatactatcatggatataaaatatattataaataaaggaaaacatcgctattaatagtaacagtgttaatcacatgagattctggattttaaaattttaaagtgatagctctagattttatgaaagtaataagcaggaatagatccaatagttaactgatgtgccttgctttagacaaacccaatagatcaaaatccaagcatacatgaaagatgaattagggtcagataagttacactgcaaaataaatttagagtagaggccatttgaacagcaaatcctaacaacattttaaatgcagcttgactcctatttcaggaacatatttattagacaaattaaagtgtgcattatcataaaaatgaacacaagtaaactcagggggagataataaaaagctaaagaaaaaaaatctcaaaaaaaatctcataaattttctgatttgaactggaggtttggttaatactgtatccaaatgcatttttttaaaaaatattctgaactgttatttcccgaagatcaaagttttaattttcaaaagaaaagttgcgaagaagaatttttaagacaaagtaaatagagaaactagttggggtggtgggaattattccagatccctgtgccttctgtaggaaaaataaataaaatctggcagtcagtaggctttctgtatctatgtcctttaactatttcaaacagagaaaaataagaaactaaaatctactgcttccaaatgattaaatatcttccactaaatttataaaggttcctactcagacaattttttcactcattccctcaaaacaccaatatttctgtatcttcaggatgagctctatacggattccagaggaaacatcaaccagaaacagacctgagtgtgtgctagtgtaacccagcattccacatacccccaaatatgcattatgatatggtgacctacactcctccatggagaattatgagatatcagagcaggagcagatctttaaaggttcctactataattcctttgaatatgaaaaatgactccaaggaaaagttattttcccaacttacaaagataaactcaagtccagtggagtgaatagatccactcttgcctgcacctagccacagttcagcttcccaagtactactctcccctggtccacctgcaaggtgagaaagtagatccagagaaacacccaacccattctttccctattctctgcttctctcttgaaatctgtctgcagaaatatgatatctgaaaatagcttttatcctaaagcacaagtatagggcaaatttccagagagtatctagaaagccacaaataaaacttgaggatggggcacggtggctgcttgagaactggagtcattttgtaacccaagctggagatgtttccagtggcctccaccatccagctgcaccccttcagactgggttaggtacaggggaagtactctgctttactctgccatggcatgccctccactgaactgtcatcgtgagtggattctgcaagggaggccctgagtcttacccatcttcttatctccagtgcctagcacaatgcctggtatagagaagatcctcaataatggctgtttttaaaaattactgtatattatttaatttctattattttccaggtgatacatataaataacttgaaaaagtcaaataatcaacaggatttattttatttctgttttgtttgtttggtttttttttttattgagacagggtcttgctctgtcacagaggctggagtgcagtggcgccatctcagctcagtgcaacctcaagttttatttttaaaagaagtgttatcttctatccaccaatccctcaattatataatacacatatctatttctccgagttaatcatattaaacttttagctatttagttgattatgtatttactacttaactctatttctattttttttctttccaacttttattttaggttcagggggtacatgtgcaggtttgttacatgggtaaattgcatgttgcaggggtttgttgtaccggttatttaatcacccaggtaatgagcatagtgcctgataggtagttttttgatcttcaccctcttccaacccttcaccctcaaataggctctagcgtctattgttcccttctttgtgtccatatgttctcaatgtttagcttctacttaaaagtgggaacatgtggtatttggttttctgttcctgtgttaatttgcttaggataatagactccagctccatccatgttgctgcaaaggacacaatctcatgttttttaaggctgcatcgtattccatggtgtatatccatgtccatcactgatggacatttaagttgattctgtatctttgttgttgtgactagtgctgcgatgaacgtgcatgtatatgtgtctttatggtagaatgatttctattcctttgggtatatacccagtaatggggttgcagggtcaaatgatagttctgttttaagctctttgagaaacctccaaactgctttccataatggctgaactaatttacattcccaccagcagtgtataagtgttcccttttctctacaacctcacaagcatctgttattttttgatgttttaataggagccattctgagtggtgtgagatggtaacacattgtggttttgatttgcatttctaatgattagtgttgctgagcttttttcacatgcttgctggccgtatgtatgtcttcttttgagaagtgtctgttcatctcctctgctcattttttaatggcattgtttgctttttgcttgctaatttgtttaagttccttaaagattctggatgttaggcctttgtcagatgcataatttgcaaatattttctcccatcctgtaggttgtctgtttactctgttgatagtttcttttgctgtggagaagctccttaattagttcccatttgtcaatttttccgttgcaattgcttttggagtcttggtcataaaatctttgtcaggatctatgtccggaatagtgtttcctaggttttcttctagggttttatagttttaagttttacatttaactttttaatccatcttgagttgatttttatatatggtgaaatgaaggggtccagtttcattcttctgcatatggttagccagttatcccagcaccatttattgaatagacagtcctttctccattgcctgttcttgtcaactttgtcgaagatcagatagttgtaggtgtgtggctttatttctgggttctctaacctgttccattggtttatttgtttatttttgtatcagtaccatgctgttttggttatgcagccttgtcatatagattaaagtcaggtagtgtgaggcctccagctttattctttttgcttagtattgcttcagttatttgggctcatactggttccatatgaattttaaaatagttttttctaattctgtgaaaaatgtaattggtagtttgataggaatagcattgaatctgtaaactgctttgggcagtatagccattttaatgattgattcttccaatccataagcatggaatgtttttccatttgtatttgttgtctctgatttttttcagcagtgtttcgtaattcacattgcagagatcttttacctccctagacagctgtattcctaggtgttttattttctgtgtggctattgtgaatggcattgtgttcttgatttggctctcagcttggacattgctggtatatagaaacgttattgatttttgtacattgattttgtatcctgaaacttggctgaagttgtttaccagatctaggagctttggggcacagagtatgggattttctaggtataaaatcatatcatctgggaagagaaatagtttgacttcctctcgtcttttatttctttctcttgcttgattgctctggctgagtcttccagtactatgatgaataggaacaatgagagtggacattcttgtcttgctgtagttctcaaggggaatacttccagtttttgcccatttagtatgatgttggctgtgggtctgtcatagatagctcttattattttgaagtatgttcctgttccttcaatgcctagtttatagagggtgtttttttttaacatgaagagatgttcaattttattggaagccttttctgtgtctgtaagatgatcttgtggttttgtttttaattctgcttatgtgatgaatcacatttattgatttgcatatgttgacccaactttgcatcccagaaataaagcctacttggtcatagtggattagctttttgacatacggctagattcagtttgctagtatttttttgagaatttttacatttatgttcatcagggatgtatgcctgaaattttctttttttcttgtgtctctgtaaggtttttgtaacagaatgacactggcctcatagaatgggttaggaaggagtccctcttctcagttttttggaatagtttcatagaattggtgacagctcttctttatacatctggtagaatttggctatgaatccatctaattcaaggttttcttctggttggtaggcttttattactggttcaattttggaacacattatcagtctgttcatggtttcaattgtttactggttcattcctgtatgtttccaggaatttatccatttcttctaggtttctagtttgtgtgcctggaggtgtttgtaatagtttctgagggtgttttgtgtttctatgggattggtggtaatgtctcctttgtctttttttttttttttttttttactctccctgtgtcgcccagccttgagtacagtggcaggatctcggctcactgcaaccttcgcctcctgggttcaagtgattctcctgcctcagcctcccaagtagttgggattacaagcatgtaccaccacacccagctaattttttatagttttagtagagacaaggttttgccatgttgtccaggctggtcttgaactcctgtcctcaggtgatccacccaccacagcctcccaaaagtgttgggattacaggtgtgagtgactatgcccagcctcctttgtcacttttgattgtgtttataataaaggttttttgattgaatgaaggaatgattgaataaacgttaatttctaatatctgcctcacaggattgttacaagcttaaagcatctagtatagactgacagtagtaagtactgaataaacctcagcctctaaaacctggccccaatctactgtctccccagggcccatccccacacaagcacctcttctatatgtgtgtcaaactatactagtcactttctctaatttactagatgtactaggtgctgggcattgtgctaagcggtttatctgcatttatcagctaattcccataacaattgtggaagctaggtactgttattattgccatattagatgtaaattccatgaggacaaatgtatttttgcttgttttattgaataattgaataaatgaatgaataaatgaatacctatttcatgaatgcagaaattgagtctgaaagagattcagccatttgcccaaagtcacacagataataaatggtaattcaagccacattgatttcaatatccatgcttttaatcactttctcacaccctctcagctgggagagtggtgattaggtgtttatcagacgaggtgctaattcttatttatcccctagaccttggtaacaaggtaacaaagacaaacaaacaaacaaacaacaacaaaaaacagagactgtatttattctgactctaaactgtaagatattcttttttctcctaataaatcaaggtttatcaacagaaacatttatttttatgtcaacaccaattagtcttccctgtggttctcaaagcaataaaataatttgttcaggcaaacccagctaaaaagacaaatatttctcctttttgttagattttgattgattcctattttatctagatcacagaaattatgctaaggtagaaattgttttttctatagcaaactaaagaaaatttgtaattctgatgttcttctaagtgatgctcactagttgagaagataacaaagaactactacatacaattccaaataaacccaagcttacataactattttaaaaagcaaacaattcaggtgaaaatactcatatgcagtcaaataaattcctataggatgaaccaatttttccattattaaaaactctcaacaaacatatgaaaaaaagctaaccattactagagaaatgcaaatcaaaaccacaatgagataccatctcacaccatttagaatggcaattattaaaaagtcagaaaacaacagatgctggcgaggatatggagaaacaggaacacttgtacactgttggtgggagggtaaattagttcaaccattgtgtaagacagtgtggtgattcctcaaagatctagaaccagaaataccatttgatctggcaatcccattactgggtatatgtccaaaggattataaatcattctactataagaacacatacacatgtatgtttattgcaacactattaacaatagcaaagacttggaaccaacccaaatgtccatcgatgatagactggataaagaaaatgtgacacatatacaccatggaatactatgcagctataaaaaagaatgagttcgtgtcctttgcagggacatgaatgaagctggaagccatcattctcagcgaactaacacaggaacagaaagccaaacaccacatgttctcattcataaatgggagttgaacaatgagaacacatggacacagggaggggaacatcacacaccggtcctgtcggggttgggaggcaaggggagggatagcattaggagaaatacctaatgcatgtggggctgaaaacctagatgatgggttgatgggtgtagcaaaccaccatggcacatgtatacctatgtaacaaacctgcacattctgcacatgaatcccagaacttaaagtaaaataataaaaaaaaactctccagtgtttgcattatacccataatttcactgttaatgttgatataaacactcagtgttccatgagcactatattgttaagctgtgctaatagaaatcaaggaacagagatgtgccctgtaatatatgatactgaaacccatgattcctatatgtgcaaaattttatgtaaagaaaaaaagtaagtaagcctctccctataaatattcattattatcaacaatcagatcttagtgactaaaagtggggtttgcaactaattatgtcagtgccaatcttgtatttacaagattgtattacactactttgtatctcctggggaataaatgagtattaaaaatacatataaccgtgaagactagtcattctaaagattttatttccaagtaaatatttttgaatatctactatgcatttggcattcttctaattactggaaatacaatgttgaaaaaaaattgacctctgctttcatatttatgctcaggagggaagttaataatgataattctatccaagaaacatttattgaatggtatcatatggggaactttaatgaatgttagtgactttaaatgaattctggactaaaggaattgaataagcaaagataacaagctgggaatatgcatttcgagtactgtaaatggcaaaaattccaacgtaaatcaagtgtgaaacatatgggtgatttgtccagagactcgagaagtagttgagactcaatcctgaaaccattcaaatgccatgctaaaaagttttggttttatgctagaagcaatagagagctgtcaaatatttaaactgacacgtttacattaggactgtaaaaatgtaattctagcaatagtagtccagagagtgagagcaagaatcaagaatgtagaaatataaactctcatttttaaaggttatagatccaagagtcatttctaggtcacatcgatagactttgactatatctaattagttagatatagacatgagattagagggaggagcagaataaaggatgatgccaatgcctctagccaagtagttgaaaaactgaccaacacagaaaactcaagagaatgatgaaactcaggacacaagcagaggaagttagtgagtttgattcagggtatgtagcatttgagaagcaagcagaagatccaaacagaaatgacctgtggggccttggagcttcagaagtcaaataagcctagtgacctaggtttagcataaaagtgttagttgaaataatgtacgctaatgagactcccaagagatagactgtagaacataaaggaaagcagaagacagcaactttggagacaccaccacttcaagataaaagaaggtaaaagaagtgaatcacgggaggtacaacaggggaagactaaggcaggcagtccaccagagtcttacagcatggagtcatagcagtcaggggaggagtttcaggaaggagggctatcagcaccatcaactgcttcagagagattaaaaggatgaccatgattacttgttacctggggatcattacttattgaggcaaatgtacttactattgtttgattaaaatagtcatctggggatatacattcacacttgagtaataaagctgtcagagagctacaagtccctggattctataggattgagaagctgcataacaagaaaaccctacctcttcatgttccaacaaacattgctgtatagaaaaaccactcattagcaaggccttaggcaactcacaagacagcagctatgcatgtgaaccttgagccggctatttcataacaatacaaaaatagttaccagccacctacagtatatttacttttccttttcttttcatattgattttctcccacacaaactgcccatgaagtaggaaggagaagtcagtaggtttacatatgtggatattagaactcatgagggctaagtgacttgcccaggtccccacagctagcctgtcaggctaggaaggctcaaaagtccctagcaattatcctacctccacagatactttcagttttaggaagcttttcacaaagtcatggatgtcatcctgctaccttagctgactaaactaatactaaactaaactgaaataactgactaaaacatagatctgttccaagttgaagaacaccaaatagggacatcctttattgactggtcatccactgtctagacagagagaaggagatgggggaaggaagaggaagagagaggggatggaggaggctgatatttataataagtcccgttatgtaaggtcaccagggtatttctcttcctgcccattaatataatagcagaaaagggacaataataccagtcactcaacttattacagagctggtgggaacatccagacaattcaaaaagaaaattctagaaaatagcaacctctaagtaattcagaaaaaaaaaaggcagttataaaagacataatgtgattacccagtagtgactttccattgtggacttctgggcataataagaactggatatagaaccatctagacaccaatagagtctcataagaaagtaagaaatacatatcactttcttatttgtcttcctcacttagatgaaagtgataccagcagtaggatacaaaagctaaatccatcaagctaagtttgtataataggtgagcagagctacaaagagcaatttagaaatctcaaggtaaaagtggtagacaatgtcatgaaaaggaaaaagaccacttaaaaaatgtagaccatttgtagaagaggattacataaagaaccctgacactgaagggcatgcaggaaagagaagcctgagaaggaatggtccaagagacaggaagagaacagtgacagaaggccagagagatttcaaacagtatcagttattgctctaagatcaagaggagctgatgactcaaaatacaccctgggatttgtctggcaggtaatactcaacctcagtgaagcatccagtgaagtggtggggagaaagccaaattaaactagagtgaagaataaatgaaaatggatggagtggccacatcaggtgtaaaatcctccctcaagatgtttatccttcaaggaaagcagagagagagagatgtggaaagaatggctgaattgcaaaaaggatgttttatgataggggagaggttagcaagggggaatgagttagaggagaagaaaaagctgaaagaaaaaaaagctataaagaagatgggtgggcaaagggtcctatgtatatgaggaggagttggccctagacagaagaagggacatcggtgggacagaggctaagaagttagaacaagcatcccaactggtcagtttacaggtaaggctcctaccagacgcccttctctgtaaccaatgagccagttaccaaataaatgggactagggtagaggttggtaggcacttaggtggggaagaaaagctttggatctgctaaactgagagaagggaagttgtgcctatgataacagctctgatgagagatggggaaagcttcatgagatagggccagagtggataaggcagtttgggagttctgtggcacagcaggcaagatctgatagcccattagatatatgtggctgtgactcagaatactcaagaaaatggctgagggaggaggagtcaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgtccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcctagcacgcagctggagatctgagaacgggcagactgcctcctcaagtgggtccctgacccctgacccccgaccagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaataataaaaagaaatgagcaaagcctctaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaatatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccatacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaatcaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgacaccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtaaactcccattcacaattgcttcagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactattgcaagaacaaaaaaccaaacaccgcatattctcactcataggtgggaattgaacaatgagatcacatggacacaggaaggggaatatcacactctggggactgtggtggggtcggggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaagaaagaaaatggcttacatgaatttctcctttttatctttaaaagcttccccctttccccaacccctttggatgtgtctatggttcaccatagcatgcatatgtcccagattgcaatcccttgctattcctgaataaacttctttttggaaagtctgtctctgctgttattttaggttgacatataaaactagtgacttcttcctactttataaacaatgtgttgggggtgaccaatataaaaagaaaaagaaaatgaaatatggcttacatggttggtaattatttttatattgttatgagatagccaactcaaggttcaggatgcataaatgctgtcttgtgagttgcctaaggccttggtggtttgtctatatagcaatgtttttgaaacatggaacacctacaaagaggtagggttttcctggtatgcagcgtctcaattctgtggaatccagggacttgcatctctctgacagctttattactcaagtgtgaatggatatcctcagatgatctttttttttttttttttgagacagagtctcactctgtcgcccagcctggagtgcagtggcgcaatctcagctcactgcaagctctgcttcccgggttcatgacattttcctgcctcagcctcccgcgtagctgggactacaggcgcctgccaccacgcccggctcattttttgtatttttagtagagacggggtttcaccatgttagccaggatggtctcgatctcctgacctcatgatccgcctgcctcagcctctcaaagtgctgggattacaagcgtgagccaccgcgcccggcagatgatcatttttatcaaacaatagtgaaaacatcaaacaatagtaagaacatttgtttcaataaataatgatccccaaatatcaagattatcttaatcatccttttaatctctctgaagcagttgacagtgctgatagccctccttcttgaaactcctcccctgactgccatgactatgggtcacagtcaaaaaagtttcaaacctactgctttaaggtagaccaataagtagaaagtgacatcctaaaaaaaaaacgaagaataccagctaaggagaaattttaggcattataaatcaagtctatcccgatattcccaattctatctctgatgagttaatagaaatctaatttgatagttttagcttttatatcctatgactaatgtccaatcaactgtctgtattgtgtaactattggtctaaccgtaattcttttttaactgcatcaacctgtggcattgttataaattaaacttttttcttggtttggatttttgatcagtgaatggagtcaaactgtaacatagacataagtattagtaaaaatacggcacttactttgacctttggaagacagctgttctcagaatgattgggttattctcactgatacaattttgggttctaagttttagcccaggttcagtgtctctgacatctacacaattcaatgcagatttatttagttttttatgaagacattggttggattttttaaaagaaattcttttgaagcagaaaattgactccatgcagatttttcactctgttgcacatattaaactacaacaatttgggtgatggaaaaaagcagaaataatttgagaggcgtgggcgaaaaggccaataaggctataaaaatttcgaattacaaagagtcaagagaatattaccaaccttttattgtcagagaaatgaagagtcttacttgtgcccttgaacatgaaaggtggggttgtcagtgaatttcaagagcaattctttaaatagaggtgggtggttctcaatgagacatgagggtggtgtgaaagtggctacgaccttaaaccagtgagaactagatacacacacacacacacacacacacacacacacacacacacacacagcagaaggtagagttaaaccaatctcagttaaaatcccagctccttcacttaatagctgtgtgatcttgggcaaatcacttaacctccagtaagctagttatcttgacttgttagtatcttgggaagataataatagccttcctgagattggtcctagatgtaaataagacaatttttgtcaagtgctcatcaaagggcatggcagaaagtactagctcaatatttactgtattagtttcctagggctgctataacaaagtaccacaaattaggtggcttagaacgactgaaatgtattgtctcacagttctggaggctagaagtctaaaatcaaggtgtcagaagggtcctgctccctttgagactgtaaaggaaagatctttccttgctgtcttcaggttctggtatccccaggcattttttggtttatggcagcataactccagtcttcacatggcattctccctgtatctcttcacagagtcttcccttctgtggatattggtctctctctgtccaaattgactctttttaaaggacaccagtcatattggattagggtctaccctaatgaactcattttgacttgattacctctgtaaagaccctctttccaaataaaatcacattctgaggaactggggttagtacttcaacttatcttttgcaggggtgtgggaagaacacaactcaccctataacaattatttatgaaattatcttgctagaaatattctgcaggagatacattagtacatgaagtacttcaaaattgtagaatatcattctctagtgattcattttctgtttcttttctttttaaaggaaggagtactcagtcttttcaatggaatgacataggtatgaacttaatgagtatccttcctgcgcttagctgaatccggaaaggcaggatattgactcctttgccattctatagattcctggtcttgaggcaaagaaaactggcacaggcctttgcgactgggcctgcaaaagtatatactacacagagaaagggcatgtatccttactttgaatggtgtgctaatcgtctaacaacttcaattgtactaatcacgaatggaagagaacggctctttaatggaacttcaatgaatataaattacatacttactaatcaaaatgaatccttttcagctaatttctttttttctccttaaatgtcttgagtgagtaatataagcttttgttattttttttggccagttttctctgccataaccctgattgtaactccactctcatcatggaacttaatgcccaaacactacacattaatttctatttcttcatatgttttacaaaatgatatatatttttgccccaaactgcaacatgctatgaaggcttaatattctaacattgcaatcatgggtacaacctaaaaaaagacttcaaattagttagcaaaggaaataaaaataggactctctggggacagaatgcaggccagtaggggatacgacaccttggtgggggtttttagggctatgttgattcattcaaatgccttaatgacctcctatgacagaaccatgtggcagagaaaaaagattcatatgccaatgtgaagggagaagaagaatcaaaatgaggaggaacagattaaatatttcacaatttaacaagatgatatttaaggcacctaatttcttgccttctaaaaactgctagcaaaatgtaatttcttgatagccaaaaaaaagaattcaaatgtacaccagcctcttgttacactataaaaataaggccaggcatggtagctcacacctgtaattccagtactttgggaggccaaggtgggcagatggatcacttgaggccaggagttcgagaccagccttgtcaacatagtaaaaccccatctctactaaaaatacaaaaattagccagacggggtggcacacaccggtaatcccagttacttgggtggctgaggcacaagaatcacttgaacctgggggaatttgcagtgacctgagatcgcgccattacactccagcatgggtgacagagtgagaccctgtctcaagaaaaaaatcatgaaaaatttaactataaatccagacttcataaagcaaacatattttccctttgacagtattaagtaatttagagatttatttctaaatttagaaatttatttctaatttgtcctcaataatagtcatttctcactttgtaatttgtctttaccttggttttctaaaatagtgattaaaaacaaataattacacgtgctagggatgcacttcttaaagaaacttaattttagattcagccccattgaggacctgctgtgtttgttaagtgggcagcagtgatggatgaaggccacacggtggcactataagcaatgggctactgatgcaccttttaatcaacatctactctaaaaagtgagccagtccaagtagctttgagaaaactggaaaagtctgaggctgcaatgcagaataaagatgaataaagattacataaatgaaaataaagcagctataatcaaaaccacactctaggccatctaccaaacctaagaagccacttactgtgataaattaattacttaaaaaacaaacaaacaaacaaacataaatgcatgagagttttgctatttggtggactaaaggaaacttttttgtatgttctgggtttcttaatattttttattttgaaatacatggcactgatgaatttatcattgaactgcaagatagccagaaaactaagaattattagttcactagatatagccataacataaacaagtttagtcagcaagtctgtgtaatctgattgtttcagtcaactaagcaaggcaactgactttgacagcttagaaaagtgaccttctagatgaagagttctgaaggtgattggaagctcttatcagaagtgcatgacaaaaccgactcccaaagtagcaccaattaataaaacaaattagcaatataccttctctttaatgcactggtgctcgtatttccttctatgaaattttttctacttagcagctatcaatcaataccaaaacgattatctcttgctgtgcaattgttggacagcttgggaagcgaagtggtttatataaaaatttgaaacgtagacatgaatggaaaagaccactataatttgaaagtggcttactgctaccctgattttagactggtgcctaaggaaagagctaaaagtgatgcatagcaaactgcatgaaattgcttgctcttgtaaacagattgtagcaacagggtaagggaaaacttagactatatattaaaaatatagaatgaatacctttctcatgataccataccatattgctgaagataggggtgaatggcatacatatacttttaactgagtgaaaacaactccagaaagaaagaaaacataggttatatctgtgcctccttggagcattttcaaattataggattgtattctttatgtttttattcttgataaatttgcacctaattgtatgtttcagttcccaattaaatcaagagctccttgggatatataatgtatctgctaatttttaactcctccatggttataaaaatcatattaataaaataaaagctacacatgttaagttctcattagatgccagatattgtgataagtacagtagatagcattatatacataaacttcaccaaaaaacccccatgagattaggactaatgctctctctattaataaagagaaaacagaggtataagttaatttgccaagtactactacacactactaagtagcagagctaagttttgaattcaagaataccttctaccaaagctcccagctcgccttgtagagcagagattgaagcatggtggttaacagccacagtgcctgaggtctacccagctccaaagctgactggctttatggtctttggcaagttgcctagacattctgtgtctctatgtagttgttattataccacccagcagttcataaagtagaaattcaaaaactcttactgagaaccttccaacttctctcagctatctccaaccagttgctctaatgaacaaataaatcaattggcatttgatataattgaaatcaggtgcatatttgatttttccagtaatggtcttcaattgcttctgacagtcactgtgctgtgactattatcacttcaggtgattatagttaatatagtgcttttttttcttcaacaactctactaaaatgtctacatgtcaaatagagttggtaactgaaattaataatgtagatacatagtaaagctttcttgaaaagtgatcatttagagttctgaattttaatattactatacctcattgaaggattgacacaatttacctccagctatttcatttaatctgtgcgttgctgtgatttgaactaaaattacacaaggcaaggaacacaggcataacagaggttcctctcatcttcaggggactcattgaaacaaaaaaaaatcagtaagggataatattctcttctcacttgcaatggcattttgggcattcagcctctatatttagagaaattcattaattctttaatcagtggcatggaggcaatgcaagaattctgaactcaacgttaagaaacactattttcatccaaactttgcactgtgtatctcactgaacaagtcttttctatctgcctcagtctcttaatctgtaaaataagaggatttctattgttgaactttaaagttttaagaattgatacagtacaaagacaaaaagtgggattgcaagagttttataaattgctatgtgaagagcagaacaatgcgcaagtgcttgcatttgcttctttaaagcttacacattatgttgcagaagggtggaattgccctaaaaaacataagccaaagtgatctttaaccaaaacccttttatctagaacaagttctctcaaataggaagctatcaaactatttcaagcagcaaggaaacaaggcaaaaaggatccttttgctcactttctgagtccttttttgtccaaaagtagagtaagattaaccccaccctgttgtatgcaactacaaacactgcaaagaatagtgatagcactaaattaccatgaccctgtaggatcgggggaacacacaggtaaaacacacctgttatcatcttccacctggagaccttcaggaaagtggggattccagatcctaacaccaggctaatccatccttgaatcccttccccattctcagctttgtcttctctcctggcacagagtcagccttcaggagccatgaaactagagaagccgaggacaaacagaagcatctctagcagcagggtcaaagccttttcacagtctctgtgtgcctgctctacccactatgaacatgtttcatgaatgttctatgttcttcctcttagacacaatatccatagtgattaaggagctggttccagtccatattccaccacttactactcatgcgttttaccctctggtccttgattttgtcttcttaagaatggggataatggggccaggcacagtggctcacgcctgcaatcccagcactttgggaggccgaggtgggaggatcacgaggtcaagagtttgagaccagcctgcccaacatgctgaaaccctgtctctactaaaaatacgaaaaattagctgggcgtggtggcgggcacctgtaatcccagctactcaggaggctgaggcaggagaatcgcttgaacacgggaggcagaggttgtagtgagctgagatcgtgtcactgcactccagcctaggcaacagagtgagactccatctcaaaaaaaaaaaaaaagaatggggataataatggtatatatctcactagatgatgaagattaaatgatatagtgcatgtagagtgcttagaatggtgttcagccatacataaaagctaccataaaatgttaactttgaagactaaatataatacttagtgtccagtatttctcagcaaactttctgcaactacatccttcaatgtgttttcacaaacagaaatagattaaccaattgatatctacttaaatagtaaaactgcaacaattccatgaagaccatgtcccccaaatatgtcccccaccagcctgcagtgctatagccaataccattctcttgctgctttacgagggcagcttttcttactgtgagaatcgagaggcagaggactctctaacccttaaggggatgaagagggaaaagggtaaagaaccaaaggcctcaattacctactccaagaatgtcaattacatattccaagtttcctaatcttctctaatatttgctaaatcaagtatttttccaaccattcaattaccatagaacaactattaattgataccttacacagtcactgttctgagggacgttcttattgaaatgtttaactttgaaccacatttttcttatctcaaagtggggataatgatacataccaaattgggtagttacatataataaagaagatgatgtaaatgaaagtctctaccacagtgagccactccacactttcatatccctgcaggagtatcttttctcatcagaaataaatgttttattaaattgcaggatgagtagaaaacaggctgctgtctctagaattattttgttcagaaacaaatattctatgcatgactattgcattaaaaattggggtcaactctcttcttatagaattttaaagaataaagacatttctcagttgtgttttaatttttatcatttattatgtttttattttttgcttaatactttgtgttatcataaaagaagaaccaggcgatattcttttattagcttttcaatggctccagaacattccttcaaagaagtctttgtaaagtctttcttccccactgtcacagtccatgcattaaaagctgaccagctatgtaaaattaaagtcagaaagaggagagactataaacacaatttctagtgaattaagtgtgagaagtcactgagtaccaccattgccacacacaaaatcttgtgcagaagtgtcttctcatgtcttctaagttttgtgagaatcttcactctaaagctctgatgaaagcaacccaggcctggatcaataaacacatttactctgagccttctataattatcctgagaccaggagttcaataatgtcacccatgctcaggcttggtattcacagtcacctcttgatgcttccatggttcaacccaactctgtggccaacacaaataagaaactcttcgatctaccttgtgtgacttctcagagaaagagtttgttcctgctatgctgtaaaggagtacatgctatcatcacccaccttgaaacttcagtggtttccctagctttaatattctaagacactgtaaacaaaattcatgcattctattactgctttccaaattgtgtagaggtaaagcaaattcctctctaccttcattatttcaagactaaaaaagcaggcttcataagcgtgcaacctgtgcagtcacaagggaccccatgcttagaagagtcctgtgcttgatttaaagtcctcctgtcccaggcttaaaattcttaatttttgaacaagggtcccagccttttcattttacactgggctctataaattacgtagccagtcctgccagagtgtctgaattgtctaactctattctcatgtggcagtcatcttctcttcactgtctgtggcactgggaataagacatgaattaatgttggaagtcaaaaggatgagccaagctgagggccacttagagcagctgtggaaagcctggtcatatgacaggtatacaggcagcaagaaatgtccattgaaactgagtcctctgaaacctttgtgaggtcttctgtagtcccgttatttttactttgctcaaaactcatcagggtttctagatgcatcaagatatgtgtgttatctgtacataaaaaatgtatcacttctgtctgcaaaatttcagtattatatctcagagaggatggcaaaataggcttgcctgctaactgcgttcaaagatccacatacacatgctcaaatttttggtgagatgagtctgattcagttgtattactcagcattctgttaagtggccttcaatactgtcatacagtctaaagcaattgatagttttagtgcctctattacatcagaaaatacacaagaatgacaatatgagcaatctactctttttcaagaaagataagcaattcactagagatgtggaatgctgtttcctaaagcaatatcaatcctggatgtggttatgatgaaaagctagtagtcatagcacagtatgaacaaagtccagaaagaatactctgcccagagtcaaatctttctatcatactcagaggcgagctacaaataagaaaggaaataaacgctcatttcctctgtaaaacagaggatactttttctgtaaattcctttatgcacagactagggactgatgccattgacacagtggggaaatgactccactcactgacccactggggatgcaatcctaacagttatacttatgtgttagcaaggatcttcactgcagttaatgaatgtcccaattttgagagagaatagcttttctggttggcaggaatcaagaagtgcatgctcagttagtcactgctcctcatctgaaattccttcaacctgaggttaggagcatttatctaaataccaggagtccactggaatcctccagcctcacctcatgccagaaagagtggatcaatgacacattctggtcaagacaaaaagtagctggaaattaccatcacatcatagcactgaaaaaaaataaaaacgaaaaaccaaaaaactccttgagaattcccagcttatcacattatctggccatgaaagtttattcatattccaatattttccatcagatgcctcaaatcctttaagaaacaagatggaaatgaagggagagaagggggaaagagaatgagagagaattgactatgtgacatttgaatccaacctaaaactcacaccactcactacagtttcagcttctttaaataataataatatgcagaaccaacatactttttcctttgataagcctcatcccagcaccaacggggataggtaaggatagaggtggaataaggattaacctagtacaagctacatgattagtaaccatgtactcttttcagaaagaaacataaattgtttcaatcagataactgcctagtcaatgaaaattcacttgtatatggaattttctgcatatcggactttgtggttcctgctttaatgttacaattttaacactcacttatttttgccttttaataatgtggttgatcaataacagagcttaacgattttcattttcaaaatttatagcagtaatttttcagagttacaagtatctgggggggatagtttcaaaaagtatttaaggccaggcagtggctcacacctgtaatcccagcactttgggaggctgaggcagggggatcacaaggtcaggaattcaagaccagcctgaacaacatggtgaaaccccatctctactaaaaatacaaaaattagctgggtatggtagggtgggcctgtaatcccagctactcaggaggctgaggcaggagaattgcttgaacacaggaagtagaggttgcagtgagctgagatcgcaccattgcactccagcctgggtgacagagcgagactctgtctcaaaaaaaaaaaaaaggaaaaaaaaggcggagggtagcgtggtggctcatgcctgtaatcctagcactttgggaggtggaggtggacagatcacaaggtcaacaaaaattagctgggcacggtggtgcgctcctgcagtcccagctacttgggaggctaaggcagaagaattgcttgaacccaggaggtagaggttgtggtgaactgagatcatgccactgcactccagcctgggcaacagagtgagactccatcttaaataaataaataaataaaataaagaacaagtatttaaaatatatcttggctgggcacagtggctcacgcctgtaatcctagcactttgggaggccagcatgggtagattacttgaggtcaggagttcgagattagcctggccaacatggtaaaaccaccatctctactaaaaatacaaaaattagctgggtgtggtggtactcacctgtaatcccacctactcaggattgggaggctgaggcaggagaatcgcttgaacctgggaggcggaggttgcagtgagccaagattgtgccactgtactccagcctgggcgacagagtaagactctgtctcaaaaagtaaaatataatatattgggccgggcatggtggctcacgcctgtaatcccagcactttgggaggccaaggcgggcagatcatgaggtcaggagtttgagaccagcctggccaacatggtgaaaccccatctctactaaaaatacaaaaaattagccaggcgtggtggcaggcacttgtaatcccacctactcgggaggctgaggtaggagtatcacttgaacccaggaggcggaggttgcagtgtgccgagaccacaccactgcactccagcctgggcaacagagtgagactccatttcaaaaaatgataataataataataatataccttatatttggaaatgaaaatatatatactcttttcatatgcaaattatagaaagtcacatcaaacaactttttcatggctggtcaggatagaattcttctagatttttatgatggcatgagtttttaagtgctgcaaaacatctatataaagagcattatcttcttccaataagttttttgagatttctttttaattgggtacatacttaagggaagagatttgggccataatacaatctcctattctcagctccagtccgacaagagaccctaattaaatttctaactgttctctaaataacacatttacccttatagtaaaactcatttataataatgctttggggggagtacctgataacctcttagaggcttcctaattataaaagactaaataatatattactgcttttttttctaattctaaaataatacatctcacataatcttaataaagacagtagagataaaaatagcaccaaaaaatctacagatcaatttcattatccatattaagtgctaactgaacccagcattatatcaaaataatacactaccaccaaacaggattcatctcagaaataaaagtaatacaagaccaaagtttaacaaagttttcaaacagtatataaattaatacagtggaaaataaaaattgcccagaaatcagatggtggttaagtgtggaaaaagattccagggcatccacttgctttaactgtcaaaacgcctgcatcaaaaacacttgaatcaaaatgttctatgtatatagatggtaaacagaagttaccaaaatatttctaccattcatgctatttgcctcttcagtaagtatccgcctcctacctattcttaatccatttccactaatgtttctatgtctaatggttaacagtacattctgtataaacttttattccaatggttctctttattcttaaacccttgtgtcaatgatttggccagagatcaatggtcatcagaagatagttaagtagctgaagcactcttttaagatacttcagctaagcatgcttctgatttacataacaatttttaaagatccctcagtttgacataatagaacattgatctatccaaatatcagccttaacaaagtcagaactatgactgcctataacctcaccccttagcatgttgacttgattccaacataattgagattgtcaaagaacatgacaatatatactttacttcaatgatagctggaaaacagatattcttttttttctcgttttttcttaattcttaactctcatggctgaaatatatagatgattctccgcaagcagaaacatggtacactccactatctgtgagaagacaagcaaagaagcacttgagacttaagttacaccactgactgttgtttctaggggcacttctcaaccagaattttcctactcataaaatggggctaccattgtggttttgctcaccaaggaaatacagagctgaatggaaccaccactgtcatctggccctctgcccacaggcagccaaacatctgcgtggtagagagtagggctaggggacagtggcatttgaaggcacagattcaactctcagctgtgtggttttctaattgtgtaacctggagcaaataattaattgtgcaacctggagcaaataatttaaatttaataataatttaaaatctcgaaacctctttatttttcttctttttaaaaaaaaaatgtttagctctaaaatgagagtttgaataaagtaatttttaaagtccccttgctttctaagattttcatatattcagtgtgcatggttcttaaaatttttctgtaaggattgataaaataaggcttgtgcagcctttatgtctttaacaagctcaatgtgcaacctgattatctgtgacttcattgatataatcttccaatagaatattgcatttcctattgattgtttatctgtatattttggcatattgagtgacatcatttttacaactcatcaaatgggggtactctttactttgagctcccctcttcctaagtagtaggaatagtcaatgcattgtttatgaaaaatgacaagccaggaaaaaggagaggaaagaacaatgagtttccagctccactattaacttcttgctagacaagacagactgcagttacctcatctataaagaaaaaaatttaacaattcttacctacctcataagaatattgagagaattatatgagttaatatatatgtatatatgtgaagattagactccgcaaatgtaaatttttttttttttttttgaggcagagtctcactctgttgcccaggctgaagtgcaatggagcaatctcggctcactgcaacctccccctccccgagcgattctgctgcttcagctggccaagtagctgagactacaggcacccaccaccacatctgactaatttttgtatttttagcagacacagggtttcactatgttgggcgggctggtctcgaactcctgagctcaagtgatccatccgcctctgcctcccaaagtggtgagattacaggcaagagccactgtgcctggcctgcaaatgtaaattttgatgttatcttaatgattgatgtttccaccagcttctaagagagtaaacataaaaagctgtatacatggcatgtatgctaccatcttccagttaactgtctttctaaacacagcaccagacccacatgtctgtgtgttggataaactccctgcctttaatgtccataatgagcatgatacaaacattttacatcattgaaccacaaaaagcacagagtatttttccaagtttttttcctagggataattgtgaaggatcaccttccaggtgaatggctgcgaccctgtacttctagcacaaatagaactgtgttttatatactgatcctagtgaagatgtaatttcaagaaggagaatgacttattacgatgtgcattgctgagggaacaaaaacccttacttgacccaatgatctgtgcataatcttccccttggtaacaatttgaagacaagaatgtaagaagcagtttggtttcccattttcttttacttaagaaatccatgctgctgatcagaagtttgccataatttgtagttttgttgttttaaactggatgggtcttttttttaattacaaaaagaaattcatttcaaaagcataaggggatatttacatttaaacaaggtgataaacaggtgtcttgcaaaagaaaaaaaaaaccacagtgttaagtttttcattcaaattcagaagcaaaaataaccgaagttgtgcactattgtcttaggaaagggaaagggaagagtgaggggtaagggaacagtcaattcagtatcaaacttgagagagtaaagtcacttctgctcagctgtgagtttacaaatatgcttataaggaggaaaagtggaaaaattatacttaatgttcaaatttatttagctgtagtctcaacacaatttctgtagttgaaatggctttgggccactggctgatctatctctgaggtccagagtggcgggtcaattttcaaatggcaattttatattcctttgtctgttcagattccaagggagtttaggttcagcttacagtcttttggaatgtttagagattattgccaccaatccatagccaagctgaccaacttttgctcatttgtatcattctagcctttcagaactattttctccatatgcatgtgcagtaattctaacaaaggaattttgcttcttctgcagtgagaggtaatggtaatgaagacacctgctttggaatcacaaactattcctaaaaaaatacatcagactactagaaatgtcattcaggcgtttgatttgaatagcaaacttgaggagggaagattaactgtgaaacaaaaatatactaaacattcaaatgcagaacaaaggctctatgctactaaaaatgcccatgacattaaatactccacaaacaccacccaccccgcatctgctgttttaacctaaaaattctattggctaacttatacaataattttgattaataacctgagaagttaaaaatcttgaaaatggcaaaagcaaactgagagagcttcccttccttattggtaccatgttatcaagtcactttttctgggtagccctggttatgaaatctccaaattctaaattatactatctcttcctgtagaaatctatacatacatcagattcagtattttggctgtatttcaccaatagcaatctccaatttgtctttgaaaatgcagcctagctgggcgcggtggctcaagcctgtaatcccagcactttgggaggctaaagcaggtggattgcctgaggttaggagttcgagaccagcctggccaacatggtgaaatcccatctctactaaaaatacaaaaatcagctgggtgtggtggtgggtgcccataatcccagctacttgggaggcagaggcaggagaatcacctgaacctgggaggtggaggttgcagtgagccgagatctcgctactgcactccagtgtgggcaacaagagtgaaactccgtctcaaataaaaaaaaaaaaagaaaaagaaaaagaaaacacagcctttatttttagttttaaataacaataatcatgtaagtgcaactgacttagaatccttggctactgggagtaaaaacctaaataacaagttaataacagattcagccccaaaaggataatcactgtgtcagactacccattcctggaatttaaaaaagtgatttatgtcgtgtagtcaagtttcacagcatacatatatacatatatatatatatatatgtatatacacacatatacgcttatgtatgtatgtatattatatatagacatttctattcaaatagtaagggtccgtattcaaaagtttgtatcataatatatggaaaaaagttaagcaagcagtgcaaagcaacttactttctcctaaaaatgtaatgtcattcctacattttaagaaagcaacgtaaatattatgcttttatgacactagacaggaatgttgcaccactgcctagcagctttattaaacaatgaaaacaaaatgttaagatttacagttacccttctccatatattgggcaaaacactaaaacagaggaaagaggaaaatcagtaacttttcaaaactgatagtctttatcagcagaactagactgaatttcactacattttagaatgaacagctctcaacaacaaattatcaacatatttaaaagtaaaagattcacaatttgaagtctgaataatgatattgcaaaaacaactcaatattgcagacgaagcatccaaacatatcactgtgattttaccttggatacaaccatggtctgttacaaaaatagatcatacatacaaaggtataaagaacattaagtttttagctgaaggcagcagtctgtttaaagggacacccccggaaatccaatgagtagtagaatttaagtatattaagctcatgactatgctgaagaatgctgatgtcttattcagtagagtcttccacgactacgatttcttcgtgtgccccaacctcggccccctctactttccctgaaggctcctctcataattaaagttgcccaaattgctgctatatttctcactgggaggattataaatctgcctggcatctcttttttgttctgctgaagatttctggggtggtgaacctgaagttgtatattcactggctctcttttgcccaatctcaaccttttatacaggtttccaggatagtgttactgtgctcttacaagaaggaggaatgtggaagagatccttgattaaaacattgatattgtttgttgctttcaatgcaacaactttaattttgttctcttctgttttctgttcttttctgttctcacctgtttcacctggagagctaagtgaagttgtctgatataaacttgcaggcctcgtgcaaagtattgcagcctgattttgaaatctttgagtttttctgcattcagtttggctgttaagaaatctggaagtttttggcccaactggtgaaaactgtacaacaaacattccacataactgaactgtagtttgggttcttcatcaccagcattccctccattttctgcttcttctggagggaggggcatgtattccaataacttatcaaatagtttccctaaatttgtttctagtttttccatgtcaccacaaaatgaactcatctccaccaacaatttcaatacctccaactgtatgtcaagaccttccactgcggtagtcaagataccaaggttagggagaacctgctcacagaaatatgtcacagaccttgtggaatggacagttttagagaagaagggtactgcctgctgagtgcactgtaagagcctgcccacacactcaggatctgagggattgaaggtctgttctaggtcggcctgttcagccaccaactttacaagttgctgtcttccacttactgtctgtaagctttttaacccagacagtaattcatgaatagaacaaattcttcatgagtcacatcttctaggacgtgtttggattcagttagtataagctcttccacttcctttgttaatacttcatctggtaaagtcttaagttttgtagaaaggaatttaattgctcattctctaacaatgtcctctccttgaagtatttggctgaacaatgaacctaaagtcccttttccatccatgttaaatatactcaacagggcattgttcactaggttaaattctgcagagccatctgactccaaaagttgcattagtatatctgccactcgaggaagattttctccagtggtaaattgaggcagttctttaattgcttgacgtcaaatagatacatcttcatcttcacagaggtctaactgtgcattgatagcagaatcagccaattctgtaaaatgcttaaagaatttcagaataaattgagctgctaatcgtttttccttagtaccacctttcacaccatccagtatcacttgataggcatctttatgctggcccactcgctccgtggtatcggccatgatgccatagttgccgtaaagctcctctaccatcggcatggtgagcgacaagcccagggcctgctcccactatcttcatccttgccggcaccactgccacctcagcacttctccaagcccactacctgcactattacacccaactggatggctctttaaagtgtaaaacaatggaaacatccatggcaacaagccacatcatccggatcaaatcttaaaacaatgggcactctagatctagtgcaaaatgtattttcagtctcatagagacaataatttctgccaccctgtttcagaggttaaaagaataagaatagcaaaacgcccatcatgtcctgtgactgtcctaatcatgataggaatcatgtccaagtgttaagccgagacttaaaaataaatttagagtcaaccactgaaaagaagcaatggacatttataggttcatccaaggatcgtggtcctaatcatgatgggaatcatgtcaaagtgttaagccaagacttaaaaataaatttagagtcaaccactgaaaagaagcaatggacatttataggttcatccaaggatcgtggttctctgtcttcatgacaagggagaataactgaagacttattctgatgcctcactctgggtttggaaataaaagtggaatacctataacaaatttcagttacactacatcacaagtatcactgtgatattaggacaaacaaaattgatgtcgatattaaagcttcgaaaaattaatcagacactttttttaagagaaagaagacagatatggataggttttttgtaaatgaagtataccaaataaccaagcactgagaatggagttaaaactgcccagacgctatgatgctacccaatgctattaaacattgggtggcacctttaaagaaaaggtactgatttcccacagccacttattatatgctatggagagcaattcttccaaaataccaagcacactttttggatggttaaagcccgttccagccttctgatggtgtcaattaattcttgtgaggaatcattttaaattctctccagtgagagagtttgctattatattttagttttatttaaaccccctttcaagaactgtgtctaatagaccttcaaagcatctctgggtagctctaacttacataacctcatttttcaaaaccactcattactttcttcccctcttaacatactctcactccagcttgggccctcccttggggcaccttgctgcctgctttggtaatatagtcatgcctacctttgagactttttctcatttctaaatagagtatgcagaatatgaaaggggtgggggaaatgctcttttgttgattggcaatggaatcagaatctgccagtgaaaataacctacaatcatatctagccaggatattatccacggcacatgtgggagaaataaaaggaaataatggaaaatgaccagaaaatggtttcatttctgccttcaattcagaaaagaagggaaaaaataaatatccaagtagattttctaaatcactacatactgttaaaaatagaaattacaaagtatgtcacagagttatattatatttgaaattctccaacaggaaatatgatgtggcttcatttaaacagcatattccataaattttgctatacataggaaaatgctctaagtaagctgcagggtaatttatactggaaaacctcactttatcactcagtgcaatcaaatgctatttgcaaattctgatttgaggcacaactttttaaagcaagaaaaatgctaaaattagactaatcctcaccttcttttcattctcagttgaggaaaatataataaacaaccataaatttaaaaatgttttgtcagtaaaagcacaaaattgaagaaaatgaaaatattaaagtatctacctcatagctgtatatgtacaaagccgttattattttttaatgatttctaactctctgttagttttaaactttttcttacagacacaaagctcaagtgtggttacaaatatttatggaaagctgaaatgccacaaggcaatgtaatttagaaataatgttttcctcgtgtcaagtaccctctcctcacacacacacacaaaagtattaaacctcagtttatttaaccatctatacatgtatatcaggcccatctacctgttcatgggtcccaaaagtgaagatgcaacagtaggaaactaatgaacatccaccgagtgtccccatgtggtgtgccaagacagacagttgcagacaattcctggctttgcaagcacaagtcaagcgaccctggacacatttttaaaattgctcacattcagtgttctcatccataaggtgagaattataataatatcaacagtgttgttgtgaggattaaatgagacaatatatgcaaagcacctatcacagagtacactcttaaatgtttccattattttctcatttaagaagaaaagaaaacactgagaaatactgcatgctgtcctgatgtctataatttgctttacattccttagcaaagacaatgtgaaagtgtgtgtgtgtgtgtgtgtgtgtgtgtgtgtgtgtagtaggtttaatatgccatcaaggagcagacagttgccctagtgagaatttatactccagggatattcagaaagctgcactcaaaatgtggctattacaagtgctccagagatctttatctgccttcaatagcatggggctttgcaatgttagaaatggatttcactggtgaaatcagtagcttgttaatcggcacaatggattttagatatcaactctgattactgcaattagtcctattcaagatacatgcagttataattttctaggtctctagaacatacaacctacctttgcattaataaagtatgaaaatctagtaagttccaaacttgtttccttagagataagccctgaagttgtttaatcctgccactgggtcaaaggattggtggttgcccaccagcagaaaaccagattctgcctttgaaatattgttaggaaagttaggattagctaaaataaagagagcttgggcttcatgaagcttactgaatagagtatatgaaccatttgacccaacttgcccacaaaactttgtttaaataaacatctttatgtgtggcaggatttggtctatctgctttttattttcattttttataatttctacttttattttagatttgagtatataggtgaggtttgttacatgggtatattgtgtgatgctgaggtttgggatatgaatgatcccatcacctaggtactgagcatataacccaatagttagtttttcaacacttgcccctctccctcccttccccctctagtagtccccattgtctatgggtgtcatttttatgtccatgatcaaccaatgtgtagctcccacttaaaagtgaaaacatgcattatttggttttctgttcctgcattaacttgcttatgatgatggcctccagctgcatcatgttgctgcaaaggatatgatttcattcttttttatggctgcatagtattccatggtgtctatgtatcacattttctttatctaatccactgttcatgggcatctaggttgattccatgctttgctattgtgaatactgctgtgatgaacattcaagtacatgtgtctttttggtagaatgatttattttcttttggatatatacccagtaatgggattgctgagtcaaatggtagatctgttttaagttctttgggaaatgagatctgcttttattaaaaccaaatagcaagattataggaaagtagccagcttccaccaaattcaaactcttttgaagctattataaggtacctaggaggtattatgaataacctagaagtcgtgtggtcgaattggcttaggtcagtttgcatcatgctagtgtttattttctagttaaaaaattatgccagttacaaaaaattatatcaaaaattagaccaatggttgattaattccttgtggaaggcatgcatacactgaataaaccaaagggtggaaataaagtgaaattagaaatcaagggaatgcaattttaaaaatgattgaagctgataaaagtttagtgagttcatatactgctactggcattatgaattaatataattttctggagagaaaaatgagtgaaatttatcaagagcccttaaaacaaacgttccaccaataagcacatgaaaggatgatcgacatcattagccatcagggtaagacaaatgaaaaccacaatgaaataccacttcacactcactagaatagctataattaaaaagatagtaagaagtactgacatgggtgtggagaattcggaaccctcatacattgcaagatgcaattcaaaatagtgcagctgttttgcaaaacagtctggtagttcctcaaaaggttaaacactagagttattttatgacccaacaattcaattcctaggtatatatccaagagaagtgaaaaaactatgttcacacaaaaacttgtaaataaatgttcatagaagcattattcataatagtcaagaagtggaaacagcaacaaatatccatcaactgatggatgaacaaataaaatgaggtatatccacatggtggcacattactgggccataaaaagaaatgatgtactgatacatgctacaacatggatgagtcttgaaaacgttatgctaagggaaagaagtcagtcaccaaggattacatattatatggctctatttatatgaattgtccaaaactggcaaacccacagagatagaaggtagactggtagactagaaggtaccactcctagactggtattaggagtaggagagctgggggaaatggggagtgactgctaatgggtatagggtttcttctggggtgatggaaatgttctaaaattgagtgtggtgatggtttacacaactctgcaaatatactaaaaaccactgaattaaatggagcattgtatggtatgtgaattatatcccaataacactgtttaaaaattaatgtttaaatccctggactcagtaatcctaagcattagtttgaaccatataaaactgcagatatcggatcatttttgacctatagaacagcaatttaatagttcaacctaacagctattctaagacacagtccaagacttatttgtaaagatgtcaatatttgtaattttgtaagaatgtgatttttgaaacaacctaaatgttaagaaataaaatgattaaataaactattgtataagtacatggtggaaaataatgcaaacatgtaaattacatctttgaagaattatttaaagcatgataaaatactgtgtgtactactttatgcaaacttttaaaacatatatttatttgtaggtaaaaataaataaatataggtaaataaaccaagaatttaacagtattatctctgaaagttaggattacgggtgatactaatttttcctttttttgtattttccaaattttctataacaagctcatattacttttaaaattaggaaataatcttatcaccaaagaaaaggaaaaaaaatccaagaaaggcagagatacccaattcaaagatagacaaatatacttggattctattaaattttacttttcatcagaaaggaatttaatttttaaaaattcaaattcaagtatttcagcattctaagatgaaaagaagcaaccttgctcttttattcaaataatgctaaactagttattcaaagaagaccgttatccatcttaatttgaaatccccagtaaataacaattcaccacatcccattctagttctttaataacaattttgcctgccaacaaatttatttctaatctacagttgcaaattgttctctcctgtccaagtcctgaataaatcagagaagagtttataagacagttctttgtcattttgcacttttagaagtggcttaactaaaatactgtttcaagtcctgccagcatcaagagctatggatgtatcagtcccttaaatcagaacgcagcaagctctccttaccccccaaacttttcctcctagatgtgccagagtcctgtctcttcagcactatgatgcatatctacagcctggctatgtcaggttattatcatccagtctcttaacttccccagttcaggggatggcaaactgaaattgtgattacaacttaatactcataagaagatacaacaaaaagttacttaaggtgaacataataataagacaatactttcttgaacttcaagttttagtgcctaaggcagcctagaggggtttccacatactctgcaggatctaggtaaggtagtttgcagttaccaggaacatgaaaaataaatgaactcagtaactgagttgagtcccctttactccaggtgttcacagtttacatgaacacctggagtaaaggggaaaaaaagaaagattctgttgaagagtcagtcacaatttatcatagttattttgagcgacagctctggatcaaatcttgcttcctagtgaaataccctactttactgctagcccttttgatattacctagactaattaagcacattcgtataaataaaagctacagaaaaaaattgaataatctaaattatgaaaattacatatcctggccagacaaggtggctcatgcctgtaatcccagcactctgggaggctgaggggagaactgcttgagcccaagaattcaggaccagcgtgggcaccatagtgagccccatctcttaaaaaattatgtatctaatcactacttggaattacattatatacttatatatttactttgtttgttgtctgttttttatcactagaatgtaaactctgagagggcaagaatttttgtctgcctaattcatcagtttaacttcagcatttggaaccgtgtctcaaacataatactgtctactaagtagaaacgcaataaatagtgaatgaatgaatagttcttccacacaaatggaacactatatagctattaaaaatagtatgcagatcaatgatcatgcaaagtcctccagattcagcactgtaacagtaacagccctataacttactaagttcatttatttttcatgttcctgataactgcaaactaccttatgtagatcctgcagagtatgtggaaagaaatagaaagaaggatgttgcaactaagcatttatcatttccttggtaactcttagaaacataaaaagaggagctagggaagcaggaaattacaaatgccagtatattagccatcaagaagacactggaatttctgctgaaaggggcctgtaaatctacatgcataccaagcattatctgcatttggaatttaaaaatacactatataggtatcatccttcattttgttcaattattgtgttactgatttccttaaattccttaatatttgatcattatatattttctcaataaatgttactcaaaattcaactgcaatcttttggggacttctggaaaaaaatgttaaactataaaatgttaggaaacactgttaaagacaaagaataatcacttttgaaatagtgcctacttaggtctgagatgacagaatttggcttaagccttgaaagaaaggtggaaatgagaattccatgcaattagataagaatataaggaaaagtatgggagtgggaagcccaagacaaaatcaggggcagggtagaccagtttttgttgaatgttaacccctaagctggaccctggcaggcaaatttgcctttttaccctaaagtcaagaagaggaaaagaccacagccatgacaccatggcaatattgctccaatagaaaaaaaatccctgaagtttaacctgagttctggcaggtgctgtgttggtaatagttttcccataaatcttggttgttgttgtttttttaagtttatttatagccctgaaagaacaaaattattgaacaaagtcataaaatacagcagttaatgtcaatgtataacaactaaataattgaatgggattaaattaaaaataaacggcattataaaatttgaagactacagaaaagactaactactttcacttaattccatttctgtcaaaacaaggggggggggggaagccaatgcattccaaccaaagatgttgaattccaaacatacctgtttctcttaataaagaatgaaagtatgcttgacagtattatacatttctttctgcctctgtcttggcagcattttagaagagtgaatgagaaagacttcagttctttcaaggccaggccaatacttgcttcttccttgtaactccaacttcatctaccacagcatctttgccagagtgttcaataaattttatttccattattttattcccactacatctatgttaagattcaattataagaagagaagtgaatgttttttattgataaggcaagaaggttttcagaaaaatgagcaaaataattaatgaaacatatttggagaacttaatggtctctgttttcaatataattcttaatttcatttttctctgaactatattggccttctaaagctattactgaattacagaaactggtttatttttggtagaaagctgcagtgccacttgagttccagattttaaatttttttgtaaacagttggatggattatgataaagaagaatcttggttgtttttgaaccactcagtcagatatagtcaagtgaacacataaaacacaaacaaattggtgaacaaattatagtttcacagtgatcatatgaagcctgggtaacagcttttaaaaggcaaatagtgctgtgagtagatcatttaaatatagataaaatattggaattaatgagttatgggattcaatccaaattattccaggactgaagtcttaatgatcaaatataacgaaatcatgagccatctgccaggacttttaaaacctttttgctaatgaccgacttttaattattattttcatttatttatttatttatttattttttgagacagagtctcgccctgtcaccccggctggagtgcaatggcaagatcttggctcactgcaacctctgcctcccgggttcaagcaattctcctgcctcagcctcccaagtagctgggattacagacatgtgccaccacaactggctaaattttttttgtatctttagagagacagggtttcaccatgttggccaggctggtctcgaactcctgaccttgtgatctgcctgcctcggcctcctaaagtgctcaaattacaggcatgagccatctcacctggccttaattatggttttatttcaacagattcaaaaatctaacttagttgaaatgtaggcagaaaaggaaaaaaaatgaaatgagaacacaaagggaatttttaaataattagttattctttttttagcatttgtgtatcttttataaagacaatggtgaattaatatagaacataaaaagttgcctggcagagttgttgtaataccactattcatgtacataacaatattttttaaaaatattcaaaaagtacctttgaaaagtaccttctgtggaaactattcataagatgacagaagaaatctctttgctcccacgaaattgactttattaagctgattagttgtttgagggttggctattatagtagtactacagcttgcagccatgtctaaaggtaatctaattttttaaaaaaatcagttctatgccagtcaaatcccatgcaagtcatacatgtgtgagctgcattcagtcttctggggccatcaatttgttgccccttctcagcatgatgcagtcaatattcccctcctcactacagtaaacttaaataccttgtgcacccctgacatctcaataatcttaaacattctcctcacactattagaaatgtgaggctaggagtttataaaattttccctattatctggctgtgagtctcaggcctgttgctgataacaaaactccagcttccgcagagactcattagcatcattcaggcaccatcctcaacaccagttggcagagcagcatcatcagtaacaagctcctggaacacagccagcccctcagcaaccaagctcaagttggctgcatcccagctttatggggtggcggaacatgtcggcatgaaggagagcagcagggtaaccaaacactctgaatcatgagctgaagagaggtgaccagggctaaagaaacctacagagattagccaaagaagaacttcaaaccacagctgctaatacattggctgttggaaagtacctgcaataaacatatcatactttatggaacactgtaatatgaaatgacacttttagggcagatgtataggaacctgggaaggcagataagagcccttgctcttttccatttcccaggtttatgctggcgtgcccacacatcttaatagatcacaaatgtttgctcctatcgaggtctcattattttcttcttcaaaataataccttccatcaatcacccaggaataacaaagtaatgacttaattgaatgcaaagagtctactcataccacctaaatcagctagtttatacatattgctgaaaaataggaatatttgtttgaaacccacaaagtgaaccagaaaattccgatcatctctcctgcatggtctgcctttgtgtgtactttcaaagtgaattatcaaactagtaatttgtcagtatggaacttaaattattaatatgtgaatatagtaggctatatttcatacaaactctcaccactgctgataaaattattgctaattatccaagaactttaaagagcatgaggattttaaagtcattaaaagggaagctttcaggcagaggctggatgactatctgtcaggtaaaatttcctgcattggatgaaggaaaaggtggcagggaatggacttggtgatttttccagtctcttctactacagggtatatgtattacatgatgtagcacagccactgaattataggtgtagaattttcaagaaacacaatatagtggtcctatgcacaattatgttaggtacataaatagcccagaaatcagtataccacatttaatttttaatttatctcagtcaaatgatttactgatttccatattacaaaatgttttgaaattatacagaacataacttatagtctctagatgttgacattttaagatatcaggacatacaaatcatattatgctaatgtgcaacaaattcaccactactcatgtgaatgatgacatggcagttatgtgtataaaataaaattacgaacagggttcaaattactttagtctggctttgaaatatatggtgaactttcataaggctcatttattgataataagtgctaccctaagcactttacatctattatctattttactccacacaacaaccatgtgatggaggttctgaggctagaaagatgcagccacttgctgaaggtcactcagttaataagcagcagagcaaagacttgaacctgctttggagactttctaactccagagcctctcacctaacactcacgacatggcttcctttttgcttccttgttttcttacttgtaggcaacattgaaattactttggttgctgcagtttatgctattgaacgtgggacaaggttttctgaagtctgcttggctgaccaaggaaaactaatttgagttttaaaatgtgaagtgaatgaagttggcagagctctgagaaattaggtacacatactgctaccattgtaaatgggatcaatatttccaaaagctatctataacatggaatgagagctataaaacttttcttgccctttgactcagtaatttcagtctttggaatataacctcaaggaaataacaccaaagaaaaaggtaatttgttcaagatgttcattcaagggctatttgtattagtgaaacacaggggaaaaatccaaattctcactaataggacagtgactaagcaatcgaggctctgtagaaaaagaaaagaagaaaattttatgatctcccaaaatgacaaatgtagaatatattcgtatgtggacgcatatgtaagaaataactgggttaaaacgtagaatgcaaattagtacatataaggataaccttgtacacccaagtaaaagagtatgtgtattaataaggcaagagattcatgaacttataaagaaatatattccccttttaactggagaaatcccaataagggaggatcatctggcatatacattgtatttaataaaaatttatctttaaatgaggacaaacacaggctatttattcatcccatgctataacaaggaagacagtcaccatctcttgcatttggaacactcaaaggggagtgcacaagttttacggtgaaaaaaatagaagactttaggtatgttctaagtggaggttgttggcatggggaagctgaaggcagggtaactagaagcacggcattttaggtaatgagttcagggaatatatttggcttttctctcagtggctctgagttgtaagtatgcaggggtggagggcatgatgagagcaaaaaaatagggaaggtggcggtcattgaccaaatcctggctgtgctaagctgattgctacagagactgtgatttggccttctaagctgcctgctgaagagaatgtgggtctgtcattatatgtggactggtcattgtccatttgtatacccaatctctcatatagaagaccagtttataattttataaaaggttgtaactcagaaacagccagatggaagagatacatagggcgaggtataggggaagaggtgcagagcttctgatccttctctgggtgtgccaccctcccagctaccacctttcagcaacctgggaggtccacttgatatgaatgtatagacttaaattagacaaaggtaatttttaaactgaggcctgactgacatacacatgatacctcacatgtattcacgtgctgtcaggaaaagctaatcaatcgctcatgagaacttactaagtcctaagttctcttccaagttctttccccggattctctcatttaatctccctacagccctgtgagtaagtgttactatcacccctcttctaagaggagaatattgtggcccagagaagctaagtaacttgcccaaggttactgaggccatggcagagatgtaatttcaacccagatagactcaccatatggccagtacagccattatactttgctgtcttctcttatttggaagaaatactttcccgtgaatcacttctagattttgtcttctgcttttctccttcaccttttctgtttggtttgcaatatataggatcctttcaggaaataacaatacccatacgcagaagttgttgagataaaatactctccagctggtgccacctgcatgaacacaatctacctgcactaactggtaggacttcttacaagaagcaaaactagagtagggttttcaagtcaggtgtgggagttgtagaggctggaagataaaatgccactgtggcacatgggataactacagaagagaaaaatatatcatttcaagctagaaaatattcagataaggctgaatctaagaaaaagttgcttggggataagtgacaaattaagaatattttaaaactcatagggaaaatattaattatttaaaaaaattgtattttacacttgcctagtttcttgtattttgcaaagtatttctcattgatgatcttatttaactctcctgctatagagtggtgaatagtatagttgacagatgagaaaacttcaggtcagaggtaagtgtgagctgtgcatccaagcagctgcctgtcattagctgagctgggactcagtcccaggctctcattcttaatagaactaaacattgatgctattcaagaaaggtacagagtcctgtgcaaatcttccctttaaattattcacagctcatgaagctctatctcacaggtacaagtccattaagaaaagtccagaaaacaaatctaacataaatggaatcaaagataagaactaaatatataatgagttccttttaaatgaaggcagcagagcaaaggcaggactaccatctgtgtacaaactgaactgttaggggtatggtatgggtatgtagtggttatatttggaaagacgcaaaacccacatccttctacctaaatctgtataagaggcacatcatctcaggactctgccatctatgatacaaaatgcacaaaatgaaatttctgctttatcttacattccatggaaatatctttattggaataaagtggcctacatttatattcacttctaaacaacgtcctctccttctcatctgtttctgtctgatggaggcctatttttgcttcagaggacagatcaaataccgcctcttccaggaagccttttcagatccaagtgagaacaagcctgtctttcctaggcgcccccagcctgtctgagaacaacttgctgatgattcttgtctcctgccttgtgtagctcctggatgacataacatgattgggatttatctttgtgcctcttaggatcccaatacaagtgcctcataccccatagcattttacttcattgtaagaaatcttttgaggtcctatcatgctctatgaattcaaaaacctttaaggagagttgggccgtctcaattccactataaaaatgacctcaatcaaggactgtcttcacttaaaaaccttcttgtttccttacaatcatatttcatgttgaccttctgtgccagaacatttgcattaatttaatgcatttgtaattagcattggcaaatgacaaacccacatccagaaggttaaattataaagtgttttttaattaaatagaaatatgagagtcatcaaacttaaacaaactaatttgagatttgcttttagcgcatattttataaatattcaaccagattttattcaatataaaggtagaagcttcaaagccagaacttcagttctttgaggactctctctcttttaatataaactggtaaataaactactagtgaaagaacttaaaatttcagagcaaaaagtacattacttccaccaaggtcaattactcttcagggacaaaagtaatgttctttttattagcaatttgaaataacaattaaataacattcgtttttattgagatttttatataagaactgagaaaacaattctttgttgtagttataaaaatataggagaaagtgctgagtttctgaaacacagcaatcttcctatattttctatcttcccttaggccatgtgtggtggagttgtgatccttatcttacttataaggaagacaaagaccagggaacaacaagaatactaccgaggcttataatgaaaagcaagctacaaaaaaagatgaagtaattattttcaattttaccacattctatgaaatatcgaaaaactcccatttcattttgtataccatgagaaaaagctctttgatccatgaatgggctaatccaacagctattcacataattcctgtcttttaaaggagaatagcaatcaatgaccaagaagaaaagtacaactcacaaaaggcatgaaatcttactttttcatcatcttcagtaaatggagctccttcaggaatcttatttatcgcttgggccacaccaataatctcaccatcactgcttcggataggcatgcacaataatgattttgtcttgtatccagttagcttgtcgatttcatcattgaatcgtcgatcctaaaaataagacaaagaaagcattaactgcatgtgcattgttgtcagggagaaggagagagaggtttatttctgcatatgataccttatcactgggaactagccccatgaatttttaatcacaataacagatttgacttcatttttaattcaccaaaggaatataaatccaaataagtcaatgccatagttgtttgccatagtaaatgaagagagagactttaagcccaaccgcaacacatcaaaattggggaaacgtgtttttaaggaaagcgatttatgtgatttatgaaaacatgttatttcaaaaagacaggatatgaaatgtcatataagaaacttacatgagaaatatatactaaacactgaaaaattgttcaatatagagctactttatttctggccaaaatgatcctgtgaaaaaaaaatctatgagtacataatgatatttcaaaatcctcccaaaaagatgtggggtatggggagataaaagacttctctatagaatgccagctaaaatatataaaataaatgataaaattatacaatatattttgcaactacctatataattatgtttacaagcaagggtcattaagtatgctaataccattgggtgaaaattgtttaacttaaacagtatagtcacacagtctcaaagtgccacacccaaagattccttattacaaaggtaaaaggtgtctttgtagtgaataaatctggtgaacgctacctcaaacaagtaaacttagcatcactctttagaagaaaaattaacaccatgtgcctcctgatataatgcaatggaaaggacacaacatcaccaagaatacagtgttcttgtcaaatgtgtaacgtgaatctaattattcaagaaatgaaaattaagaaatgtagaaatcatcagtcattctatcagaaacctaacgctggatgcttaaaaaatgtcaagatcatgaaagacaaaaaaaaagtttttttaaataaatataaagttaaaccatgggagctataccaatttaaagaagactgaagagacctgaaatccaaataaaatatgtgatcctttactagaaattccgaaaattccacaaaggatatttctggagggacaattggagaaagttaagtcagataattatatcattataaactttcttaagtatgatactggtgttgtaattatgctgcagaatgtccttattcttaggatatacatgctagggtatttggggagtgaaatatcataccttcaactcactttcaaggaaggaacgaatggatggaaggagggagggagagaagggaaggagagaggaaaaggagggtggaaggaaaaaaagaaaaagattggctcctgagtaactgtgactaaaaatgctccaaggtagatgataaactggatccagtctgatgataaactatttcaagtcaggggttggagtgaggcttcttcctgtaccttctgcacacccctgttaaaggaggcttaaaagacaaaaacaaagcactggtgcctatgctatgctattctcgctctgtcacccaggctggaatgcagtcatttgatctcggttcactgcaacctccacctcccgggttcaagcgattctcctgcctcatcctcccaagtagctgggactacagatgcaagccatcatgcctggctaattttttttttttttttttttttttgcattttagtagagatggggtttcaccatattggccaaggtggtctcgaactcctgaccgcaggtgatccactcgccttggcctcccaaagtgttggaattacaggcgtgacccacagtgcccggccaggagtctttaaatgccattatgaggcctggctctggtctggtgatccatggaggccacactaaaccccagagagaggagagtccaattaaagagagggaaatcaaaacccaaacaaaaccaaatctcctgctcaaaataagtatgtgaccaaactttcagaaaatcagcaatctgtattaattatttttaaatttctctgaggaactactacatgtcaggctatgggctaggtggaagttgcaatcaagtaggtgaggcagacaatgtatagatgtatatttatatattgtggtaagtgttactgagaaaaaagcaaaatgcgtgagagagactgaatatgaaggacttatttttatagggatcaaggaagttctctctcaaaacagaacaaataagccgagacttcaatcatgagtaagaattttctaggcaaagagtggtggaaagaactttccaggaagatgaaccaatacatataaggtcctgaagcaggaaaaagcttaataagttccaaaaagtcaaaggtcaatgtggctagagtagagggagacaaagggagagtgaaagagggaggcagtgaccaaatggtgccaagtctcacaggcctagaaagagttatatttaatcccaaatgcaatggaaaacctttgaagatcttgaagcagaagaatagcattggccactatttagcacttagattctctgcaattatcttaccagtttacttgttctcctcccaactaaaatataaaatctaagacagcagagattttgtctctcctatttactgcttcattctggcatgcatattatacatgcacaataatattttttaaataatttattcttttgaaaagattgcattgcaattatgcagaatatagaaaagttgttaaggcgctaaggcgccacataccactctttggcatgtatgtagagacatttttccaaatatatagaagagaggtacacaaatgttcactgcaacatcaattatgaaaattaaaaacgtgaagccatttgaatgttgatcaagagaaaaataaattatgatcttgtggtttggtagtgtattatacaacaatttaaatgaataaattagagctacctgtatcaacatgaacaaatgtcaaaaacataatgttaagtgaaacaaacaagcagcagtctgatacaatctatataataccacaatacttaaaaataatactaaatatcatttatggattcaaatatgtagcaaaagtataaaagcatgtaagggaataataaacactaaatttatattagtgattacctgtggagaggaaggaaggaagtggcatcagggagaaccacagaggaggcttcaactacaacaagaaagcttacttctttagaaaaacaattcggggggccaggtgcagtggatcacgcctgtaatctcagcacgttgggaggctgaggccggcagatcacgaagtcaggagttcgagaccagcctggccagcatggtgaaaccttgtctctactaaaaatacaaaaaattagccgggcgtggtgccaggtgcctgtagttccagctactcaggaggctgaggcaggagaattgcttgaacccaggaggtggaggttgcagtgagccaagatcacgccacttcactccagcctgggcgagtgagactccgtctcaaaaaaaagaaagaaagaaaaacaattcaggagcaagatggtggttctctggaggttgagtgtaatctgtggcacccaaggaagctgatctctgttgctttgaaccccactggtcagacctgccatgtctcagcacatccctagggccaacctaccccaggatggtgtggagcacagcatgttcacctgccacccagccgccattctgtttccaaggctgcgtctgtccactggactggtgacggggttgtcagtgtttagctcctgcttccagctgctgctttgaatccttgctctgcgatggactactccctggctacagccctcactctccttagtcactaagactttgaacaagttgtttcaaactatgtctatgcagacgcatcacggaaagctgccaaggcaggccttttggcacacttgactttaacctttgccgggctttgtgatttcaactatcatgatgggggcatctggaaagctgttgccatgctgtggaagctctgaccttttagacttaacaccttaaaaagtaattcttaacaccttaaaaagtacttatctttgcctctgctctgccatgccattccactaacaataaaaaggaagtaacagataagttcattgttgagacaaaactctttggtgcaatcatagctcactttcatcacccaaagtcctgggctcaagcaatcctcctgcctcagcctcctaagtagctaggactgcaggtgcacaccaccatgcccagctattcttttttattttttgtagacacagggtctcactacattgcccagtctggtctcaaattactggcctcaagcaaccctcccactctggcctctttaaacgctgggatcacaggtgtgagccactgctcccagcccagaatttaatctttgaggaaaagtttgagaggatttgtattcaagaaactgtgcaactgagtcccattttctggtgagttaatgagatttctttcccagaatcagagtataactaaacattatatatgagcttttgcatcttcatttaccaatctcttaaacagaattcagtttaattactaaatatgtgatcaaacatctcctgtatttttcctgataaggatagacaaagagaaagactgttaattcatgcacaaagactttgcagaaaattagacaatatttaatttttgaaaatttccccctctgttcagttgatatcagctactgatggttccatgtccttgggaaacattaaaattagaaaaagctgatatctcacactactaatttctaaatcctaagaagaggagcttggaaagctgctgaatatagagaagttccgtttagggaagaagtctcctttgtaattgtatgaaaatatcaaacattctaaatgaaaacttaatctctcaaatatgtttattttacttgtcttaaaacaatctgcctacaagtataaaagtataaaaaattgttattttcccatttgaagttttctaatataaaaatatattctatgaaataaaatttctaaaaataaaatgctatataataaaacatattcgactcttttatgtaaaaaaagcccaatgtagtaaaatattaagattttataaacctagatggcttattcttatctaaaattaagaactttgtggaggatgacacagaattgaaatagaccagttgggaaattttggtggtccaggtaaggtatgaggatagtctgggtttaagaaaaaggcaatgagggtaaagagaagtagacaaatatgttggaagttgagtctgtagtacttcctgatgaattggttgggaggggagaatagacaaaagacaatgagcctcagattttaacttgagaaaccgtggacggaagtatcatttactggaatgggggagattgagataaaggtgaaagtctacatatgaagagagtagaaggttgataaatcaatttattaaacaaggtgaagtgcatctttgaccaaaatcagtggttgttccccctgactgcatctgaaaattaacttgagaaagtcatcacatatggaatcaatcattactaggcattggtatttttttaaatgctcctctgttatcctcatatgagaaccactgtcctaaatgataaagactttagtcattagtgagagcaataaaacctattgatgggaaatgccttaaaatggggaggaacaagaagagtggtatgtattctgatggttgcatatcaatggtgttggccatgatggaatggactgaaaatccactctgcagtaggaacagcctgtttgcccttacctttgtgataatctgcatctctggagaagggtctcttaccgaccaaaactcaactctgagtctgagtagaccaaccaccaaggctatggagtaggttgctaccccattgctaaagcatccaaagtcacatgagaacaatagacactgggatgctttagcatgacaaggagtcacaaaaatggtctaaactctccccaccatctcctcacctctctaaatccacctgataaactgataacttaaagagaaaatgtggcctggagcagtgcttcatgcctgtaatgccagcactttgggaggccaaggtgggtggatcacttaaggccaggagttcaagaccagcctggtcaacatggtgaaaccccatctctactaaaaatacaaaaattagccaggtgtggtggtaggcgcctgtaatcccagctactcctactcggcaggctgagtcaggaaaatcgattgaacccgagaggcagaggttgcagggagccaagattgcgccactgcactccagactgggcgacagagcaagactctgtctcaaaaacaaaaaggagaaaatgtaattgtattaatacatgtggtaagtattaatcttttaatttaaaataaaagctaggaagaaagattttttctattaagtctttgtttttttgtttttttgtcttggtgtgtgtgtgtgtgtgtgtgtgtgtgtgtgtgtgtgtgtgtgtgtgtgtgtttgagatggagtttccctctttttgtccaggctggagtgcaatggtgcaatctctgttcactgcaaccaccacctcccagggtcaagtaattttcctacctcagcttcctgagtagctgggattacaggcatgtgccaccacaccaagctaattttgtgtttttagtagagatgggggtttcaccatgttggccaggctggtctcgaactcctgacctcaagtgatccacctgcctcggcctcccaaagtgctgggattacaggcatgagccaccgcacccagcctccattaagtcttaatggttttaaaaaataatgcatcttaggacatgctttgtctgtgtcttcattacactacttataagataattctcacaaattaactcaaaacttgataaaatcaaattaatctaatgggagatcagaatcgctgatacaattatgtactttcttaatatatacataaatctgtagattaatcttccaattaaaaacaatcaagaaagctgagtcccaaattgaggcataaatgaattatagtagatgaagaaaattaggaaaataattagataaaggaacatgttactctgatattatagaaggaacaaaagtttaataatagatgaaattaaaaaatagatttaactagccaagtaatcaccacaaatgagtataatagtagaggaaacacatagcattacggaacacaacagcagggtgccacaactagtctaaggtcagacaatatctcccaaagaaagtgaagtgtttaaggtgatacccacaggatcaataggaattatccagaaaaaaaggagagaagcattagggagaggtggaagggagtgtcccagaaagagggaatagtatctctaaagtccagaggcaataaacgctggttaatttgaggaatagaaagaagttgaagatggctcttgtgggaagtgtcagacatggggtaggaaagacagctggaggctgatgagagggtgtctagtaactaggtgtagaattgtaaatttatcatagaggaagcgaggggtcactagagagttttaagaaggtgagtgggagtgatatgactgagtcttcattttagaaagactgctgtggctacatgtaaagaatggattggaagcaagaggtccaggtgagagatgaaccatctctgggctgggatggtggttagtggtagtaggagtggtggaaaatggactgagttgagagatatttaggaggtagaatgaatagaactgattctatgctgattaatttggaaggctgtgaaagttagagaagtgaaaatgactccatatttctggtgcagatgtctgggagggtagtgggatgattcactgagtgaggaacgcagtaaggaacagattctggggaatatgagtttcgttgtggacatttcaaggtttagttgcctgtgggtcatccacatggtacagatgctcaaaaagaagtttgatagatttagatatagatacagacatagacgatttttttttttaatttcaggaaaaggacttgaaatggaaagtaaaaattgtctaggtaaggatgggaattttgcctaacagcttttaagcccaggatcttcagaaggtcatcacaatcaccagcagagcttcacagaaggccaggtaaggaggaaacaggactagtaagaaggcaaaaaatgtgcttgtttctgaaaatggaaacttgaataggaaactaacaaatgcctcaaggattataatgaaatatcatatggagaatggtgcccaatttttactcatctcccttgggacaaaagaacaagaaatgatctacaacaggagagatttctaataaattaaggtaaagtaaagttgttaaaatctggaatgagctgttataattgtggtagactcttaccgctttgagtatttttatgtcataatattttttctatctcagatattttaagtacaactgctcttgagaagtgcagaaatcttttccatgccttttatgcagatctgtcttttgtatataacacgcagccatgatttttaacctttaaaaagacaaagtcacaaggccaaaagcaatttttacttctcagtgaaggaactgacctgtgcctccttcatagagaacagtaattggatacatttctgacccaggatcttgcacttgcaaacccatctgcaagtttctgagttgaatgtggtgccatgaagcacacccagaaaaaggattcccaccttcaagatccacaaaggctgtaaaaagcaacctctgaactcagctttcatgtctttgagaaagaattatatttaatatgctcaagaatcccagccagccccaaaaaaacacactttagaggtacgaaagaagcctcgaagcaaaacaaatccatcttctctttctactttctcagagaaatcactggaggctccctaaggcaagattcagagttgagaatcttatccaggtcccacattcatggcaaagatgggttgcctaagatctcttttattccctctgtatttaaggactctatccccaatactttatagtaaaattttccagtactcatgattaagccaagaactaatcttgaccaatgtttaatctacaagggtgatttttaaaaaccagaatcttgaatctaccttaggtccttcatagccaaaatgctcaaactgttcaagtctaagagtgtccacatgatgtaattatgtttcctgaacatacttatgaggaaatatgtaatgacaaaagcccctattaattccataacactttcaaatgaccttgtctttgagttacaaaatatagctcaaaaattataaagttataattgtaaattgtggagaagattacagagaaaaattataaagaaattagagagaaaaggtgaaataagatatgcatgtatataaggtattcttcggcctacagacacttagacatacataggaatagaacagagcttggcagtccttgttaatactggaatcacctgggacctttaggaaagtactgatgttttagccccaccccaactaattaaatcacaattggtagggggaggggccctggaggggatctgacttctggctgtttgtcagggtagggttaagaaccactgaattagagggtcacttaataaatccaaggcctcatcaggcattcacgcctgtaatcccagcactttgggaggctgaggtgggtgaatcacctgaggtcaggagtttgagaccagcccggctaacaagctgaaaccccatctctactaaaaatacaaaaattagccgggcatagtggtgcacacctgtaatcccagctactcgggaggccgaggcaggagaattgcttgggcccgggaggcagaggttgcagtgagctgagattgtgccactactctccagcctgggcaacagagcaagattccatcttaaaaaataaaaataaaaaataaaaatccaaggcctctggggtctgaagacaacaggttataaaccatgctttagagatttagcttttgttttattttgtcttttccatacactttccctgaaggcttcatgaactaggcctgcatacctttttcaacatcatattagcccattgccccaccaaaagattcagagaaaaagttcagtctcatatttcatctacatcctgtttcaaatgccttatggagttgtaatgtagagaagttaatggaaataaaaaaacataaaatgaataatccattgaaacacaaaccaatagattgccaaactttctgaagctcaaaaaattgcttttattgctatatcatttagtaatactcatttaattccaattcataaaatcatctccttacacttatgacttatcagtagacatcacttattttccagaaaatgcttggaaggcaaagctttcgaaaattgattagtctttaatgacttgaaatctattattcttactttcttcatagaaagaagaactaattgttctgaattgatggaagacttgagattacactgcataaaaacaaagacacagcatgtggcaactacatagctcattctttaggcctcctaatttgatatttgctgagaaaaagtgaaaaattatcattgttgttcttaatatgtatttgcagaatttcattgctgtacagtaaacaaaaaagaatctccaaattctttcctaaagagttctaaatagtacaaaagattaccaaaaattgtttctgaagcttcactcttttatggacctgaagtggtgtagttggaattggagtattttgtacattcacataggtaagctctacttgctaaatgtttaaagggcatacctttatttaagtctttcaaatagaattggtggttgatagacaccatcaaataatttgatatgaagtttcaaaacagttattgtgattaccatgttgtttggggcattatccctttttttagtcacgttgctaaagtaaactttgtttgctgatcttatttccctctgttcttcctttcttagttggcacttttctttggtcctgtcttatcatcatgattattattatttctctttattacaataaatacaaatacaaatctcaaggcaaaatacacaggaaaatgaagacccacaccacacttgaaaccaaagcgcaactgacgtagtaaaaaagaaaatgatgaattcttaaactgctttaatagacagcccagatatctattaccgtaagtctgcaaatatattgtacctagagttaaaatgcaacctcatgctctataagctttattgcatataaggaaaatgtctaagaaaaggccagtacctgaagaaagagttatgggaagggtcagctaaccagaaggcacctttttttctgacacagtgagaccatctaagaactgcaatgaatcagggaaatgaggctctaaggtaaaaccaggaaggccaggcagtctgcaaataaggggaagggaactatcagcatgaagctgtgattcagacaccagacaaacagtcagaaagtagagaatacagggcaagccaaggtcaagacagtgatgcatgaaaagccaggtccaggtcagaagaacagatctaacagtgagacattggagacttggtctcacccattcatcagaacctaacacagactacctccaacagagagctttggaattcttcccactgaagacaactgagacaacccgaaaagtggcccaaaaatgtaactgatatgtaggcagctatctcaatcaaatgctgatccttcccacatttatggcaaataccagaatttatagagtcatagtgatatgttatattttaattacataatttgtttaggttttattgttaatatgcaaaggttacaattcctctttgacaaaagtttaatgttaaaaagtaatttttgaccgggcgctgtggccaacacctgtaatcccagcactttgggaggccaaggtgggcggatcacttgaggtcaggagtcaagaccagcctggccaacatggtgaaaccccgtctttactaaaaatacaaaaattagctgggcgtgatggtaggaacctgtaattccagctactcaggaggctgaggcaggagaatcacttgaacccaggaggcagaggttgcagtgagccgagattgcgccactgcactccagcctgtgcaacagagcgagactctgtctcaaaaaaaaaaaaagaaaagaaaaaagtaattttttaaaatctgctttttaaagttttttaggttttgaaatgttttaaaaacacatttttaaataaaatgtctatagaaataagtgtatttagttaatcaaaagagtattatttcaaatcagtcagaaaattatggattattcaactagttacatatttgggaaaaataagttagacccctatctcacatcagacatcaaaattaatttcaagcagaataaagacttaaatgtactcatctcttaataaattgcaaaagtaaaacaaaaaatttactcaaaccctgccaagacatatttcctattttaacatgaaatactatagtattaatcatttaagatgccaatatctagctttattgaaacgaccagtgaaatgtctacttttatacattgctaatgagaatataaattagtgcaataaatatggagggcaatttggcaagaagtaacaaaagtcttttaaaaatttttatgctctttaataatttcatttctaggaatttatgataaggaaaaattgaaaaatatctacatattcaagaggaaatggattatattatgatatagacacaataccactaaaaaaagcattagaatttattttacatgttataagtggttttattatgacatgagaaagttacatgaagaaaagtggtttagaattcagtaaaattagcataatttcctaagggtgatgaaattaccatctaagacagcacaatagtttcaaaagtgccctccaaaaacatagaagtcattatgctactgaattgtcagtaaaatagataggcaacatacaccagccgtcaagctggaggtgggtcgatattcataaataatttatctctatgaaaaaccatagcatcctatactttcagcaagatataagcgagtccaagctagcaatccaaatggccccggctgtttttttaaagccactatcaccctagctaaaaaatctcttatcataaaaggtccaattgacctgctacccagaatgccaaaggaacttggtggtattgcctgaaaatcacaaagaacaaagaacagaagactgtcaagatactataattgggcaatgttctgatatgtgaaatggatggatttttcaactctctcagattctgaccttctccacatttaatgtgaaatatcacaacctcttatgtggcatagcatatataatattggaaaacatcctgattttccaaaagaatgaatactatcaactaaaaaaaacaaactattaaaccagtaaatataagtttgtaaaagattgctgtgaacaagtcctccagccacagcagtgtgttccaccactgaaagcccaggttagaaaaaatcaggcatcttctactgggaaaaggacttggaagcagcttaacactacttcccaccaaccttccaggtggatccctggagctggttggttccatacacattcccttccccactataagtccctgcatccctgaagccttccttctccattcccaggccaggctctttatttccttggtgttcaccctcgcttcagctacaaataagcaaagtgccgagagtacctggactccttgcagaagttatatagtcacatgttccatcaaaaaaaaaaaaaaaaaatggggacatgaatctcttgccctataatatgagagtaggcgtgacataccaaactgaaggtgtcaacctgtggggggaagtcattcagaggatggatcccatcagcaggaatcatttgtaaataatctggataaatacaagcgtgccttttccttaaataaagcaccaaagtgctttcacataaatgtttgtgagtaggagccctctagccagacacactggagaaatgagtcggcatgtttattggcactctcatctaagctattccaccttggatagagttgattagctcctcttagaactgttctcttgtctgctgccttgtaacatgtcattttcttagccagctagcaaaatgctgcagtgtttgttttatgaactaattcaagcacctggaatagccagctaattagaccattcatatttttcaggtttgggttttgctgggctagaaagatctgatatatcggctagcatttactctcatgcaaataacagggccaggaaccattctataaatctcaattcatttctgaggtgttccagtaaaatgagcaatcaatttaaccgactagaattcttcactttaggatctgcatagtacggaacaacagaagcagtagaaattgcaacaagccctaggctaccaaagtctataagactcctagatactccttcagatggcatttcaaaaacaaattgaaaaatttcatagcttccaagtccctctgccttacttaagaaaggttatcttataggcatcattggatattgtcttccccaccataagccacccatcagcatgctcacgtacatctgatacatctagctacactgcacccaacaacaagagatttcatataattagttccatgattgacatgaaaagtttatgaaaattcaccaaaagctaagtcatcaggttagccagtttgaaatcaccatgtcaaataactgatatcacacagaaaatataatttaactccaatgcactttagttaggaacaataataaaaagataactagtgaaatcaaatatttaaacatttagaatacatttctgaattacccatcaatcaaaaaattaaaatagaagttataaaatacttagaaaatactaagaaaaataatgtctaaatataaaaataccaggatgattacacatcatatatcaaaaccgtggtccacagttaaagagttcttaaaggttctgttgtaaatgcttacctcaggaaaaaaaaaatgttcaacttaataatcatccaaccataaggagttaggggaaaagaacagcaaaataaattcaagaaaatggaaaaaataatacaaataagagcaaaagttaatgaaaatggcaggaaatatatattgaagacaattgaagacaattcaatatatattgaagacaattggtttaaatgtttttccccctcaaaactcgtgttaaaatttaattgccattgtgatgatattaggaagtgggacctttaagaagtgtttaggtcatgagggctctgccctcatgaatacactcataccattatcacttgagtgggttcattattgcagaagtgggtctgcctctccccagcactctttgccctttcaccatatgatgccttccaccatgttatgccacagcaagaaggccctcaccagatgcagacaccttgattttggactccctggctttcagaactgtgcactaataaatttctgtttgttataaattaccgagtctatggtattctgttatagcagcacaaaactgactaagacaaaaattaacaaagttcaaaaaaagaataacatatgaaaatctctagagagaataatcaggagagaaaaaaaagagagaggccttatattttaaaaaatcaggaataaaatggggctaaaactacagttgctacaaagattaaacaaatataatggtgttatgaacaactttgtgccaataaatttgaaaagttagatgaaataaatagataaaaacttatccaaaaaatctttcaaaaaactagagaacataaagagtcctataagctttaaataaattgaatcagtactttaaaatattcccgttaaacatacacacacatcctcagatccagatagatttctaggaaattataccaaacatcatggcattgggcaattctaatttattacaaactattccaactaatggaaaaagaaagaccattctcccagttcatttgtgatataactttgctttcaaaatcagacaagagtattctaagaaaaaaaaaaaggctgggcatagtggctcacacctgtaatcccaacaacttgggaggccaacacagaaagattgcttgagccctggagtttgagactagagtgggcaacattgtggaacactgtctctataaaaaatttttaaaaattagccaggcatggtggcatgtgcctgtagtcccagctacttgggaggctgaggtgcagggatcacctgagcccaggaggttgaggctgcagtgaatcttgtgattgtgtcactgcacaccagcctgggtgacaaaaagaagaaaatataaaaatataggccagtcttgcttatgaatggatatagatgcaaaaaccctaaaaaccaaaatttttgtgaaacaaatcagacaatacataaaaaaagatcactttttataaccaagttgatgtttcctaggaatgcaagattggtttaatatgagatcaattaaagtaattcaccacattaatagtgtaaggtaaaaaaattcatatctttataaaggcagaaaaagttaataaaactctgcattctcttattattttaaaaataacagcaacaacctccttagcaaactgggaatagaagggaactttcttaacccaataaaggggatctcaaaaaacccacagaaacctcatacctaatgattaaactgaaagcattctctataagctcagtttcaagacaaagagacctgttataatcagtcttgttctacatgatactggaggttcttgcacagtaggagctaagaaaaagaaataaaaggtaaaggattgtaaagaaagaaaactgtcattatttgcagatgatatgattgcttacacagaaaatcttaaacaagctacagataaaaatttaaataagagttgttggattccaaattgatacacaaaagtaaattgcatttctagataaacacaagaattgactaaaaatataattttttaaatatactgtttaaaatatcaataaacatttttaaatacctaggatacaatatagcaaagaatgtgtaagacttttatagtgaaaactaaaaaaaagacttaaaagacattaaagaagattaaattggaaaaaaatatatatcatattattgggtaggaagactgactctcatacatcagtaattccccctaaactgacctataacttcagtgcaattccagttgaaatcctatcagagtgtgcatgtgtgtgtatgtgtgaaactcaacaggctgattacaaaactgacatgaaagaataaagggccagctgaagccaagaccctcctgaggaagaacaagtcataggggttggggagaagattcaccctactagatattaatactttctataagctacagaaattaaggcagtgtgatagtaatacaggcatagattaatagaccaacagaataatagagagcctagtaaaaaacccatgcacatatagaaaatggatttatggcaaagcagtcatcacagatcatgagaaaagatgaacttctcaataaatgaccctaggtcaattgcttattcaaatagaaaagaaataaaattgtattcatatcctacaccctaacacaaaaaaggaattacaattaaactaaatacttaatatgaaaacaaatttataaaaatttccaaagacactataggagaatatttttcttcataccctgtttcaagaataagaacaaaaatgcaaatttctataagatcaataaatcaagtagtattaaaattaagagcttgggctgggcgtggtggcacatgcctgtagtcccagctactggagaggctgaggcaggagaattgcttgaacccgggaggcagaggttgcagtgaaccaagatcgcatcaccgcactctagcctgggcaacagagcgagaccccatctcaaaaaaaaaaaaaaaggacttgggttttccattaagaatgaaaagcaacagtacaccagctctgctaagggacagaatgcctcctcaagtgggtccctgacccctgtgcctccttactgggagaaacctcccaacaggggtcgtcagacacctcatacaggagagctctggctggcattaggccagggcctccctagaatgaagcttccagaggaaggagcaggcagcagtctttgctgttctgcagcctccactgatgatacccaggcgaacagggtctagagtggacctccagcaaactgcagcagacctgcagaagagggacctgattgttagaagaaaaactaacaaacagaaagcgataacatcaacataaaggacccccacacaaaaaccccatccaaagatcatcagcctcaaagatcaaaggtagataaatccatgaagatgagaaaaaaacagtgcaaaaaaacaactgaaaattcaaaaaaccagaatgcctcttctcctccaagtggttacaacccctctctggcaaggacacaaaactggatggagaatgagtttgacgaactgacagaagtaggcttcagaaagtgggtaataacaaactcttctgagctaaaggagcatgttttaacctaatgcaaggaagctaagaaccttgataaaaggttacaggaactgctaactagaataaccagtttagagaggaacataaatgacctattggagctgaaaaacacagcacgagaacttcctgtagcatacacaagtatcaacaaccaaatttatcaagtgggagaaagaatatcagagattgaagatcaacttactgaaataaggtgtgaagacaagattggagaaaaaagaatgaaaaggaatgaacaaagcatccaggaaatatgggactatgtgaaaggaccaaacatatgattgattactgtacctgaaagtgacggggagaatggaaccaagttggaaaacacacttcaggatatcatccaggagaacttccccaacctagcaagacaggccaacattcaaattcaggaaatacagagaacaacactaagatactcctcaagaagagcaaccccaagacacataatcatcagattctccaaggttgaaacaaaggaaaaaatgttaagagcagccagagagaaaggtcaggttacctacaaagggaagcccatcagactaacagtggatctctctgcagaaaccctacaagccagaagagagtgggggccaatattcaacattcttaaacaaaaaaaagttttcaacccagaatttcatacccagccaaactaagcttcataaggagaaataaaatcctttccagacaagcaaatgctgagggattttgtcaccacaaagcctgccttacaagacccctgaaggaagcactaaatatggaaaggaaaagctgttaccagccactgcaaaaacacaccaaaatataaagaccaatgacactatgaagaaactgcatcaactaatgttcaaaataaccagctaacatcatggtgaaaggatcaaattcacacataacaatattaaccttaaatgtaaataggctaaatgccccaattaaaagacacagactggaaaattggataaagaatcaagagccattggtgtgctgtattcaggagacccatctcacgtgcaaagacacatagggtcaaaaaaaaagggatggaggaatatttaccaagcaaatggaaagcaaaaagaaagcaggggttgcaatcctagtctctgataaaacagactttaaatcaacaaagatcaaaaaagacaaaagggatcaacgcaacaagaaaagctacctatcctaaatatatatgtacccaatacaggagcactcagattcataaaagaagttcttagagacttacaaagagacttagatacctgcacaataatagtgggagactttaacaccccactgtcaatattagacagatcaatgagacagaaaattaacaaggatattcaggacttgaactcggctatggaccaagtggacctaatagacatctacagaactctccaccccaaatcaacagaatacacattcttctcagcaccacattgcacttattccaaaattgatcacatagttggaagtaaagcactcttcagcaaatgtaaaagaacagaaattataacaaacttccctcagaccacagtacaatcaaattagaactcaggattaagaaactcactaaaaaccgcacaactacatggaaattgaacaacctgctcctgaatgactactgggaaaataatgaaattaaggcagaaacaaaggagttctttgaaaccaatgagaacaaagacacaacataccagaatctctgggacacatttaaagcagtgttgagagggaaatttatagcactaaatgcccacaacagaaagttggaaagatctaaaatcggcaccctaacatcacaattaaaagaactagagaagcaagagcaaacacattcaaaagctagcagaggacaagaaataactaagatcagagcagaactgaaggggatagagacatgaaaaacccttcgaaaaaaatcaatgaatccaggagctgtttttttttaaacattaacaaaatagatggaccactagttagactaataaagaagaaaagagagaagaatcaaatagacacaataaaaaatgataaaggggatatcaccactgatcccacagaaatacaaactaccatcagagaatactacaaacactactactcaaataaactagaaaatctagaagaaatgacaaattcctggacacatacaccctctcaagactaaaccaggaagaagtcaaatccctgaatagaccaataacaagttctgaaattaaggcagtaattaagagcctaccaaccaaaaaaagcccaggaccagatggcttcacagccaaattctaccagaggtacaaagaggagctagtatcattccttctgaaactattccaatcaatagaaaaagagggaatcctccctaactcattttatgaggccagcatcatcctgataccaaaacctggcagagagagacaacaaaaaaagaaattttcaggccaatgtccctgaagaatattgatgtgaaaatcctcaataaaatagggcaaaccgaatccagcagcacatcaaaaagcttatccaacacgatcaagttggcttcttttgtgggatgcaaggctggttcaacatacacaaatcaataaatgtaatccatcacataaacagaaccaatgacaaaaaccacatgattatctcaatagatgcagaaaaggccttcaataaaattcaacagcccttacgctaaaaactcagtaaactaggtattgatggaacatatctcaaaaaataatagctgtttatgacaaacccatagccaacatcatactgaatgggcaaaagctggaagcattccctttgaaaaccaacacaagacaaggatgccctctctcaccactcctattcaacatactattggaagttctggccagggcaatcaggcaagagaaagaaataaagggtattcaaatagaaagagaggaagtcaaattgtctctgtttgcagatgacatgattgtatatttagaaaaccccattgtctaagctccaaaactccttaagctgataagcaacttcagcaaagtctcaggatacaaaatcagtgttcaaaaatcacaagcattcctatatatcaacaatagatgagcagagagccatgtcatgagtgaactcccattcacgattgctataaagagaataaaatacctaggaatacaacttaaagggacgtgaaggacttcctcaaggagaactacaaaccactgctcaggaaagaagagaggacacaaacaagtggaaaaaaattccatgctcatggatagggagaatcagatcatgaaaatggtcatactgcccaaagtaacgtatagagccaatgctattcgcatcaagctaccattaactttcttcacagaattagaaaaaaactactttaaatttcatatggaaccaaaaaagaacctgtatagccaagacaatcctaagaaaaaagaacaaagctggacatgtcatgctacctgactttaaactatactacaagtctacagaaaccaaaacagcatggtactggtaccaaaacagatacatagaccaacggaacgaaaggagacctcagaaataacaccacacatctacaatcatctgattttcaacaaacctgacaaaaacaagcagtggagaaaggattccatatttaataaatggtgctgggaaaactggctagccatatgcagaaaacagaaactggaccccttccttacaccttatagaaaaattaactcaagatggattaaagacttaaatgtaaaacccaaaaccataaaaaccctagaagaaaacccaggcaatacgattcaggacataggcatgggcaaagacttcatgactaaaacaccaaaagcaattgcaacaaaagccaaaattgacaaatgagatctagtcaaactaaagagcttctgcacagcaaaagaaactatcatcagagtgaacaggcaacctacagaatgggaaaaaatgtttgcaatctatccatctgacaaaggtctaatatccagaatctaccaggaacttaaacaaatttacaagaaaaaaacaaacaacaccatgaaacagtgggcaaaggctatgaacagatacttctcaaaagaagacatttatgtggccaacaaacgtgaaaaaaagctcatcatcactggtcattagagaaatgcaaatcaaaaccacaatgagataccatctcatgccagttagaatagtgactattaaaaagtcaggaaacaatagatgctggagaggcggtggagaaatagaaacacgtttacaccattggtgggagtgtaaattagttcaaccattgtggaagataatgtggtgattcctcaaggatctagaaccagaaatatcacttgacccagcaatcccattactgggtatatacccaaaggattataaatcattctaatataaagacccatgcgtacatgtgtttattgcagcactatttacaatagcaaagacatggaaccaacccaaatgcccatcaatgatagactggataaagaaaatgtggcacatatacaccacggaatactatgcagccataaaaaagaatgaattcatgtcctttgcagggacatggatgaagctggaagccaccaatctcagcaaactaacacatgaacagaaaaccaaacaccacatgttctcactcataagtgggagttgagcaatgagagcacatggacacagtgaggggaacatcacacaccagggcctgtcagggggtgggggacaagggaagggagagcattaggacaaatatctaatgcatggggggcttaaaagctagatgacgggttgataggtgcagcaaaccaccatggcacatgtatacctatgtaacaaacctgcatgttctgcacatgtatcctagaacttaaagtataataaaaaaaaaattgctaagggttatagattagataccctttaatgtaaatattcaaatttctttttataaaaaagcagatatattgagatataattgaaataaaaaaactgtacatatttaacatatatgattttattagtctggacatatggttacacccatgaaatggccacaatcaagatatgaatataactatcacccccaccaaagtttcttcatgccctttttaatcccaccttccatccctcccaccccaccatcccccacctcagataacactgatctgcttcctgtcactagagagtagtttgcattttctagagttttatctaaatcagccatgcagtatgcattcttgtctgacttctttcattccacattattaaaaaaaaagaatgaaaatcaagcaataaagaagaaaaaatatttgtaatacatataaccaataaggaaggtggtgttcagaatatatatgtatataaggagctcctacaaatcaataagaaaaaagcaaattcaataggaaaaaatgggccaatgacatggaccagtactccacaataagagaaaacacaaacatatgaaaagagggttgagggggagtcattcactgagctcaccccagaacatttgcatggtctatactttcataccaaccatgagtagcctgttcttttcttggctgggaggtaaatgaggaccctgtccatagatcaggtggccatgaggggaatgggcttggtagggaaagctagaatttgtgctctggtgactatggtggtcctggccccatatatattcactgtaaagaggaagatgcagcggaacaagaagaacactgaataactaagaaacgaatgcttgtgcttactttggcagcacatatactaaaattggcacaatagaagattagcatggcccctgcgcaaggatgatgagcaaattcatgaggcattccatatttttagcaatcccattactggctatataaccagaggaatataagtcattctaccataaaggcatgcacacgagtgttcattgaagccctattaacaataacaaagacatggaatcaatgtttttgcaggacatgcaaggaatcaacctaaacgcccatcaatgacacattggatatacacatggatactatgcagccataaaaagaatgagatcatgtctttttgctggaacatggatagagctggaagctattattattagcaaactaacacaaaaacagaaaaccaaatactgcatgttctcacttataagtgggagctaaatgatgagaactcatgaacccaaaaaagggaacaacagacattggggtctacttaaggatggagggtgagaggagggagaggagcagaaaaaataaatattgggtaccagacttaatacctgggtgatgaaatagttacacagcaaacccccatgacacaagtttacctatataacaaacctttacatgtacccccaaacctaagagttaaaaataaataaataaaagttacaaaaatgaatagttaaaagtctgcggtcatgcaaatatgatgccaagattccaggagacctatacaaaatgcccatagcaacattactgataaaagcaaaaaataaaaataaataaataaaaataaaataaaataaaataactagaaataactcaaaagtctgtcaatagtagaatgataaattgtgatatatttatacaaaggaacattatacggcactggaaattattgctacacatttcaacatgaattaatctcaaaaacataatgttgagcagaaaaagaaacaaaagaatacatgtagaatgattccatttatacaaagttcaaaagcaggcaaaattaaattgcatattgtataggaaaacaaagataggtggcaaagtcatggggagggaaacaaggggatatttcacacaacactcagcatgacaatgaaggtggtggtgacaagaggaaggataatattattgtgaaagggcaccagaagatttcaatgtagtggcttttttttttttttttttttgagacagagtttcactcttgttccccaggctggagtgcaacagcgcaatctcagctcactgcaacctccaccttctggattcaagctattcttctgcctcagcctcctgagtagctggggttacaggagtgcactactacacctggctaatttttgcatttttagtagagacagggttttaccatgttggtcttgaactcctgacctcaagtgatccacccacctcggcttcccaaagtgctaggattacaggtgtgagccatcgcacccagctagtgttttacattttaatctggtgtgagtagaaggatgtccagtttattcttctttatgctgtacgtatatattttattcttccatttgaatatatgatgcatttcacaattttttaaaggcaatggacaatataatgaaaattgaagaactgaagctcttgtcctttccgatatgttcagcacacatattgttttgaatgcgcagagttcttagggttatgatttagcaacatgagcagttaacaacccaacccttgttatgttaataggaacactgtggctaaaccactaaactaaaatttcactccatagacttattgatactaaaatggaatgtttcttcagagaactacatacctcaatttgctcacttttctcttccttttactatgctttgacattaccatttattacagataatctactaaatagaattgccttccttctttacagttctttctacattgttttgtccaggtaatttttatgactttcataatagtgtctgacatgcacgtaatttaaagtcaacaaatacagaatgataaaaatgagcagtcagaaatttttatctacttatttatttatttattcatttattgagacagggtctcactctgttgcccatgctagagtgcagtggctcaatcatagctcactgcaaaattgatctcccaggctcaagtgatcctctctcctcagcctcccaagtagctagaactacaggcacagccaccatgcccagctaatttttttgagttttagtagatacgaggtctcgctatgctgcccaggctggtctcgaattgctgggctcaagcaatgctcctgcctcagcctcccaaagtgctgggattacaggtgtgagcctccatgtcaagctcagaaattttttttttttttttgagacagagtcttgctctgtcacccaggctggagtgcagtggcacagtctcagctcactgcaacctctgcctcccgggttcaagcaattcttctgcctcagcctcccgagtagctgggactacaggcatgcaccaccacgcccggctaatttttgtatttttagtagagatggggtttaaccatagtggtcaggctggtctcgaactcctgaccttctgatccgcccgcctcagcctccaagtgctgggattataggtgtgagccatcgcacccggccagaaaattcttttaagaaccacgtgacttctgcaaataaggcatattcagtattaacttttaactagataagacctacaatgagctattttcacacacatatgttttttttccaaaaatggtagaagctaatatttattttaagtctgcatggcaagtttttcagtttttcataatactttggatgacagatgtcattgccaaggcatcgaaagcactaaattcctctttggaagtgctgtttgtccagtttcacatctgccctgtatcctttactcctcgaaaagacaatgtttcaagcattatccccctagatgttacaaacagctgaaccagcctgcaaattaaaggactaccttgaacataaatttctgataaggcccatattaatcatatgccccaaagtttagatgatcacacaaaagtaattttctcacagaaaaggtttttgctttcttttcaaaaaattgtaaaggcatggtgtaaacattactattccttttctctgtttctaaatgggtctaggttcttgtgtgaggaaagaggacaattagtaaatgtaattttcttatgcagcctcagctggcttcacatacctcataaatagttcttattcaaacattctaaagatacctacaattaaataaaattcatcctaaggctgggtatggtagctcatgcctgtaaacccaacactttggaaggccaaagtgggaagatcacttgaggccaggagtttgaaaccagccttgtcaacacattgagactccgcctctacaaaagaaaaagattagccaggtgtggtggcacacatttgtagtcccagctacttaggaagcggaggctggaagatggcttgagtccaggagtttaaggctgcagtgagccatgatcacatcactgctttctagccttggtgacagagcaagactctgtctcaaaaaaaaaaaaaaagaagaaaaaagtccatcctagttatatatttgatctatttcatgttctgaaagatctaacctggaactttccccttacgtatacaactttaaagagtaaatggctattccaagtcaataaactggtggcaaattgaaagatattaatgtgtagctaatctattttacatgatggagtttctagtctccccacaatgagcctcagtatatgattttaagtaacattcagaatactaaacttgattttaaaaacttgcaagcattcaggatattctgccatgaagcctctaaaattataactatattacacagaagttaaaaacaaacaaacaaacaaaaaccctacacttaggggcaagagcgcttaaccaaggcattgcttattgctgcaaagctgctctgtattaacctcacattaaatcattagagagaatggtgggaggcgagggacagctggcacccttggacatgggggctgaggcatccatggctgctaaagattttatagatttttttccttttacaggataaaaataaatcatttgcctttagttatagtttctaactgatactgtcacaaagataatttctggttgtggtttatgcagtgcagtcttatatactattatattatatctggctgatattaggtactgggtgcccatttgtgaaatggaacttaaggaactgtacatttttaataagaatcaatgctatttccctaacagacagtatctgtcatgggcagatgattcacattgatggcttataaatagcatgaattccccaggaaatttctccactgggtcctcctttcacactaaattcaagatattagtcaaatcctgctaaggtacacagatttgactatccagaaaagacagatcaaggttcttcagacatcaaaacttgctttgaagagagaaagacaacataatctggttttgcagtggcagatggctcataactttggctttgaatcttgatcttctaagccagtagacaagcggagacataagagtcataccaattactccagcaccacatatggtgagctagcctttaaaacaggcactaaatgagacttgtgatcagtttaaactgcaaagaaattgaggcaattataagacttattgattcctcagataatagcaatgatggctatcatttaccaggagcctaccatataacctgtgcatttatgtatgcaaaaatctgtgccagagttttgcacacatggaataatcacaacaaccatgcaaagtggatactattcgccccattatacatatgaggaaactgaagctaagagaagatcagtaacttatctcatgttaagtaatttaccaataactgagccaggatgctaactaagagatgcttgagtctaaagcttgggctcttttcaccatattatgttactttgaagagttagcaatttgtcctcaaggcctctgtccatgctggtgtttaatacagctcaaaaatcataaagaaacttgtcagtggtacaaacagtagtttatgttcagcctaatgtactaggacagagtgagaagttaatactgcttgccattcttcttgtgaccagttcaacaccaggtctttttattttttccagtctatgattaaatatattagcaaagattgacttctgcagaaggaaaacatagaagaaataaaatatctccccaaaagcttgaagctcttgcttcatgaagagtaggaacatcatgaattgcaaatgtctttcaaatattttttccagtaataggccatttcataaaaataatgcaatgaccaaagaagtgaagaatcctgattttaccatattttccaaaaacagaaagtgtatatagatatataaactttatatatatgtttttatatatataaactttatatgtttatatatatataaactttatatatatgtttatatacataaacatatatatgtatgtatacatcagtaaaatgtatgattttctgatataaacccttgtttataatataaacaatataaaactcttgtttctgatataaacctctcatgatcatggtcacataagaagttcttgggaggtataacaagcactgcatatgatgccacaagtcctgaatcccctgcccagcccccaaactgagccatttaacttccctcagactgtttctttaccctccaaatgaggatagtaattcttacctttcagacagcaaggattaattaggtagtatgtggtgaagcattttataaatcataaagtgctacacaagtatatcaccacattcagaatacagaacaggaatcagactagaaacattagaaactctccatttcccaaattctgtccctagatgtttttttgggggatgttataccccactccacttattatttttgattgcttcagtaggtatctagctccagcaatcaaaccaatccatgactaaggcaacaaatgcccccaaaggacattccctgcagccaaacagcaaaaagctattggatcaatagatcaccggtatggctgtagcttcagtgccctacctacaggtcacctagagtttacaaaaagtttcacaataaagagaaatgtgcagtttttttctagaataagttgcttgcttgtatacactagagcttcaggttttttctcagagacaaattgtacatctctttgttttatgatggatatatgcaagtataagacctgcatagagcaactcaaactctgccttgaaaactctctaaaatgttgtaggaaatctgttaactatatcctccagttaattcctagtaatataaacagattccttccctgcaggttttggtactgattagttgtgatgaaaaatgaaagtttttcatatttaatgaaactatccattttgcacactcacaacatagctcccagaaatattgtttagtccttggcaacactgtctcacaactttggtaaagagcattgtgaaaagatgttgttgaacagactgccactcattgtttacataccacaccagagacagcagtttgtggtggttaagagtacaaactgtggctccaacaatatgggttcaaaccctggctctccaacttaatagctgtgtgaccttggggaaattaagaaagcttctaataagtgttaactatcactactgtcagtagtagtagtagtagtatcgccttcacaggcattaatggattatattgcaaaccatgaagtttcctgaggcatcttgttccaaactctccaaacctgacacaattgttgggatcttcgcacaaaaataatcagttacctggtgtcaatggatgtgaatggctaaaacagcttctggaatgcattctagcagatttttgaacttcatattccatcaaggagccgccttctttcatggacaggaatccagccttgaacatgtgaacagaacctgaatgtaatccttaatatttcccataatggtaaaactgtagaatctaaacagagatggataatttgagtttgcatctggtctctgcctcttactagctgtataaacttgggaaagttactaaacctattcaagtctagcttcctcacatgtaaaatgtaggaagtaacggtgtctatctcatagaaccttgtgaggattaaatgagataactaaatcttaccacagtgcctactgcataacatattcccaataaatactggctattactattaatttttttgggggggttggttggtacagttgatatgagctcttcacctgtgtgttaattgaaaaatgaattttttgcagctgatcctttgaggactataaaatgtatggatgaagtcttatcagcagaagtcttatgttattataatgttgaattcagttcactttttggaagattttataataaatcttacagtgtgaaacaatcatggagtagattgtctaagaaattatagaaagataacattgagaaagtagttgatctctgtattgtaaccatcaatgtctcctttctacttaggtttcttgtttgttcgtttgtttgtttgtttgtttttataattgaagaattggagtcagaacttcagaataatagtcattgagtcagaaggtgagatgatagatagaaggtcaaggaaggctgttgattgcccctttcaagtcaggcagggctgacttaaacatggttggcttttggcaaagctgaggtagtcagttcatcttgagttcccttgtagattctctttactcttctcggtcaatgtaactatcctgggtccaattattgctcatatcaagtggtaaatttatttctgttagtgttaatcactaattaacttgttcactgctcatgggtcctcagagatgtctggagactcttacagttggaaaagccaggaatcttgaggtgcatagaactataaaagaattataggttgtgaagttgttagtttgaggcatatatcttttgtccactattcctatgtctagggcctatctcattcctgtagacttattatgtgttcttagatgaataattatgcagaaaaactttctgggattttttttttttttacttggagacaaaaggactcagatcctatgacatgatagttgtctatatcctttattgcagttgatgggaagactcagaaacaaacttggacccagataatttccttcttctagatatcacccaaggccgggcatggtggctcatgcctgtaatcccaacactttgggaggccaaggcggatggatcacttgaggttaggagttcaagaccagcctggccaacacagtgaaaccccgtctttactaaaaattcaaaaaattagccaggtctggtggcacatacctgtaatcccagttacttgggaggctaaggcaggagaatagcttgaacccaggaggcggaggttgcagtgagccaagatcatgccactgcactacagcctgggccacagagcaagagtctgtctcaaaaaaaaaaaaaaaaatcacccagtggcagtatcaaagaatggcttttccccagctatcctaaagatatataaaacaacatgctgttacacaaatagagctttgttacaagtcacctcatcagtactttcagtcagatgacagcccagagcccctctggtaacatgatagagcagccacgagtcacactatgagcagatcagacatgagcctcattcaacaccaagaataacctgctacaaagctagtagcttaaaattttggggaaggattattttgtaaggtttctcctctgtgttttcataattaacatggaattttagagctgagagagtctcagaagtcattttcctaacccccccatgttatatatggagattctgagggccagagagagaggtcatctgcctgcattcccatagatgatgagtgcagggaagcccagatttatgccccttcttgctcccaggccttccatggctcactgtcttcaactgaaggtgactaagataacaaggccctcgaataatctggctctaccatcctatccactgcctacccaggatgaactccttttgctcatgaacattctacgtgagaaatggttacagacagaagtagatagagcagctgggaagcagtttcaataatctgggtgaaagataatggtgacttgaatcagagttgtggtagtagagttgcagaaaagtgaacagattggagattgttttatggagtgaatcagaagaaccttctaacggatctaatatgtaggtgaataaaaggaaggaatcaaaggtaacacctagggttctggcttgggcaactgaagataaagaagataaggcagaggcaagagagtattgggatggggggctgggggcgcggcatgaaagaaagagttctctcaatgttccgtgtataacaatctgagaggtggcatggcatatgtcagaggaggaacaatatttcccccttttctgttttccatgaggagagacttcccttaacccgtccaccctttggatccattccttggtcctcctcagaaaggtagggtgagttatctgatgagggaattagggagactaacagggcatgcacaacctagctccttcctccctttaatccttgggagtcaggccacccccaaagagcagtccttcagttcctcgatgctgtaatttccaaagggacaggccccttgcatggggaggactatgggcatccagcattttctgtgcttgggagggtaggtttatctaattctggtgctgagaattatacacgcctataaatataagcccatattccagtatctgtttcataagccataaatgtgatattttgatatcccatatgcatttcttttttgtcttttttctcatctgaattggttcagggtagggaagaaagaaggtaggtattgggtcctctcaaaactcaagagtgggaggaacagtgggagaggaacacagagtccttcctctaacactgtggccctgtgacctcaggaagaggacctaacttctcagtgcttgtttcctaatctatgaaaggaaagggatagcatctactctacatttctcaaaaggttattatgaagatcttaataacaaatatttgaatatttaaatgttcaacatttgaatatttgaataaccaatatttgaatgtaaccttaatattccaatatttgaatatgactttgagccgggcacttaaagtgccagtggcatatgttaagagttgtggtagtagagttggagaaaagtgaacagatttgagatggttttacaagtaactcaaaagaactttctgatggacctaatatggtaggtgaataaaagaaagtaatcaaagataagacctaggtttttgtctttaaactgccaggcttgggggggaagttccaaggtggccaaataggaacagctccagtctgcagctcccagcatgagtgacgcagaggacaggtgatttctgcatttccaactgaggtaccgggttcatctcactggggcttgtctgacagtgggtgcaggacagtgggtgcagcccatggagcatgagccgaagcagggcaaggcatcgcctcacctgggaagtgcaaggggttggggaattcccttttctagcccagggaagctgtgacagatggcacctggaaaatctggtcactcccaccctaatactgtgcttttccaacagtcttagcaaacggcacaccaggagattacatcccatgcctggcttggagggtcccacacccacggagtcttgctcactgctatcacagcagtctgagatcgaactgcaaggcagcagcgaggcttggggagtggtgcccgccattgctgaggcttgagtaggtaaacaaagcggccaggaagctcaaactgggtagagcccaccgcagctcaaggaagcctgcctgcctctgtagattccacctctggtgcagggtatagctgaacaaaaggcagcagaagcttctgcagacttaaacatccctgtctgacagctttgaagagagtagtggttctcccagcacggagtttgagatctgggaacggacagactgcctcctaaagtggcttcctgacccccgagtagcctaactgggaggcgcctcccagtaggggcagactgacacctcatacggccaggtgcccctctgagatgaagcttccggaagaacgatcaggcagcaacatttgccgttctgcaatatttgcggttctgcagcctctgctggtgatacccaggcaaacagggtctggggtggacctccagcaaactccaacagacctgcagcagagggtcctgactgttagaaggaaaactaacaaacagaaaggacatccacaccaaaaccccatatgtacatcaccatcatcaaagactaaaggtagacaaaaccacaaagacggggagaaaccagagcagaaaagctgaaaattctaaaaatcagagtgcctcttctcctctaacggaacgcagctcctcaccagcaatggaacaaagctggacagaaaatgactttgacgagttgagagaagaaggcttcagaagatcggtaataacaaacttctctgagctaaaggagggtgttcgaacccctgcaaagaagctaaaaaccttgaaaaaagattggaagaatggctaaatagaataaacagtgtagagaagaccttaaatgacctgatggagctgaaaaccatggcacgagaactacgtgacgcatgcacaagattcagtagccgattcgatcaactggaagaaagggtatcagtgattgaagatcaaatgaatgaaatgaagtgagaagagaagcttagagaaaaaagagtaaaaagaaatgaacaaagcctccaagaaatatgggactatgtgaaaagaccaaatctacgtctgattggtatacctgaaagtgacggggagaatggaaccaagttggaaaacaatctttaggatattatgcaggagaacttccccaacctagcaaggcagaccaacattcaaattcaggaaacagagagaacgccacaaagatactccttgagaagagcaactccaagacacataattaacagattcaccaaagttgaaatgaagaaaaaatgctaagggcagccagagagaaaggtcatgttacccacaaagggaagcccatcagactaacagtggatctctcagcagaaactctgcaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaacaccaggcctgccttacaagagctcctgaaggaagcactaaatatggaaaggaacaactggtaccagccactgcaaaaatatgccaaattataaagaccatcgatgctaggaagaaactgcatcaactaacgggcaaaataaccagctaacatcataatgacaggatcaaattcacacataacaatattaaccttaaatgtaaatgggctaaatgctccaattaaaagacacagactggcaaattggataaagagtcaagacccatcagtgtgctatattcaggagacctatctcatgtgcagagacacacataggctcaaaataaagggatgcaggaagatctaccaagcaaatggaaaacaacgacaaaaaaaagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagaacccagattcataaagcaagtccttagagacctacaaagagacttagattcccacacaataataatgggagactttaacaccccactgtcaacattagacagatcaacgagacagaaagttaacaaggatacccaggaattgaactcagctctgcaccaagcagacctaatagacatctacagaactctccaccgcaaatcaacagaatatacattcttttcagcaccacaccacacctattccaaaattgaccacatagttggaagtacagcactcctcagcaaatgtaaaagaacagaaattataacaaactgtctctcagaccacagtgcaatcaaattagaactcaggattaagaaactcactcaaaactgctcaactacatggaaactgaacaacctgctcctgaatgactactgggtacataacgaaatgaaggcagaaataaagacattatttgaaaccagtgagaacaaagacacaacataccagaatctctgggacacatttaaagcagtgtgtagagggaaatttatagcactaaatgcccataggagaaagcaggaaagatctaaaattgaccccctaacatcacaattaaaagaactagagaagcaagagcaaacacattcaaaagctagcagaaggcaagaaataactaagatcagagcagaactgaaggagatagagacacaaaaaacccttcaaaaaatcaatgaatccaggagctggttttttgaaaagatcaacaaaattgatagactgctagcaagactaataaagaagaaaagaaagaagaatcaaatagatgcaataaaaaatgataaaggggatatcaccaccaatcccacagaaatacaaactaccatcagagaatactataaacacctctatgcaaataaactagaaaatctagaagaaatggataaattcctggacacataaaccctcccaagactaaaccaggaagaagctgaatccctgaatagaccaataacaagctctgaaactgaggcaataattaagagcctaccaacaaaaaaaagtccaggaccagacggattcacagccaaattctaccagaggtacaaagaggagctggtaccattccttctgaaactattccaatcaatagaaaaagagggaatcctccctaactcattttatgaggccagcatcttcctgacaccaaagcctggcagagacacaacaaaaaaagagaattttagaccaatatccctggtgaacatcgatgtaaaaatcctcaataaaatactggcaaactgaatccagcagcacatcagaaagcttatccaccatgatcaagtgggcttcatccctgggatgcaaggctggttcaacatacacaaatcaataaacataatccatcatataaacagaaccaatgacaaaaaccacatgattatctcaatagatgcagaaaaggccttcgaaaaattcaacagcccttcgtgctaaaacctctcaataaataaggtattgatgggatgtatctcaaaataataagagctatttatgacagacccacagccaatatcatactgaatgggcaaaaactggaagcattccctttgaaaactggcagaagacagggatgccctctctcaccactcctattcaacatagtgttggaagttctggccagggcaatcaggcaggagaaagaaataaagggtattcaattaggaaaagaggaagtcaaattgtccctgtttgcagatgaaatgattgtatatttagaaaaccccatcatctcagcccaaaatctccttaagctgataagcaacttcagcagtctcaggatacaacatcaatgttcaaaaatcacaagcattcctatataccaacaatagatgagcagagagccacatcatgagtgaactcccattcacgattgctataaagagaataaaatacctaggaatacaacttacaagggacgtgaaggacttcctcaaggagaactacaaaccactgctcaggaaagaagagaggacacaaacaagtggaaaaaaattccatgctcatggatagggagaatcagatcacgaaaatggccatactgcccaaagtaatgtatagagtcaatgccatccccatcaagctaccaatgactttcttcacagaattggaaaaaactactttaaagttcatatggaaccaaaaaagagcccgcatcgccaagtcaatcctaagccaaaagaacaaagctggaggcgtcgcgctactgtactacaaggctacaggaaccaaaacagcatggtactggtaccaaaacagagatatagaccaatggaacagaacagagccctcagaataataccacacatctacaaccatctgatctttgacaagcctgacaaaaacaagaaatggggaaaggattccctatttagcaaatggtgctgggaaaactggctagccatatgtagaaagctgaaattggatcccttccttacaccttacacaaaaattaattccagatagagtaaagacttaaatgtttgacctaaaaccataaaaaccctagaagaaaacctaggcaataccattcaggacataggcatgggcaaggacttcatgtctaaaataccaaaagcaatggtaacaaaagccaaaattgacagataggatctaattaaactaaagagcttctgcacagcaaaagaaaccaccatcagagtgaacaggcaacctaaagaatgggagaaaatttttacaatctacccatctgataaagggctaatatccagaatctacaaagaacttaaacaaatttataagaaaaatcaaacaacctcataaaaaactgggcaaaggatatgaacagacacttctccaaagaagacatttatgcagccaaaagacacatgaaaaaatgctcatcatcactggtcatcagagaaatgcaaatcaaaaccacaatgagataccatctcacaccagttagaatggacatcattaaaaagtcaggaaacaacaggtgctggagaggatgtggagaaataggaacatttttacactgttggtgggactgtaaactagttcaaccattgtggaagacagtgtggcgattcttcaaggatctagaactagaaataccatttgacccaacatcccattactgagtatatacccaaaggattataaatcatgctgctataaagacacatgcacatgtatgtttattttggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattgtgagcaaactatcgcaaggacagaaaaccaaacattgcatgttctcacttataggtgggaactgaacaatgagaacacttggacacagggtggggaacatcacacaccagggcctgtcatggggtgggggggagggaggagggatagcattaggagatatacctaatgtaaatgacgaattaacgggtgcagcacaccaacgtggcacatgtgtacatatgtaacaaacctgcacgttgtgcacatgtaccctagaacttaaagtataataaaaaaataaaaataaaaaaataaagtgccaggctcaaagtcatattcaaatattggaaacatcacttgtagttccaaatgcattcactaaggaatttatagatggaatttctacaaagagaaaattaataatggaccaactaatatttctattgtaataataattattattatcatgattattttactatatacttctccttaggaaaatagtggttatcaaagatgacagccctacaggaagagatagaaagaaaagtcatctgatgctcctttattcacgtttttctatttcaaatatggaaaagctggccttattatttagctttgtacacttatagaaaatttgagaataagaaatgcattcgtaataaatgggctcttttttctaggaaagaaaaaaaagtatctttcataaacctggggtgatatttttttaaatacgctttcacatacaagcccagggattatgttctgctaaaaataatgaagatgcagatattaaggttctgtgtagtttttagtcaagaaaaaaaaagctctcagaaacagctacacggttgataaagtgtggttgagtttcccttcgacgacttgtcacagaagggcaccagcaagtcctgtggctgaattttacaaatcactaagcaagttttggagcgttaacatattgagggagaagaaatataataacaaaggtgattgtcccacatccttcctggtggattcaggaagatggaaaatatttcttttctgtatacaaaagaaagaaaaagagtcctgaaggggacattcaccatcaggaactttaggttaacagagacaagacctcaatcaatgagcctgagaattgctggcatggtaactcctgggttgctgctgctaaaagttcctggtagataccaggctaagagatatatcaaagaaagaatatttattatcgttctcattctaataaaagcctggatattgcataccaagtgtttaaatacaaatttccctgtcacttgttctacttagaatggaagggcaaggtcctttttacattgcaagacattgcaatatagcaaataaattacaaccaagggccacatggggtaacagtttaaagtgtaattaaactctgtgtatttaaaagaaaaacaagtatttcatatatctgatattaaaatggaaaagaaggatacactcacaggccacatggaagtaaaaaaataattgttttatgaaagaggccaatgagatttaaaaatatgattgtaaaattaaaaactgggaacaaatacttattttcatattatatcagtttgatagtaaggtaagtaaggtcatagaaggcaagaagaggattaggaaaagagaaaagagaatgaggagaaaaagagacaggcaagatgaaggataggaggagggagaaggggaaaaatggggcgcaccaggggaagccattacacaaaaggaacggcaggtgtgggatgtccaaaaagaagaaattaagaggacaagacaaataaatggaaagaggagaggaaacacagaaagactaagagaaaagaggagatgttgagatagccagcagttcaggggactctgaagcatgatagataaatgcatttaactattcctttgagctttggagcattaactgttgtgatcactgtctttggaaatgtcatttagctgtttaacaaaactggtcacagatgactttagaagaattgcgggggttaagtagtttctagggtaatggtagataatccaaataaaaatatcttgagtccaaaaacaaatctgacaatcttggaggacacttcctggaagcaagtagagaagtacagactagaaaaacataaatattctgtgctcttggttcttcaggggaaagcagaagtggtggtggtggcagagcatttgctttcaccaaaggctgagctctggctctttacatacattaatgtgcttcaagttaccacccttacatcagagagttcccagcctgaccttttatattctccctagcaaatcactctgccttgcccaaaagatatcaccacggtgatttaaataaacatatgaaatgcagaatacattttctttgctccaacattgccattattaactacatcatcaccactggagtcacagtctttctctcctgctccatccttccaaccttgttcattcctcttctctactggtaatagatgaattgcttgatcccctgaaccttcatgtctccaacagtcacagcctggagcatgatagccctgcacctgaccagttgaccagggaacctgtcctacccttatgtatgagaaaatgcaaggactcttggcctacaagtgccctagctcagcattattttatttatttattttgagatggagtctcactctatcacccaggctggagtgcagaggcgtgatctcggctcactgcaacctccaccccctgggttcaagcgattctcctgcctcagcccccctagtagctgggattacaagcacctgccaccgtgcccggccaatttttctatttttagtaaagacagggtttcaccatgttggccaggctggtcttgaactcctgaactcatgatctacccaccttggcctcccaaagcgctgggattacaggcgtgagccactgcgcctggcccctagctcagcattattagctaaaccccctggtcctaatctgaccttgtaacccagtgctggtatttaggccacttaccctgtgactgaatttttcattatattcctgatatggtttggctgtgtccccagccaaatctcatttcaaattgtaactcccacaattcccacatgttgtggaaggaatctggtgggaggtgattgaattatgggggcagatctttcctgtgttgttctcatgatagtgaatgagtcttccaagatctgatggttttaaaaatgggagtttccctgcacaggctctctctttgcctgccaccatccacgtaaaatgtgacttgctcctccttgccttctgccaggagtgtgaggcctcctcagccacgtggaactgtgagtccattaagcctctttttcttcccagtctcgggtatgtctttatcagcagcatgagaatagactaatacatttcctttccctcatttattcatgtaacatataacatttttattgagtatctacctactatgtgctaggtaccatgccaaacacagggagtgctacaaagccaagaaaatcatagcatctgccttcaaggagctcacagtctaatggagagaaagacaggtgagccaaaattaaagcaaccaaaactggaataaatagcaagagtcatacagataaattactatggaagttagtggaaaaaagaatgaacttccatggagagtttgccattctcattatttatcttgacaaagtcatagtctaggcctcattccagtctggctccatgagcctgcatccagtgcattcacccagggtcctgtgccaagaagagtccccaaacccacccttgaagtttaatgcactacagtcattatcttgaaattcttaataattttattttggaatttttattttgtacatgaggtctgatggagcatgcctcagaggttcacatacagtccagcctcctgatgggttctcagcctctgcctcctgccctagctccatgagccctgccttgttctattcagggctgcaacagggtcaatgaacagagatacctgtgttctactgttgccctctgtgtctagcagggtccagggtatgggtatggggagagtcagtgtccctgggtagggaaaggccctggccatcttgggatgtccccaccccaggccggcagcaccatggcatgttcattaagtgactctatgggggcttcctgcccacccctgatccaggtagcaagcttgtcaggcacagaggttgtcatcttttggggcttgcccatctaccatgggtcgggtggctgcctgcaggggctggcctagggaaggggagattgacttccctgtccctagaaagacccctgttttcatttttcactgagtcctataaattatgtagctgggtctgatcccagttcttgaccttgtaaccctcagagcttagaggcaacaatctcattagcaaatttcctacctccagtgtcctatttcccagagtcctattctccaatccattctgaagagtgaaaactgaaacaggaagaatcatctccctgtgccattctgatccctttcccaaagcctaactggctttccctctcagattttgttatgggcagttaatcatgcacacaagcacaggcctgtgaaaatcatgacctgctggagaggacgctcaccacttaaaggccctggactttgacggcatgcagtgactggatgggactggggctggggcccactctgggtcaggttgaagctacatttgccagcctccctgcacttggctatggccacatccctgggttctagagtctagaaagacattgaaatatgagcaagaaatgtgtgccacttcctgacaggacaggaaaatctctcatttcatttcccatttttctctgtctcttccctcatctgctgatgggctgttaatgctgacagcaccctttgaacccctgtgttgaggctcaggaaggaaagaatcctctcttggaggagagccatctatcaatcaggaagactgtgctgagcctcagaagagtgagaaatgagcttccattgtgttactcctgtgtgccactgagctttggaagggtatctgagaaagcaaatatggtttctttaagtaatgattagtacatatatggaaaaaaaataaaagaaaacaaaaagagaagagaaaaattagtcataagcccacactcagagattacctctatcaatgttttggcatattgacctccaccctttgaccatgcagtattctaatttctttttactgagcccaaacaaagtgacaaacagtgttaagcacttttcaggtttaatcttggcaacctcttaagacagaaggtatcattatcctcattttagaattgcagaaactagcaactagagaggtaaaatatggcacagcccttggatatggtggaactgggaatcgaattcggtctgattctgaaaatgatgcactccaccatttcccttatgcgtctgttgttactgttaagaaaactgagattctgttgaataaactttgttcacttaatagtattctctgagcaatctcctatgattaaatattcccttttataatatatcataattgattcatccaaccctctagttggatgtttggattgataatttattattattatagataatactgcaacaagtattcatatagacaaatctttgcacatacccataaaatttttcttagcatgactggaattgttacataagccattgtaaatattcttttttttttttttttttttttttgagacagagtctcactctgtcacccaggctggagtgcaatggtatgatcttggcttattgtaacttctgcctcctgggttcaaacaattctcctgcctcagcctcccaagtagctgggactacaggtgcgtgccaccacacttgggtaattttttgtatttttagtagaggcgaagtttcaccatattggccaggctggagaagttgtgactattcttaaggcagtatacggttcttgccaaattatcctatatcagttgtggttggcagagtcgggcagtgggggtgtgattttactaccaggggatatttgacaatgtctggagactttttaaattgtccagactaggcaagtatctagtggagagaggcaagggatgctactaaacaaccatcctacaatgcacaggtcaccctacctccaacaaagaattatctgtccaagatgccaataatacccctgttgagaaagctaacccacataatgacctcatcagtgtgtgtcagtcttgagacaaaataaagtttataataaagtctcttccacttactcaaacatgatctaccaagcgtctactctatgccagatcccgtggtaggtactaagttagaattcaagcatgagggtgagataaatagggaagagtaaagagaggaggtggctcggaagcaaagtttgacttcacttggtagtaagaaagcatatctattccattttataccttcatatctttctatataattttctattaaattatttccatgcgattcttcattaaatatataacctcacaaggtagtcacaagaaatgattaatattgctatattgctacctacaggaatggttgatcctgattctttttaggctatttctgaagaacaaaattagttttttcttcaacagaaacccaaagtcttaagtatgaaacattcttataatgacagtagctcttcttcccccagttgacctttttgttctttaacatagcaaataatcttaatttggttaagtcagaggtagaaaaatattttcctgccctttatattttaaaactcctttctatctattcacagcaggcatgagtaaaagaaaggatcaaatcagaggctgttcctcttgttcattcattttaaaaatgaatggcaaaagagattggggagagatgcctcagcttccagctgttcgtctccctgcttggttaattcatggcacattggctgccactggttcctctctttgcttctctgcatgataattttagggttatgataaaaaggagggctatggctagggctgtcttgggctttcaaagccaatgatcaaagatggggaagtgagagaatctgactccagtctcatatacctgaagacagaaaaaaaaaaaaaaaaagaagctaccttagcagttgcacagagtaacagagtgtgcaccctctcacttagtggttctctggaagcaaaaggaaaaagaggctaacagggaagtgtgagtagccataaaggtggccattagaaagagggaattagagcttcacttttccagaggactttattcagaaaagaacaaaaatctggactggtttcttgagcaaccctgggataatctttcccacagtgtcccaagcctgcagttcttaatgccattacagctgttatgaaaactttaaatatgtaatcatgcatattaagttgccaaatacccataaaaactgttagttcattaaactgtgcatacccatttaaatgaaaaaggagtaccatttaattttttaattgaaaaatgtaaaggttaaaacattctggtaatctgataaagtagtacatgcaacataaatgcaaaaatgtaatgctagtattaaaagtatcatcatttccaaacacaaaaacataaagaaagcctatgttttatataaggaatagtcaacacatctgcaataaaattgtgtcatagatatacttagcctactaaattattagatcttgattataggcatgagatttagtgttcatttattctttaatgccagctgctagaattgatttagtttgcaagtgcttgagccaaataccatcatttttaaaaatttttaatattttgacaacaaaactacaaatcatcaacttggagatttcatatggggatttatttcacagagacccaatgtatacttcggaaattgcattttgtactagaaaaataggcatgttgatcaattgtaacaagaaatttaacatatctgtgtttgtcaaaggtagaatatttattatggactctaaatcctgacagcataatattcatttaaaggatttgatctctttacattttaaagtaatcatttcttgtgtttcagggattatgtatgtgtggtactgtgttaaacagtacctaggatttgttttaatggggtatggtaaagcaaacacagaaatgactgtcatgaagaaagttcatactcacagaccctagaaacgggaggcatggcacactgtgcagggccgcatagggaaaggccagggtcagtccagaggcagaaacagggcagagcatggcacagaacctttactagggtcttcagggaaggatgaactagacagggtaggtagctgagtaagtttaggattggctagtttgaataattttggcaaactatgggctataggagtggtctttagttgttgggtacctggccctgggtgatttagggcaaggagaatattgtctgggtgtatgagattttgataaaggagatagttagggctctggatcggctgatttatatatcagaggtaccctcaaaagggagttcttcactctctccagaaattagctagccctgggaggggcattctctccagggtcgtaagcctcaaatgctagaacatcaagaacacagaaaatgtggaattatagtcaatacaggtactaccacattttagatcaaaactctcctattatgttcaaagccctttccaaagacaacactgtgaataaagccttctggactgtgtattttaaaacattaataaggccttacatttctgactttatccattggaaaatgcttttccattatctcattgccatctaatgattagatttgatgattagaggtttacaaaatactatggggtagacatgtctgaacatattatccctatattatagctaaaaaactaaggcagaactgggaatagaaccacaattcctgactgtaagtctagagcatgttctgtcacactctgatgccttttacagtttaacaatgttattagtaacctaagaattcaattgtcaggcaaatggatttaatgaggttgtacagagaacaggttgcacaaactagatcaaagtcacctcttcgctgtaggtgtgttcggccaaggttaccttttatggactgtctttggggatacagaatctcacgaataaacagaataacttgaagagaataagggagtcagctccctcacttaccaacggagtcactttaagcaaattacttaaactgtccaagcctcagtttctccttttgtaaaatgggtgtggtcatagttacctcaggggattgttgagaggattaaaagagacaatgcttgctaacgagctgtgtggctcaaagttagtactccataaatgaagttactattcatccacagtgaagcttccctctaccttctgttattatgttaaaaaaaaaaaaaagtagacaccctgccgggctcagtggcacacatttatagtcccagctactcatgtggttgaggtgggaggatcacttgagcccaggagttttaattcagcctgggcaacatagtaagatcttgtctctaaaaaaaagaaaaaaatagacaccctaaagaggtatctcataggtttcccctttttttttcttcaggaaaaaaagattttttctcctgaatttgcgacagcctttaagctatattttatgataggaaacataatttgtcattaatatatgaaaccactgttcagtcaaaaacaaccaattaatgaaaaaaacctcaggaattatagaaagtatattttttaatgccagaaaaccttctttactattttaatccaaataaataaatatagcctcaatgcctataaatgaccaggaactgaaacttctcctaaaatattagcaacttaacccactcttttatgattaaactgcctttatctgattaaaatttcactttccaaaagaatgtggttatatggcaaaatactacccttaaaataagcagcaagcaatgtacctcaaggaccttgttgactttcctataaaacaactaaaagctgtttcagagaaaagtttgtatgactcttcaacattatattcaacatgaaaccctaacttccaaattaagccaggcttgtcaataaacaggtgacccaaacctcaggaaccaaaataaattggtcagaatagtaaacatttagcttatgggttgggaaaaaaatttagttaaccttaaattacctttacatgattctgtaggaactgtgcctttctgtaatctatcctcatgtacaaagcagcaaatgtaatttgtccttgtgtttatcacgatcatgtgtctgtcaggaagagaggctgaaatagcagagtttcctacttcaaacacaaaatcaactctggttctgggctagtgaacatgtttgcgcgcttgggggaattttttttaaacactgtgcaaagctggaataagatttcatgaaactcctttataatatcagtgttggagtaggatcaacatctgcctttttagacaaatctcagcaactcaataacatgagtgtagaccatatctatcagcactggctcatcagggaacgaagcactctcatcgctgaattttctagacacccaaaattaattcctcctgaggcaaacactttcaatgtgattatttcaatggagattattccaaaaagaaaactgaaattcaatgaagtactaaatattgttattcatattattagaaaatatatataataaatatatatcagcatattataatgcattcttaaatacaattttatgtataattttttgtgttgttttccaactcctctcttcaaggataaggcactcagctctctcttctcatatcatgagaaggcaagcaggttctaaatgagcaaagatggagaagaagtagtcctggcagaaaggatgcaaaatacaggaatagaaaagcactatctgggcattgaaaacagcctataatttaattaggatggtgctgaggccacatgaagggctgaagtagacaaggctggattaagattgaacttctctaccttagactccatatgactcagattcagggcccgcttcgtgagcatgtgaccagtgcagtggcatgaaagacccctgcttgaggtttaatgctatgctgtgcgagattcttaatactttttatcattgaatttgtgctttgtaagcatagtccaatggaacaatggagtatgagccccagagtccagaaccttggttcacatacagtctcccctcccactgcctgcccaggactggtttttggccacctgatccccgctccatggtgtcccaggcctcacccatccttcccagtctcacctctgcccttagcaaccaggtcacatgggctgagggagaggcccacattcatgtctgccattgcactctgctcttagatggggtctagggagggtacggagaagggcaggtgcatgccccacaccacctcagggaagtgcaaggatgtggccctcctcacccagagctggcagcagcatggcacctcaggcaggcaattcagcgggggccccttgcccaccttcaatccaaatactgagaatgcctcagcctagaggttgcaatcccttcggactctcagactggagcttgctatggattaggggacagactcttgggaaggggagactgacttctttaaccccggccagagtcctgctttaccatcttgcactaggctccacagattatgtagctggccctacttagaatctttccccttaacccagcttctctccctgttctggataaaggcatcacacttcctcatatctcctgggtttagaatctgagtcatcattgccctccctccctcctttcccaaatccaaacccacaggccacttcccatctgtctccttctgcccattcccactgttcatgcttgagtttaattgttcatcatggctccaccagaccatgacagtagactcctaatcatttccacagctttgagcctctccttgttcaatccattcagctgctgccaccaggttacccaaaacaccactttgatcatgctaagatatttttaatggctccctgtggcctactcttggtgaagttcaaactctttagctaggtgttcaaagtccttccttcttttgtcctcaccttacttttgcaaatcattctatgacaatagaatgtcatatatatgcaatatgcaatattttggccaaattaaaccactcactctcccttatacatattttatgcttggtcatcactgtgtctctgctaaagctattttgttggacttggaatcacttctccctaccccacaactatctctaactggaaaatctaatcctatttatagctggaatggtgcctcctccatgaagtctttcattatgagcccagtcacaaagtgactccatacttgtccaagactaacatcatttagtttgtacagcttggtactagttttttgtggacagtacatggctgtctactgtacacccttggagagcagaagcatatcctgccctttgtacaccgataggccctctacccaaggccttggggataatgggctctttctgtgcatgtttgttggaactaatgaataaatgaagctgttgtgtaaacagatcaggccttctgaaaggcaggcgcacctgtaacccttcagcgtcatcccctttcctgctctcagttcatctaacaaaacatcctgctgcttttcacacccaagcccatcaaacacctgtattatcattatcaacactgacaaaaattcacctcacgatttttatgaatgtttaaagtgctatattctgaatgcttagaataatctcagagaacacctgttacttgaatgctcttattttcaacctcttgagggcaattttttcattactatattaaagtggactgttaaataacttataactatctggggaaaggtatactgcagtcactatgatctggactggatacctaaaaatgaatgttttttttttttccatttacgatttatttttttcctaatttcaagtctgtcttttaggactaattgaggaaagtaatgcaaaataatgaaataaactgaggggttttgggctgtcagaacttctattcaattttagcatttcattaaatattctacccttgactccagaatgccacgcttatcatcataattttgtctcttcaatgcctttctcttgcccatattaggaacccccaagagtatcatcaatataattattaaatgattaaatttggaaattctgtgtgataaaaaaaaaaccttacctcctgaagaaaaaatacactgtctgaagctgagcaagaaacaccttaaaaatatagtagttaacaaagaatcaggaaggatggttacatatttacatagaaacttcaagatgcttgcatatatggtacaaattaaaacatcatcacaaaagaacatgtatttggaaggttgtcggttttcattaagagaaatctgtaacaccaggaaatgcaaaggatggaggaaaatgctagaactggggaaggatgcaacatccttccctacaacaaccctataaaaagtttatactgcatgtcttactaacaggaacaaagtatagaacttttgataggctaggatatagtgttaccaaaccacatttagggacattttaagtagagaatggaaggatagatattttcatgttccttgaatgtaaacctggtttcaaaatacttaatttaagggtggagcatggaaaagattaggctggtcaaaatgtgctgacttcacatctcagttccagataaggagaaaaacaatataaaataaggtaaacagaaagaaaaagaatatcagcaaactaggtatcatcattatcttcataaactgtaaccatttcctgggtaattgcaatgtaccagatattattttaggggctttgacacaatatctcattttattgagataaacaaaaataatctttgctaggtaggtattattgtccccattttatgggtgaggaaattgaggctgtgagagattaagaaattctccaaggtcacaccattggtgactgtagcgtcccataataaagaaaaaaaagtagctttatcaaagaagagtagcataagtaaaatgaagaaaactacaccaagttaaaaatacagagatacataaaagaagccaatggaaaaagaaaagagaaactttctaaccaaatgaaaacaaggtaaaccaagggtaaattcccaacccatacagcacgtttcccctacctgccttttgccagtcctcccaacaacccagtccccttttgtggccatcattactactctggggggaaaagggaaaaaaaaaaactcctctttcccaatgtcagcttccaaaaatattaaaaggcaactttgctttacactctgcagagtaagggtagagcccacaggaagcatcagctgctgaaaacctgctttcccctgcctgtgatgacacctacagccacaattctagacagcagcaagacaagttaactgttgaagaggctaagaattatgctcttaaagaaaggacagtatgaaataaaggttagggcctgaaagaggacggtaagaaataaaagctatagaaatgggagaaaatcaattggggatgaagttcaaaagtaagggcaataaagagaaaaggctgcaaccctaggctggaataagtatcattgaactaggaagggatttttctttagcccaagcatacaaaaaggatgtgggaaaaaaaaattggaaagaagaaaatgtgtgattgttttatttctctagaaataataatttgtgacaaaatttttatagaatcttcaacatatgaattattaaatgcttatatttcttctcatagctttctaggattgtagaggaataaacacttgttgaaaaccactcattgttgcttcacctacaccttttaaagtttccaagaaagatacaatgaataatgcacttagtctataataaaaagttaacaaaaatggtattttgagaaacatcctttaatattaaagtgttaggttggcagatatctcacaaaaatatgaaacttggctttagtacaagctagtcaattttctatgtaaaattgtcaactttcagatgaaatagataaaattttacctttagtgtccttcccactctttttgctattctcagcaacagcaactaaactctagagaaacatgtagctccctgagaccactggaagaagtacttaccagatgactataaaactttcctaaccaaggatgagaatttttaattcttatgaaccctgaagaagtctcatagaaaataacatcaagtctcatcatattcagtgaataagtactgaagaaattagaatggactggtttcagatccagcatctaatatcaagttcaaaatgctgtgaaaatgaaaggctcagaaaacccagatgagagcatgttgggtttccttttccacttgaaactaacatgtttaccctgctgatggctttggagttgctaaaaaattatcaatatttgttgtttgtttcataaattaaaaacctacttgctcagtcctatcaaagctgactacagataatgctatatttgagcctaaagataactagcccctctatctgtccaatctttctaatcttaataacagaaacagttacgatactaagaaggcacaagtgagtcacaggaccatttttcccctgacattcctcttcttttcctcttttccctagcttaccacttgtgcaactctaatctagagaagggaacagggaagtagttaagcactttgttctctttccaatattgacttagagaatgaagcattatggtccccaaaagacaccaaagacaccaaaatgctcatcttaacaccggaattctggagcacacatctttttctagcaactcacaaacacatactaaaaccacacattgacatattaaagagaggaggagggagctgtggatgccagaccagccaaagtgtcagtgttaaagacaaagtgtcttgacagagaaatacgtggtgttattgggtgatatattaacttcccacaagccattgggtgttaagaaaggaccaacacatcaaagatgccgtagtaacattctaactagtctaaactcgggaatttaaatagcaaaatttgtattgtaaagagcctaaattaatgtgttcctggatgccagatgataaccgaaggcttatctcccaagccaatggggctctgggagaaggggacaatgcaaagtcctacctggtaggcatcaggaatgttgaccgtttctccatgctccccgacatagccaatgatacctttgccccaggggacctgcacctcatttgagttctctgtgctgctgcaaggcagcagaggtgttcctgcatgcacatcaaagaatttggagaccaaggtcttcttgccagcagctgccccttccaccaggaaaagagagcagcggtcagcatccaccataaggcagacaaagatgagaatcttgtagctcaggctggtgaggtcaaggtcattggagatatctttgaccaattccagaaagaactgacgctcattatgctttttcagatggcacttgtagtcgatggctgtagggggataccgaggcagattcactctcgattccagcagcgcactgagaatatgggctgtggtggggggcagggagcttgccttccggagaagtgccctccgtcgtacactactcaggggttcctgagcccgggaggtcacctgttcatcgtaggtcctgttcacgtggatggccttggagcgggcaaaactcttccttagctctttctgagaagctctccgctgcaggttcccatcgcccctgctgccaccggcccagctgggactcaagggaaccccaccacagtccccgccaccgggaaggggctggctgtgggcagagccatttggtccagtgccaccaccaacgctgctgccacctctgcaggtgctgtgagccaagctgctggtaccagccaaagagggccttggacctaaagccccctgaccctgactgtgcctctgcagccacttttcaaccatctcctgcttccccttccgcatcaagtaatcttcaaacaactctgggtgcctgtccaggaaagtttccacctccccaaagtccaggcgggaggctgccatggtcccagacagctttccttgcctgtttacacgtgaaccaaatgttttcctgccccgaggcctctagctgttcctgcacatgttcacccccaccagtattcccagttcagcgccacctcccctggagattattcccagcagtggaatctgggagatgccccttccttctctggctcagagtggctggcgccgaccccaccccgtggtcctgctactcctgctccgcacaggtgcccagcactgagctgccgccgctgccccggctcctgttccggaaacccgagctatcgctgctcctgttctggctgccgccgctgctgctggaactgctgctgtaaccggatgagtggaccgctgtgacagggaggtagggcaggacacgcccctgagtgaggcacggagcctggagggaggagagaagaggagggagccgcggacgccagaccagccaaagtccacggcccaggctgccaggcggttcctggaagagtctctggacggccggaatcggcgcctgggtacaggactcctgattggaacacgattagaagagggaaacgcaccttgttccttccccgcttcttgctcccttacctccccaaccctccctactcaccgcgccccttaatccgttagcgtttcgaggaggcccagcgggagcccagtgggagtccgagatacaagtgttgatgttttgcagggatctgaacacagaagcggactccgaggaatcgagagtgtcgttcaccctcagagacaggcagggttatttttctgggatgtgactgtggattgttggttcccaggattcctgggacttgctcactaacactgcccagcgccttgtgggtgctcagtaaatattaatggaatggcatttccccgaaaatagcaaataaagtttccgatgtgagcaattcatgactttaaccaaattcatgtacctggggcagagacagattacacagagaaagggtgtaaaacacagtacagaaaaagagtttaccaggtagaggaagtaagtgctgaagagtctggagtatttaattaacagcagggagaccagctaggagacagtaaaccaagcatagaatcctggtaatttggagctgctggtttccaagaaggtgagtggtgatcaagatttaaaaagaaaaaaaacaacgtttagcatagtgcctggcacataaaaagtgctcagtaaatgttagctgttgtattacttttgttattattattattctaaggtgacgatgtatggaaactttactgaatgtagctatgtctctggtcacttgagtgatctatcagtaaagatggttagtgatatgttgaaactggcttgtaaggactcacaagtgcctattttaaaatctctttccaattctgtattcagtcacatcatggagtttgcaatcagtcacaacgggaatgtttacaccatggaaatcagcaaatgttatgtgtcagggtttttttttttttaatggactgctaattgttaaacatttacggatatgcagtggaaataatccaaatgtccatcagctgaggaacagacaaataaaatgtgataactccatacaatggaatattattcaatcataaaatggaataaagcactgacacgtgctagtactcgaatgaagcttaaaaacatcatgcaaaatgaaagaagccactcacaaatgaccacatagtgtaaaatttcatttgtaagaaatgtccagaataggcaaatccatacagacagaaagtagattactttctagatggagaggaagtgggtgacgctaatgtgtatgagttttttggggggtgtggggggtaataaaaatgttctaaattgattgtggtgatagttgcacaatctgaatatgctgaaattcattgaattgtacatttaattgaatgaatcgtatggtatgtaagttatatttcaataaagctgttacaagataagaacaaaaaacatttactaccctgagactggtgataatacagcagcagtgttgtgcacggagacaagaaaagcactgagtagagatctgatgaaaatgaagcaatgagcttctcagggaagtgagagaagtagaccaaccctgggcttcctagaaacagaaagtttaataaagacacttccttaattccatcttccatgtattcattatacaagcagttgtttggcatttatcatgttccaggctctggggacaaaagaagaccaagacaaaagctgtgcttttgactaaagatctccgtctacagcaccaagagaagtgagagtggagaagaatactgggaaggatggggaaagcaatagaagagaaatccgaaaaactgaatgcaacatttcgagctgcgttttgaatcggctgtagccatgttccctgcttggtgtgtgaggtcactaaaggagttaatggttggggaagaaaatgagaaagtgacagaaagcacacataagatagtccagagggctgtaatggagggctgataataagatgtgtgttggtgtggccacattgccatttatcttcactctcaatctgcagaatggtatgtgtattagtcatagtcccaacaggaaacagagcacactcaaattaaattccaagaaggttaatttacaaaggaacaaattacaaaggtggaatataggtaaatgacagaaacagtgaagaaacctgggactcatagcggtagagaagttaccacccctagacatgaggggaagaggaggaaaaagttactaggacttggaaggaaagaagattggatagtgacttctgccttgaggggagcaatgacagcccatcaaaaggcatcaacaggccaagcatggtggctcatgcctgtcatcccagcactttgggaggatgaggcaggcagatcacttggggtcaagaatcgagaccagcctgcccaatatggcgaaaccccatctctactaaaaatacaaaaattagcctggaatggtggcatgcacctgtaatcccagctactcaggaggctgaagcaggagaatcccttgaacctgggaagcagaggttgcagtgagctgagatcgcaccactgcactccagcctgggcaacagagtgagactctgtctcaaaaaaaaaaaaaaaaaaaaaaaagacatcaacagctcaagctaacctcaaaggagggatattaggagtaaatattaataatagctggaacttattcttttccctcccttctatcagcaaccagatacaagctagaaggtattgaagcctgttgatacctcatcctcactgggcaaagagtaggaggggacaaagcaggatctgtataagatctgaaagggtgaaaggatgattcttggccctatatggaaacttgaagaggtccccttaggaaataatggaagaggtcccactaggaaagaatggccaatatggaaccttgaaggggttcctttggtaaagaaaataaaaatatatttccctttaggaaatatagctccatataattttctgtgtaattctgacctcttctgcttatctgctaattccatcgaaactatctataatacactccatgacaacatttgcagtctataaagccccctcaggcacaaactatcataccagaaaaggtgtgatattgtgaagatactgtgcagtccatagaatcccccagggcactatcacacgtgaaaaggcatgatactgtgaagatagatcactcagagcaaggaagaggctctgcaggctccttctccatctaccctttcccatctctatcagtctgtaaagattgtccaagtagcctctcattaaagaagataaaggagacttcctatttgtatttttcaagaatgaggagttcctttttaatataagtatttatttctttatcatggccaatcagcatttattgagtactttcaatgtgcaaaacattgggtggcaggcaagataacttttgttatcccattacattttagtactggatggaagcttatagttcttctagtactatgctttccacattttgctcatggttacattgaaatctagagtggacacataactcctccaaagtcacctgccaggccaacctctgatctcatagttccatcccacccttagcaacatctcacaatttggtattaacctcttaaagcccaatgaatttctgtctcctaagtttgcctcctaattattcgtctcctaaaacagacattactgacttttattgtgtgaccactgagcatcatcaaatatgtaaagggaggctgaaaacttagttacttaaaacaacaattttcctacttctcacaattctgtaggttaactagtggttcttctctttcacttggtattggctgaagtcactcatgtggctgcattcaactggcagctgggatgtgctggatggtccagtaaggcctctcatacatatctagggcctcagtgctgacttgtggctgaggctgctcagtttttctccaggaggcctctttccacattgtatctaattttccagttcctctttacgtggcttctgtctccagcaggataacctgcttccttacaatatggcatctgggtttcaagagggagtgttgcaagagggtaagcccaatatgcaagagcctatcaagcctatataatagttgttaatgccccattggtcaaagccaattatatagccaagcacatcagttgagagagggacaaggacatgaatactcacaggtgtggttcactgggagccactcatccaacaattcaccaaacaaactctctcctgaacctcagagccccatttcttttcttttctttctttctttttttttttttttttttttttgagacagagtctcactctgctgcccagataagtgcagtggcatgatcatgccaaagccccatttctaactactgcaaaatatttgctcctaaatgtttcacaggcacctcaaatttctcatctccaagatcactctcactcccacccacatgaaatcactcaatccagtatattttactgcagaaatttctgtttaaatccagctgccttctccaagcctgctttccttaattcaagccttcattatctgtccattctctaccaaccagtatcaccttccacataacaaacgtaaaaatggcacattaaggccttgtcaaaaggcaagtaatgggtcaaactgcagctccacaaaagctatgtccaccagaatctgtgaatgtcaccttactgggaagagggtctttgcagatgtaattaaagatctcaagataagattatcctggatttagggtgggttctaaatcaagtgacactttccttataatatatgtacaaaagagaagacacagagacacacagaggagaaggtagtatgaagactgaggtacagatggagtgatgggtctacaagccaaggaatatccaggattactggtggccacctcattctagaagagaggcatgaaacagatgctcttaggaaaaaaaaaaaaatcaatcttctgaatgccttgattttggagttctggcctccagaactgtcagagaataaatgtatgttgtttcaagtcaccatgtttgtggtaatgtgttacagcagccctaggaaacgaatgcaagagctttcttcattgcacctttattttccatctctcttctcacctcctgccacaactctccaagcattctccccttctctcttctgggcttctacttgaaatgctcttctccccttccctgactctcaaacttcttttttccattaacacctatttcaaatgtcacacatattatgtttcctgcttccccagtaaaaagctgtgctgtgtcctatgtgtcctgcttccacacatttggtcatctacctgctataaaccatagaacacttggtgtttactcaacccaacacgatgcatttaattctccatttaaaaaacatttaacattaaaacacactttactagtcttttatctcttcttctatcaatttagaaattgaaagcactctgagccagaagcccacctatagttgtattaaagactaataagtatctagaaggtaagtctttaaaatttcaaagatatcttggtgaacgataatgacccataaagttacagaaaaatgagcttcaatgtcatgccataaatgttttacatattttcttcatcttaaaatcaagagtatttttcaccagaaaaatcagcaataatcaaaatatcttgctgaagaataacttgttgataaaaaagttggttggttttcattattgaaaatattttctatatatttggagattcgaacttagtagaatatggataaattcaatatttaaaatattccttgaatcttcataaacgtaactttgctaaaatatcttaaataatcaagattgttgagttaagacattgacaatataaaatagtctaagagtcatgtctttcctcaaggaacatgtacagtatagctagggaggtagaacatttacattaaagaacaactgacaatacaagataccactgatgaagtctgacagacaaggaattctattttctaaaaatcagaagtatccttaaatgcaatatgatattctttatattcaatagcaatccataactagtattaagattgagagtatagacctactaacaatagaacaaaaggaggaaaaagctggagggaaaaattcaacaacagattctttttttcttcaacttttaagttctggggcacatgtgcagggtgtgcgggtttgttacctaggtaaaagtgtgctgcacagatcaacacatcacctaggtattaagcccagcatgcattagctatttttcgggctgctctccctcccccgtccccttgatgggccctagtgtatgttgttccccacctccccatgtccatgtgttctcattgttcagctcccacttgtaagtgagaacatgtgggtttggttttctattcctgcgttagtttgctgaggataatggcttccagctccattgatgtctctgcaaagtacatgatcttgttccttttcatggctgcatagtatttcatggtgcatatcatcaaattttctttatccagtctatcattgataggcatttggattgattccatttctttactattgtgaatagtgctgcaatgaacatacacgtacatgtatctttgtaacagaatgatttatattcctttgagtatatacccagtaatggaattactgggtcaaatgctatttctggttctagatctttgaggaatagtcacactgtcttccacaaaggttaaactaatttacgttcccaccaacagtgtaaaagcatgcctttttctccacaaactcgctagcatatgttgtttcttggctttttaataattgccaagaaacaattctgactggcataagatggtatctcattgtggttttcatttgcatttctctaatggtcagtgatgtttaacatttttcatatgtttgttgggcacatgaatgtcttcttttgagaagtgtctgttcatgtcctttgtccattttttaatggggttgcttttttcttgtaaatttctttaagttccttgtagactctggatattagacctttgtcagatggatagattgcaaaaattttcttccattctgtaggttgtctgttcactctggtgatagtttcttttgttgtgcagaagctctttagcttaattagatcccatttgtcaatttttgcatttgttgtgattgcttttggtgtttttgtcatgaaatctttgccacagtgcctatgtcttgaatggtattgcttagattttcttctagggtttttatggttttgggttttacatttaagtctttaaaacatcttgggttaatttttgtataagatgtaaggaaggggttcagtttcaattttctgcatatggccagccagttctcccagcatcatttattaaatagggaatcctttccccattgcttgtttttgtcaggtttgtcaaagatcagatggttgtaggtgtgcagtcttatttctgagttctctattctgttccattggtctatgtgtccaacaacagattttaatttaggtttgaattcagggaagttatatagaagaagaagaagggtagaaataaatattaagcactgatgcctttcttcttaattgccatgcctttattcactaaatcaaaaataattaatcattccagcactgcactgttttacatttcttataggaaaaattttataaaattagaatataaatgccttatcatttaaaagacagtttccattagtctcatctgttatttatggcttgattcaaagatgaaatattactcccaagagtaacttccacagcaactaataaattaaaaaaaacatgccaaccctcaattatttattttattttttgagtgatcatgataaatgacagactagagcaaggccaaccagctctagtatcaaataagcattttttaaaaatatactgtacaagttattcataaaacatttataatgttttaatgtcagaatttatctttccaaaataaatatatcaaaattaaaggtagtttgaactttgagaaaccatgaatctgttgccaaattaaccttactaatgtgcaatgtaatatgaaatagtactaatataattagttatcattctggaaacactaattacatcacagctacgtgttataaaaacagctaatgaatatacccttgtgcactgaagaattaataaagacagaacctgatgctagatattcctcctgaagtttagcctctgaaagagtttctcacttgtgtataaatacacgtttttggcacataacctgctttttaatgagactcttgtgtttataggaaaacttttctacaagctattttatcaccaagaaatagaccaatttaaatgtcttaccagtttataaaagaaaatatagagaaaaagaaaaaaattgagcaaattattcaattcatgctatactacaataataaggtaaagaatttggttaatttcagtctctcatcaaatattcttttgagcacagtacaaagtgtcatttgttaacaatgaccaaaatggcatctttctcagcctggctgcctttgcctgcattctttcacccatctcttcaaacagggcctcaccaaattttcccctactaaatgagcttaaccctccaaggatattctgacactgacgttggagggagttttaagcacttttttgtttgtttgtttgtggtagtgacttcattgtattacttctagctcagtcttttctttcttcagttgcaaacaattctggtgattttctttcaacatttgcacaagtaatttttttaaaaattattaaaagttatcatttccacacttactgtcaaaggtttcctcacaaaaggacaccaaggttgaagtcatttgcatttctgcaatagaactcatactttaaatatgtatcagagactacccagtacttcgtaggttggcttttctcatttagatttccaattgaagtgggagcagtgctatctgtcacacagtcatagtgaaggccattgtgggggacttcaggcacaatgtcatctccatcaccacctttaattaagttgatctcaatttcccttttgcatattcccactagtatcaagccatggtggagcaagatgcctcagtttctatatctgcaaaatgtgaatcattaatagaattgtgagtattaaatgagttaatatggatacagcacttagaacagtatctgtacaaaaggagcaggattgaaaataaaagaaagaaacagaacagtttcggtcacatagtaaactctcaataaatgttagccattctattattattgttgttatcattaatttagccaccagtccatacacctgaaagaaatacaattttaaaatacgtataccattttttaatagtaaaaccttttttaaaaaccatatgtcaactaaaaaatgccagtttataaatttcaaccctcataagtgttgcagcctgcagggtggccattctgacatgctgggaagcatagtctccagtcagaagctggaaacagacactttgagggaagggcaaagggaacaggaatttatgcttagcagggtggccaaacatacatattcaatcagctataggaggagtcatgaatatttatgaaagaagaaacaaagtgcatgcacagttcagctttatgtcccttcgtggggcccacgtacaaaaaaacagaagcattagcatgatccaagggtgatgtttttgctctctgacatcaaatgtaaagcagaggacacaaaaaccctcactgtgcattctgggtggactggccagaaccactccatggtcggtggggcagcatcaagtgactggttgttatcagtgaaaggactagtttctgttgtactcttaggagagagttagccagggagaaagtgtaacaagccatatctgacctctcacacaatcatggctgagaacttagttttcaaggttactctgatccccttggccaagagatggtctgttcagtcagttgtaggccttagaattttaatttctcacatactttctgctagttagggctaattgaaaaatcactgtatagaaaaacagaactcagtaaaactaaaattttttttttttttttttgagatggagtcttgctctgtcacctaggctggagtgcagtggcgcaatctcagctcactgcaacctctgcctcccgggttcaagcaattctcctgcctcagcctcccaagcagctgggattacaggcatctgccaccatgcccatctaatttttgtatttttatagaaacggggtttcaccatgttggtcaggctggtcttggactcctgacctcaagtgatccacccacctcagcctctcaaagtgctgggatcacaggcgtgagccacctcgcccagccagtagaactaaatatttgaaggagcacaaaagtgttaggaaattgaaccaacttgagaagccagaaaataaaaacaaaaatttttttaaagtactgctcagaaaaatgacacacttgtttttccaaagaactggctatgttggtttccacagactggccaagaaagcacatgtcgagggcagtcatatagatccaaagacccctaccagaaagtgtctgaattaccttttcctgctaaagtagttcctcatacctttgattggctgtacaactaataacaccacattccccaaatacatacaaaataagtttcctaataacttcctatgcaggaaaatgttcctctttctggattttcataaaataatatgaaatttagtgacagaaaacagtttcacagattttgcttttgcatctgacaaaattttttagtgactttgagctatacttttagtttttcttcttttatgaaaaggataatatatgcttgtaaaaatttaaacgtaagattatataaagaaaaaataagtcttccatctccattcccaagaaacacatacttatcagtgtggtatgtatcaatagccaatagctatatagatacgttcatatatacacaaatatacatattcttgtatgtatagaaaaaaactatatagaaaagtgagccattctacaagatccatcagaaatttgctttctttactcaatagtgtattatagctatccctccatgtgagaataaataaaacctcaaaagtataaaaatccaaagaggacttttatcttcaagtaaaattaacactccaaggtaaaaagaccatgtttattctaaccagaattacaagagaaataactttcttttctaaatcagaatttaacctcaatgacaaattatctccttgagtagctcagtgaggttcttggatataattggggaatagaatcttctagtcctagctatcaaataatctcagttatctaatttcttcatgcttcaagtaaaattgcacaataatttgatcactagcccatagtcaatctaaacttggattttacaaaggcttggtttgttgctcacatatcagaactggagaagtagtcggagagtaagaaatgctgatggtttcgcaagccagaatgcagacatgagcaagtctgacatgggagcaggcaggctgcaagcaactatacaaacaagaaaaaagaataaagtgaagttgatgcatagggcatgactggtcgggttaacaggtaagtcaaagagcaatgagactgggttcaacagaaagattgtatgaagtgaaaatacaagcaaaaagaaatgcgtatacatgtttatggtagacagcttttttttttttttgcaattatttactaccctcttccctctaaaagaatgacaaactattgtcatgtgacttgcattcctccttcagggaaagtataccttctcatttaattgacattggccttgcctacttaacataagttttgatcagtggaatgtgagcacccattatgtatgccacatctaagcagaagcttcatgaaacatcaggagcttcttccatggctcttggactttccttatgccacacaagtgggaatgtccatataggtacttctttaacctgggttctagaatgagaagatacttggagcaaaaccacatccaaccacagtctatatgccatgtgaatgagaaatattaataaatgttttgttgttgcaggtccctgagattttgttactatagcaagtcaacatacagaaattggtacctagacgtgaggtgctgctatcaccaaaatatatggccctatattcaatacctgacagagaatggcatggaaactattatcaggagctggaaaaatggtgacctatgttatacagggataaaatatttggtgaaactgtcacctacaataccttaaacaggtaaaaaatctaattaacatggatataaatatgggaacaaaagacactgtggaggggggtgttttaaaaactacctatcagatactatgctcactacttgggtgatggcatccatactccaaacctgagcatcaaacaatattcccatgtaacaaatctgcacatgtaccctatgtacctaaaacaatagttgaaataaaaaaaaaaataaacctaaagaatatacagcttcaggtgaagaaactgaagaacaaaatgttactagtgtatttggtcattactagctgtgtttaacaagactgtacaagaagggaactcagaaaaagaactggcctatttataagcagggattcaagggaaaatagagaatccagagatcctagaagttgcccacctgaaatctgcaactatttctcatctcaatttcagatgaaattaaaaatagtcttgcaacaaaggccaattaaaactcagtaccggggcaaagaaatggctcagtaaaaagaatgtgactctatgaaagcctgacaagcacaaagtacgattgacaaaaagaacaaaaatcaaacagattttcggagacagttgtgctatcaaaagtaccactatcctaggtttttaaaagactgtaacttaataaaaacaatctttgggctgaagtcacctggagacttgactggactggatggatcactctgtctgggctcagctgggactctggaaccactgatcactcaaattctctctccccatctcctggctgaatcaatctttcccctttcccctcttccaatagtctcaggcctctctctgcataaggtttctccacacgctgtttccagcaggactgccgaccttcctacatggtggtgtaggtcttccaaaaaatgcaaaagtgtaagcttccaggtcttcttaatgcttaggatctgaactagtataacatcacttctatcacatcctattggttaaagtaatcaaagtcaacccggattcagcatgagagagttctacacaaaggcatgaatagctggaagcatggtttatcaggtgccatcattagagaccagataccataatgcacaataaataaatatttattgaataaactaatgaatggtaatccactgtaacagaccacattcttatctatggtagagatgggcatacatgatttaaaatgaccaccctatttttatgatcaaacagcaatttatagagccatgattttcacataatactattccaaatacttatcaaaaaaggaaaacaaaccaaaactaaatctcttggtaagattaaaacagaaagattccatttaaaaatttttattttatatgattgttgcagtttttatagaaggacaaaaagttaaatgtgaggaagtggttggatagacaacagtcgttaaaagtgtatgaatctggccagaaccccacataaaagtaggaaaatcagattttgtgaaaccaggacccatgttctagtcccagttttgaggactaacactaactgtttgactttggagaagtttctgggcctcagttttctcaactttaaaatgagcaatcccactactgggtatctacccaaaggaaaagaaataattgtaacaagaagaaacctgcatctgtatgtttatcacagcactattaacagtagcaaagatatggtcaacctccaccaatggatggctggataaagaaaatgtcagctgggcgctgtggctcacacctgtaatcccagcactttgggaggctgaggtgggcagatcacaagatcaggagttcgaaaccagcctggccaaagagaacagcctgaccaacatggtgaaaccccgtctctactaaaaatacaaaaattagccaggtgtggtggcaggtgcctgtaatcccagctactcaggaggctgaggcaggagaattgcttgaacctgggaggcagaggttgcagtgagccaagatcgcgccattacactccaccctggatgactagagcaagactccaactcaaaaaaaaaaaaaagaaaatgtcgtatatatacacaattgaatatttttcagccacacaaaaaaatcatatcttgtgcagcaacatggataaaactggaggcaattaactttaatgaaacaagacacagaaagacaaaaacctcatgctgtcacttaaaagtaggagctaaataatgtattcacatgggcatagactgtgaaatgacagacaaaggagacttggaagggaggaggagaaaagaaggtggatgatgagagattacttaatgggtacagtgtacattatttgggtgatggataccctaaagctctgacttcaccactatgtaatctatgcatgtaacaaaatttatacaaattttaaaaaacaaaaataaaataaaatgagagtgtgggaactgtaagttttcaaacattttctaacctttgtacactttatttgaaagtagttttatacttaggagtagggaggaaggatatggaggagaagggaaggtgtcccactcctcctcaatcacagtggttctgttttaaacactgagttttttttttgtttttttctttttggaggagggctgcatttaaacaagtggttctgcaaataaaatatattcgaaaatgagagacctggcccaacccctcacgttttatagatgaggaaatactgtccttttctgcactgaagctccccacctctgtctttcatgcaacccctgactcacatgatggcgccccactctgacttgccttactctcacagtattatgtgtttacatgaagccccactttgtggggaatgagaaattcaagctgaggaaatgcctgaaattgtaatttcaaactcaagttgatcatattgatcacaaagtgaaaaatgcaaagaagacaatttgattctaaattctaatctatgttaatatttcagaagaatgtgatgaggaggaagaataagcaaaacataaatgctcaaaattattctgtattatacacaacatattgtaggacacaagggttcaattcaaaaaattattcttcttgaaaaataaatgatatgttgtttcccacaagacctactgactagaggtttacatctgggaagtacttcactcactagtctaaaaaaattttaagaatgcaggatctaacaatgttccactgctttctgaagagttctctctgtaccttctgtaacacacaaataattgccaagttaactaatctcacattttcactttaattaaatgaaacaacactttgtccttttagatccttatgaagacatgaattagaattgcctatgctaaaagtgatcagtgttcctatataatcatccaatggtctacatatttttaaatatatttttgtgggtatgctatcaccataacatttcctggtcactaaattctcctggttcctgttaacggtactacaaaacaaaaatacttactttttcagagttcatcatgatagaaatctgttctctgattaacatgaatccttttcctactggatatttaattcaagtgtaggagacatttccagactttaacaacttgacaactgtaaagagttgtaaaagttaattattatttcctctgctctgtcagggtacacctaatttagatggaagtgcactcaaagagtaatttccttagaggttctcatctttcacaaagtaggcgttgcacagatatggtgcccgtatcagttagggtttcagcagataagcagtaccactacgattgatgtgaataaggaatttattataggaattaggccttccacaatttggggagaagttgaggagataaaggtcgagaaagggacagttaaatgatcaggggaaagtcagtaagaccacaaagcagaactagtgaagacgactatgggaggttgttggtgttagagaaaaaaattattccaacacttgttaaagacaggaagaaagatgttactgaagaagagactactgcaatgagagttttgcagtagggagaaagattgagctcaactataaatacaacaaggtcaagtggagcttatagctaaggagcagggtgtaagctcagtggacggaaaaacactaagaggaaacgccaggtgtaagagacaattctggccaaaccaacttaacaggatacttgctgaaggcaggccagaggattagatatcaaagctgaggtgtgaggaattttatcagataccaagggtgggagatttttgctaaattagtttagcacagttcttgctaaaactgcactaagtggatcaaagacagagaccaaggtcagggcctagtcgagaagacagtttagaggagcctgactcaagtctggtcaaacgatctttgttaatggctctgcatctggtgatgggcctaaggttgttgtagatcagcagagcaagtacttggaaagaaagctgcaagccaaacacagaaagcaatgacaagcctgtgagggtaaactggtacctgtgttatctgtttctccccatttcaaagctggatgataggaatggcctgaaaaacctaggccctttcccctcgaagctccacgtagtcctggcccaagacttagagaagctataaaagaatatgtggcaggagttggaagagctgttgtcccaccacacaaaggtgagccaacagattagttacaagtataatttgtaactggggccctgaactgaccttccaaatgcaaaagtttctgcctgaccccttttgaatctcagacaaatttctcttgtgaccagccctaactgaggactatatacagaataatttggaaaatgcagttccagcttagctaaattggcacagtataaaatccccaccacatccaaaagaccctttatgtaaattcatcctaaaatggatttaagcctctcagaaataatatatattcaataataacacctatcacaataaagtattttacttattgcattcatttgcaaactttcttccaacttttatttctttacaagaaacattgctatcggcaaagagatacttattttgctctaaggtaaacataaagcaacactgaacacattatttttaactacaatttttttaatggaaatctacttaatatttctccatttctacccgcctgccttttttcatctcaactctcctcatactatcttctttctacttcccataagtcaagctccaaacctgagggccttttacttccccctgcaatatggcttttatcggtgccaccaagttcatccatcagggttgtataaatccaaactgtaattataaatgtggatggagttcaagtgctttctcagagagctctctggcctcatgccaattaggataggaggtaggtacatcacctaattctacatatttgcaaacctaactgagctctgaaactggcaacatccttaggacactcttacagtccctacagatgtctctgcccttatcagataattccttcagggagagaataacaagctcagctttttctgaagccctccctgggcccccacaggcactctttcctacacaatactggcactgggctccatgaggagcgcattctccccgacttaccagatgcattaagagtaagcctgggcacttagcagatttaatggaaccgtctggaaatcattgtcaatatgttcccctcactctgagaactctgttaggacatcttcatagaaggtatatgctaatatcttttttattttattttattttattttgagacaggatctcactctgttgctcaagctgagtgtagtggcataatcacagatcactgcagccttgacctcccaggctcaagcaattctcctgccacagcctcccgagttgctgggactacaggcacgtaccatcatggacacctaatttttgtattttttgcagagatagggtttcaccatgttgaccaggctgatctccaattcctgggctcaagcgatctgtgcacctcggcctcccaaagtgctgggattacaggcgtgagccactgcacctagcccactaatatcttaactagctaacatattatccctatgataatggtgaaaagccgcaaggaattggagcagaagatccaagttttggttctggtgccagatctctctaggtgtcaacacagaaggtaaaacccacatcacagggctattgttgtgaagtgtaaatgaggtaacagatgtcttatcctcacccataatgattcctgacctagtccactacccatccctttggtacagactcagcttctccttcttgcattgggccatatcatttgggtgatagaacacttgcaggactgcacagctgttgcaggggctgcctcacactacacaaagccactgttcccttccacccaggccctgctgtagacctgccccaccatgcgtctcttatatttgctgtaagtgggtgggggggctctttccacatttatgatgaaggttttagggtttttttctccctctctctcagtgtccctgctatccttccctgcaaatttaccttcatattactcaggattagcagagtatcttaatgcagaaagattacatgttatatgatacaaatatttaacaacattggacatgcttttctccttctctcttttattttaagtcacccaaggtcaacattggctcttttttcccaaaaacattcctaaggtaagatcaactatgtgaccttattttccctactttttaaaaagttgctttaagtattgtttataataaaaagcaaacacataaccaaccacaagttaatgaaaattaaagctaatgtcttctatatttacatttaaattacagagaaataagtatgtggaagccatcatcaacagtagttgttagacttacaaactattttgtgcatgtagagactactgaaccacaacagattttagtttccttccttctcctcctccatcctgacctatccccttccttagcatgccaacaaaagcgagttcagaatctgaagggctcctgatcagtagatcacacacaataaaaaatatcaacctttattttaaaatgttaaacttactacaggctgatcaaaaatgatcaaatatgacttctctaaacgtgcaatttttgaaattagaaattttggcttataacatatttccgaagtgaagatgttgcccatttcaaatactgaataagatcttctctctcactcttctttttaagaccagaaaaggtcatgttagttccagggatatatttctttcttttttttttttttgagatggagttttgctcttgttgcccaagctggagtgcaatggcgcgatctcagctcactgcaacctccgcctcccaggttcaagccattctcctgcctcagcctcccaagtagctgggattacaggcatgcaccaacatgcctagcaatttttttgtatttttagtagagatggggtttcaccatgttagccaggctggtcttgaactcctaacctcaggtgatccgccctcctcggcctccaaggtgctgggattacaggtgtgagccaccacgtacagtcccagggatatatttctttgggttctccaaatattccatcagagtctcttctccccatacaatacctacaaaggtgaaggtaagttttaagtttgtgtagttacatttgtagggctcactttctgatctgacccacatatgtgaacaaaagattaatcttggactcagtagggaggctattttaactgagacttatagattctgacctataagaaatttccaaaatgtgtctccactccttggcttctctgtagaaatccatactgtagaaacagtcgcatactgtttagggtcttctatggtaaaccaatgaactaccaccaaagacatgttatgcttaagcagttcctcatcctccaagaatcagagtgagttccttctagaaaaggtcttagagatcatgcaatccaatctctaattttgtagattagtaaatgatggtccaaagcttgtcctaagattacaaagctacctacagtcaagaatttatgactactaactcatatttgcatgttttttctacctatcataccaagctgcctctatccagatctccatcaaaatccatgatttcaaaaatccagttttaagacaatagagaaaggttcctttcttttctttctaaaaccagtcaaaaagaacatggagaaagagaaacagaactgctaccttcacttttgataaaacctttcaggaagcacctgttataattgttataattagaagtctaccaaggacatgaaacctagaccagagtgaaatgacacctttcactaagcatctctccaaagtatgtgacacactctgaaaggcaaaggcataagcctttgtttagctcaaaaagaataggatatatcagctggccatgaaagtcttcttaaattcagttttacaccatggaggaccaggggagccaggatgaatgaagaaaacataaatatgtcctctttgaaagaagcactctaacttataaggtacaagagaaactgcaaaggtaacataaccccaggcctgccagtctttgccagctgaagtaaagagccaaataacagccccaccaaaacataaacccataaacgctcaggtatatgttatcgctaatataactatgcataaggaagacatcaaaactaactggaaaactcagaccatcatccttattttccttctgcaaataactagtccaaaaagattatcttcatcagaagatgggtaataataaaaaataaccagcacaagaaagtactgaaaatacacacaatacacacaatacacacagtacacacgcaaacacacacacaccacatacatacacacagcagaaaggaatatgaaaaacaaaagttaggccaggcatggtggctcacacctgcaatcccagcacttagggagcctgaggcgggtggatcgcttgagctcaggagttcaagaccagccttggtgacgtggtgaaaccccatctctacaaaaaatagaaaaaaaaatggccgggcatggtggtgcacttccggggtcccagctactcaggaggctgaggcgggatgatcagttgagtccaggatgtcaaggctgcaatgagctgagatcgcaccactgcactccagcctgggcaacagagtgacagcctgtctcgaaaaacaaaaacgaaatgttaaatgaaaaatacacatctgaaattatgtattaataaataggcagatgaaaatcatagccatatttccatggattcaaaaaaggcctttatgaattaagggctcaaagtagagtgttctagtctattttcacactgatgtaaagaaatacccaagactgggtaatttataaaggaaagaggtttaattgcctcacaattccacatagctgagacggcctcaagaaacttaccatgatggtggaaggtgaagaggaagcaagcaccttcttcataaggcagcaggaaagagaagcatgaaaaggaggaatttccaaacacttataaaaccatcagatattgtgagaactcactatcatgagaacagcatgggggaaactgcccccatgatccaatcacctcccaccaggtccctccctccacacgtggagattatggggattgcaattcgagatgagatttgggtggggacacagagccaaaccatatcattccacccctgaccccttccaaatctaacatcatttttacgttgcaaaaccaaccatgccttctcaacagtcccccaaagtctcaactcatttcagcattaactcaaaagtccatagtcaaaagtctcacctgagataaggtgagtcccttcctcctatgagcctgtaaaatctaaagcaagttatttacttcctagatataatggggatacaaacaatgggtgcatatacccattccaaatgggagaaattggccaaaacaaaggggctacaggccccgtgcaagtccgaaatccagcacggcagtcaaatcttaaagctccaaaatgatctcctttgacttcatgtctcacatctgggtcacgctgatgcaagaggtgggttcccatggtcttgggcagctccacccctgtggctttgcagggtacagccctgctcctggctgctttcacaggctggcattgagtgtctgtggcaaaacaggcacacatgcaagctgttggtggatctaccattctggggtctggagaatggtggcccccttctcatagctccattaggcaatgccccagtagggactctgtgatggggctccaacccacatttccctttcacactgccctagcagaggttctccatgaagactctgcctctagagcagacttctgcctggacatccaggtgtttctatacatcctgtgaaatctaggcagaggttcccaaacctcaattcttgacttctgtgtacctgcaggccccacaccacatagaagctttccaggcttggggcttgcaccctctgaagcaacgacctgagctgtaccttggccccttttagccatagttggaactggagtggctgggaagcagggcaccaaatcccaaggatgcacagagcacagagcagcagtggggccctgggcttggcccacaaaaccatttttcccacctaggtctcaggcctgcaattggaggagctgccttgaaggtttctgacatgccctggagacattttccccattgtcttggtgcttaacattgtcttggcaattaactccttgttacttacagaaatttctgtagccagcttgaatttctccccagaaaacaggtttttcttttcttttcttttttttttttgagatggagtctcgctctgtcgcccaggctggagtgcagtggcatgatctcagctcaccgcaagccccgcctcctgggttcacgccattctcccgcctcagcctccagagtagctaggagtacaggcacccaccatcaagcccagctaattttttttttttttttgtatttttactagaggcagggtttcactgtgttagccaggatggtctcgatctcctgacctcatgatccgcccgcctcggcctcccaaagtgctgggattacaggcctgagccactgcgcctggcccacgtttttcttttctgccacatggtcgggctgcaaattttccaaacttttatgctctgtcacctcttgaacgctttgctgcttagaaatgtcttctaccagataccctaaatcatctctctcaagttcgaagtcccatagatctctaggacaggggcaaaatgccgccagtctctttgctaacgcatagcaacagtgacatttactgcagttcctgataagttcctcattttcatctgagaccacctcagcctgaacttcattgtccacatcactgtcagcattttggtcaaaaccattcaacaagtttctaggaagctcccaactttctcatatcttcctgtcttctgagccctccaaattgttccaacatctgcccattacccagttagccatagctgaaactggagtggcacattttgttttttttttaagacagagtcttgctctgtcacctaggctgtagtgcagtggtgcaatcgcaactcattgcaacctctgcctctggggttcaagcaattctcctgcctcagcctcctgagtagctgggactataggcacatgccaccacacccgactaattttttgtatttttagtagagacggggtttcaccgtgttagccaggatggtcttgatctcctgacctcatgatccacctgccttggcctcccaaagtgctgggattacaggtgtgagccaccgtgctcggccatctcttacacatttttaagtatctttatagcagtgccccaaacccctggtaccaatttactatactagtccattcacactgctataaagaaatacccgagactaggtaatttataaaggaaagaggtttaattgactcacagttccacatggcttggaggcctcaggaaactcataatcatggagaaagatgaaggggaagcaaggtaccttcttcacaaggtggcaggagagagaagtgtgaaggaggaaattccaaacactcataaaaccatcagatctcgtgagaactcaaagactgtaacaagaacagcatgagggaaaccacccccatgatccaatcacctcccacccggtccctccctcgacatgtgaggattatggggattataatttgagatgagatttggatggggacacagagccaaaccatatcatagagctacaaagaagctagtagaaaatgataaaacagaaacatataaatgacagcaaaaatggacaatgctgctgctagcacaatcagacttcaaaatactgataaaaatgaaatggaaaaaatagttttaaatgatcactctagctatcagctctaaggtcaaatgacagatacagaagatactcagacaaaggagatacaagatctgcacaaccggtggcccaagtaagatttttaaaaaacaaatgaaatagagtaaaactattacaacatataaatcaagaaaactttcaaaactaaaggcactgaatctatcaattggaagaatacaacatgtcccaggagatagtgaaattgatcaatcaaggcctagatatagcctagcaaatttgctaactctcagtaagacttttactgaaacatagggggaaaaaataaaataaaaaaccaagtaactcataatggaaaggcaacaggctggtttcatatttctccaaacaataattcaacataaagcatataaaatcctgagcaattaaaatgtctcccaatcattttacaaccaaattatcattcaagtgtaataacaatccccagctgtatttaaacatccaaaaactgggacaatatagttctggtaatactttcttattgttacaatgaatagaaaaccatccactaaccaaaagataaatgaagataatatggtaaaatctgggaacactcactggtactatttaaatgtagaacaaacattaaaaacaactgtggtaattatggttacatggggtgtaaatgatatatggcatctcagagtagaaataacaacatacataagtggtaagagttggagactatgaaaaatgggagattgtataaatattttggctttctcatccttcatagaggaggataagcagatgttgcttaatgcagatcaatctaattgtagaggcacatggatattctttagagtataaatatgactatcaaaattgtcaaaaagaataatattgccaaataaatttagttggtagagggacaggaataggagaatgtcaggaaaagtgaacatacataatttccttaccacacataatggtaaatatttcttttgaactatttggatttttgtataatgtaagcatttcaaaatatttttaaagttattaatacatttatgattcaatgtgttcctactgcatccactaacaaaatttgacatgacaataagcaaaagataaagacttaaatccctaataagatagtttagctaatatgctaatctcatgatacgatttctttaaaggcccaagaaaaccagggtttgtatcctagttccaccatttattagcatagaatcctggaaaaatcatgaattaattcaaacaatttgtttctaaaacccgcttcaattatcattgcccaaaaatgcaagtggtgcttcaatgcactataaagacattattctcaaaagaaaaattttatccatttactgatgtttttaaaaatacagtacggccaggaacagtggcccacgcctgtaatcccagcactttgggaggccgaggcgggcagatcacttgaggccaggatttcgagatcagcctggccaacatggtgaaaccccgtctctactaaaaatacaacaacagcaaaaaaaattagccgcatgtggtggcacacgcctgtaatcccagctacttcagaggctgaggcaggaaaatagcttgaacctgggatgcagtggtagcagtgagccgagatcacaacactgtactccagcctgggtgacagagtgagtgagactccatctcaagagaaaaaaaaaaaaaaaaaaaaaaattgaagaacaaagaaaaacacagtatatatggttcaacatcaccaatcattagggaaatgaaaaccaaaaccacatgagatagcacttcaaacccattaggatggctgttatcacaaaaacagaaaataagtgttggttgagaagttggagaaattagaacccttgtgtattctaattcacaatggaattgtggaaacataaaatggtgcaaccactgtgaaaaatgatatggctgttcctcaaaaaattagacacagaattatcatgggattcagcaattccacttctgggtatatacccaaaagaatgaaaacacggactcgacagatatttgtacacccatgtgcatagcagcattagtcacaagagccaaaaggtggaagcaacccaagtctctatcaacggataaatagataaacaaaatgctatctacatataatagaatattattcagtctttaaaaagatagaaatttcaacacgttataacataaatgaaccttgaagacattatgctaagtgaaataagccactcacaaaaggaccaatactgtatgatttgattccacttgtattatatacctagggcagtcaaattcacagacaaaaagcagaatgtcagtcgccaggggctattcaatgggtacagagtttcagtttgagaaaatgaaaatgttctggaaatggatggtggttatggttgcaaaacagtgtgtgcttaaaatgacacagaattgtaagttaagatggttaaaatggtaaattttatgttatatatattttgctacaatttttaaaaccacataagattattataatcatgagttttgtaaaactatattctatacaagtcatatgggacaaagaatctttaaaattgagaatttctgtattcttctgaaaataaaaatagtgtaattatttgcaacagaaaggtcatacacaaaaaaataaaatatggttgacagtgcaccacaatttttattaacactgaactactgacttcatggttcttcttaattattgaagtctgtttttagccaagctgtgctaacatattttttaaatccttgtttagttttaagtaaacttactttaaaatcctagtgcaattaacatagtaagctacttattgttcttatctcatcagcagaactaacaaacaataatattatatcctcaaatcagtcacaaatattacctaaataatccaatttagggaaattttatttctaattcttaaataatattaaacccaagccttatacagctttcaaccattggcaacaatctacataataaaaggcatatttggtataagttttaatattatttcaaatcaacgctattgaggaataaattcctcaaactactggcagttagaggaacaacattggcttaagtctgctctacaaattagaagttcaaaaattgtgcttataacaggataataataaaatgactctatagagaaatactttaaaaattaaaaagctatataaatgctaacaatgaagatgagttaaaaactgatctattcagtagtctatcaactgaaaatcctattgcaataactgcaatacaagtttaatactacctgcccacagtaagggcagactccacagtacctttgcttcagacaccagctgcaagctcagcggcccccaagccacccaaacttccaactaactggctacaaatttgggggttcccacaacctcatcgacttcaataatttattactagaacaactcacagaaatcaggaaagaactatatttacaattatagttgtattataaaggatacaaatcaggactagtcaggggaagagacccatagggtgacagctgggagggtcccaaatgaaaagcttctgagtcatttatctgtggaatcaggtctcatcactctcccaacacatggatgtgttcaccaagtaggaagctcaaccagagttccagttgaaagtgtctaaagtttttaattggggcttcaatacacaggcatgactgtgtgaatcactggccatgtgactgaactcaacctccaaccccctttctgttcccagaggtcagacttactcatctagctcaaagccttaattctgaaatcacctgattggtccttgcagtttggtcagcacccattctgaaactatctggaagttcaccgcaattcatcttattaacataaactcaggtcttggtcccaggggccaactataataacaaacatactccggtcactctagaaattccaaggttttagaggttccttgccaggaacccaggacaaagaccaaattattaccagtacctagtaccagcatttttgcacttcccaaatacaatgatattgtgttaataataaatatgctgatattttaaaagatgataaaatactactgacttgacaaatattaaattttattcaatgtacttttattataagtactttatcaattatgtatttataaatttatttacttaatttcttttttttgtttttttgagacagggtctcactctgtcacccaggcgggagtgcagctgtgagattatgggtcactgcagccttaacctcctgggctcaaggcatcctcctgcatcagcctcctgagtaactaggactagaggaatatgccaccacatctgtctaattttttttttttttgagacaaagtcttgctctgttgccccagctggagtgcagtggcatgatcttggctcatcacaacctctgcctcctgggttcaagcgattctcctgcctcagcctcccaagtagctgggactgcaagcgtgcaccaccatgcctggctgatttttgtatttttagtagagacggggtttcactctgttggccaggctggtcttgaactcctgacctcgtgatctgccaacctcggcctcccaaagtgctgggattacaggcgtaagccaccatgcctggtctaagttttttttttttttttttttttttttttagagatggggtttcaccatattggccaagctggtcttgaactcctgacctcaggtgatccacctgccttggcttcccaaagtacagggattacaggcataagccaccatgcccagccatcagctaatttattttttgtagagacagggtcttactacattgcccaggctggtcttacagatcaagtaatcctcctggcctcaagtaatcctcccacctcagcctcccaaagtgttgggattacatgtgtgtgccaccatgtttggccaattatgtatttattttatatgtaaaagtagtcctttattatgagtctcccccaaataaagatatgttgaggtcctaacccctggtaactcagaatatgagtttgtctggaaatagagtcattgcagatgtgattaattgagatgaggtcatattggtgtaggatgagcccttaatccaatatgattggtgtccttatgaatatgattggtgtcattatgagaaaatggtcatgtaaagacagagatgcacaggggtcatgtaataacaaagtcagagattggaattatgtagctagaggtcataactagaatttcacccataaaaaggaatgaaaagcatcacaagaagtgttgattgccataaaaaattattagacttagtttctcagtaccacctgttgtattccaggttgtttgttgtaattttgttgttgttgttgttaaatatacatttccagtggggggggaaggaatgaagtactgatacatgctacaatttagatgggccttgaaaacattatgctaagtgaaagaagtcagacacaaagggtcacatattatatgattccttttatatgatccaataggcaaatccaaagagacagaatgcagattagtggttgccagggaatagggttaagggggaatgcagagtgattacctaatggatgcagttgttctggagtgataaaaaagttttgaaaatagggaaaggcggtgattttacagcattatgaatgcactaaatgctacggaattgtacactttaaaatgtctaattatgttatataaatttcacttcaataaaaataataaaaagaaataaaaaataaaataaaatccttttcaaatagtagtgacttgaaatgccaacctataagatatgctaggccccaagaaaagtttcaaatagagttataccctattttgaaaaaaggtgatatatatatataatctcaaaaaagctgatatatatatataaaaccatatatatatttaacaggattatcatattataatttccattcttagacagatagatagatagatagatgtacacatataaatctccatatgattaatccaggaatgacaaattgctttgcaaagatagtgtagtcttttccaaccacttcgatcttaaccctaagatactgtctcactttaccctcttcccacaaacaaaaaaacatgctgaatatacgcttcaaactatatagtatttctcccactctgctaaaatcaatactacaaatagaatcactactgccattataccactaaaatatgattttttaaaaatctagcttatactttttcaagaaaaatgtattacctaaaatcaaataccctgtataggcaaaaacctatgccatacaagattcttaattcttctgattaaaaggatgatcagttatccaaatgcaggtcttatgatataaatccatatttcagtaatatgtaaagagtggtccatttttaacgctgcaaattaggaaattattataatgccaaatcatatgctttattctttcctacagtgtatctggttctctcccacaactgctagtttttacctttgtttttgtttgcctctgtataagaaaatcctggtgcttttcctgtttttcagccaaagaggccccagagatttggaccagtcttgtgattttcacctttttccactgtgtggcactgagcacatttctgaataaaggtcttcttgcctgcttcagcatctcccatgttgctctgcaatggaacattaaaaccacaaaccaaaaaaatatatatattagattttcaaagccggggagaaaaaagaattccatcattttgactgaagtgaatgctgatgatgttaaacaaaaacatatcctttaaagcatgcaagctttaatgtatgagtgctcaaaaacacagatatattataacatccaatttcataaagacaatcatctcattaattaggcttattttaagtttctagccatagctacttcagaaactgctattggtatcaaacgggttttacttcagccttcaaagaattatattaatttatccaggtcaattatattccttttcatttctaaaaagtgcatgtgcaaaagatgatgtaaaacatataggtctaattttgcaaccccttatttaaaaataagaatagaacaaataggaaaggtgtttaactatgatattactatgagtatttatatgtctacaataatcaaactgtaaaaataaaaattatacagaaaagaatgcagccatagaaacctgtatgtaacataatttctcatttactttacattcttagctatagataccagattagatcaagcattatctgaaagcaatcagaaataacattattgaattcagtcagcaatagtatgcatttaatactaatgtagtggaaaatacacagttttaagtagtaaagaccctactgggttgggtgcggtggctcatgtctgtaatcccagcactttgggaggccaaggcgggcaaatcacaaggtcaggagttcgagatcagcccggccaagatggtgaaaccccatctctactaaaaatacaaaaattagccgggtgtggtggcggacgcctgtaatcccagctactcgggaggttgaagcagagaattgcttgaacctgggaggcggaggttgcagtaagctgagattgcgccactgcactccagcctgggtgacagagagagactccctctcaaaaaacaaaaacaaaaacaaaaaccttactgtatgatggtagacatataaaataaattttttacaaagatattttggttgagactgttaaaaattctataactaaataaatgcctcctccatctaaaatgatgtaaaaattaaaataagttcaaactatcaaaaaattgtactttatcgatgtctcaggaggttctccatggtggtacaggatggcataatgaaggccctgaatgtggaacctgatggcataggtctcacctgcagcctggcacccaatatcacctcacagctctgagcccctgggccagatcacttcctccacccctccctatctcacctgcccagccaactgggaccttggccagatttctgcaataaacacttgcggtttctgtccaaaaaaaaaaaagtgtactttaatatagtaaggaatatgctgtctgggttctatttttctgtttttgtgttctgtgaagaatgagtgcaagggagatggggtttgggatggatttgaacacaaagaattactactacagacatcatgaaaataccaaattctttgagagtagagtcctaagcacatattgatctatcaatagaaacagaaaacgtttgtgttattctgccaatattgaagaaacctattgtttaactacaattcataaattgtttaacatactgtggttaaacaatctgtattcttcaatattggcagaataacacaaacattcttagttactgctccaagaaaggccaatgctttatacacaacaacctgcaaaaccagctctccctaacttctttaaatctatgtggaaacccataacagtgtcaacaatccaagtaaagggaagatagttttctttaggcagtatccaaaaacaactaagctattaaccaatagttcaggtttcatggaaagccgggtaagaaaacttactttatccaagagaagcttactttaaaacttcaaacatcactcagagtactgcattcaattatcagttctattaattacctaaataggttcagaattcagtgagcctttgagcacagaccatagaggataaaacttcactcacaaaagcacatttttggccttttcacaaaatacattcaccataaccataaagcttgtatcataaaaaagtcatctaagcactaactagataatctttatttccaatttttatacaaagcagaaaaatcagattgaggctgggcatggtagctcacacctgtaatcccagcactttgggaggccgaggtggttggatcacctgaggtcaggagttcgagaccagcctggccaacatggtgaaaccttgtctctactaaaaatacaaaaattagccgggtgtggtggtgcatgcctgtagtcccacctactcaggaggctgaggtgagagaatcacttgaacccgggaagcgaaggttgcagtgagccgagatcgtgtcactgcactccagcctgggcgacaaagcaagactctctcaaaaaaaaaaaaaaaaaaaaggaaaagaaaaatcatattgatttttatactaagtaaatgttgctagtaattcaggaaaccagacatttaaaaacaaacaaaaaactgtccttactcataaactacagatttcacattaaagtcacgtgtaacatatttccattataactgttaaaactaccagcattaatcacaattaaaacgtttacttctgccctctctaatcatagacgaatactgccagtgcaaatacctatgaccctcttccaagtgcattaaaaccaacagattcagtaatagcaggaagggaagagcaggatagcaagggatagaatatcttaagaaggacaggaagaatatgaaaagaattcattttgtcctataatcatttggcactctatcagcatttcatatttcaaaagaaatatctcactgaaataggcaaagatgtggcatctagtatgaaaatggtcattcttccaagaatgaagtaatttcaacattaaatagagtaacagtagcaaacatttgtatgtgcttagtatgtgacaggcatattctaagcactttatatattattaactcatttagttctcacaacagccctgtaagatggataccattaacatctctatttttatagatgtagaaaacgaggcaaacagaaattaagtgacttgtttacggtcacagattggtgagcagtggagaagaattaatattcaatctataatcttataggtttaacaattcctttttttttcttttttttttttttttttgagacggagtctcactctgtcgcccaggccggagtgccgtggtgtgatctcggctcactgcaacctccgcttcccgggttcaagtgattctcctgcctcagcctcctgagtagctaggattacaggcatgcaccactatgcctggataatttttgtatttttagtagagacggggtttcaccatgttggtcaggctggtcttgaactcctgacctcgtgatccgcctgccacggcttcccaaaatgctgggattagaggcgtaagccaccatgccaagccaacaattactttttaagggtgacttggcaaccctgtgttgaacacaatatctgtaacactgcagatgcttacaactttttacccaactgagagtgcttaaagaggaataggtgggtacataccattgctatgtcttatttttcataaaaagagaaatgctaatgaaacactttttaatattggcattaaaaacggccagcggttcctccctttgcccccgctcccagcagtcacctggaacagccacctggccagagtccacgcctcaacttcgaggctggcgatccagaaagagcacctcacgccctgggctgcaagcg

SEQ ID NO: 1361 - DNA, 293438 bp, Homo sapiens
ctggaggtttagttcctgtcttccttggctaccataacactggcaggggaggatgaggcagttgaggccagcagtcgtttttggtgtagctcttcccacttacttctgtttgtagctactgaatctagcatcggcttcagtttcacgttgaccttcaccagtgcctaaaacaaaacaaaacaaaacacaggtggaggagagaggaaacagagtaactgacatgattttccacctttcacttatgaggagaatggaaactggctataggaaatgaaagtgatgattattttggtaaacaagagctatttacaagaagtaaatatgcatttaacaccaatatgttgtattaatagagcctacttagagaatgaaaaaataagacatcaccagcatagctgtgtacaactctaggggacaccagccatgtagactcaaatcctgttttacaactacatcaagcaagacaggaaacaaaatatccagctcacatatgcctacttacgtgtgcatctttgcctgccacagagggctccagatctcaattgactatgcacttaaatttttacaaaataatcctacaattgctttaccatagatgactctgggtggacttacttgaataggaaaggtcaggtaaaatcctgaaatgaggaggtgctcatttttaaagctaaagatctgggagttgtgctaaatatacaaagcatggaaacatgcatggaaatagacatggcagaaagggaagcagtgtggaagagagtgacagagggatgaaagggggatgagggaagaggaaatgtagggtgtggccaggggcagatggacgaccaggctgatgaaagtcaggcttcagcatcctcacttgtgccagacccttctaagtatattcttttgtgcttaattttgtgtgtgtgtgtttttaagagtcctcctgttcccaaatggtataagcttgtctcaccgctcctgggttgcccctggtagtggaatgagagccctaaaagtaagatggcttactttaatttaatgcaaatgagtccatcttcagctttcatatcagagggcttctccaagatagggggtaacatgggggcagggccgaggattttgtttctgaactgggactagaacaaattcaaggagctcagattaaagagcaataggtaaatattttacaggtcagaggagcatggaatttactctgcccaacaggaaaattccactattctctactttactgattattttctttcttttaaatgcatgaatatctacattttccttattttaatttttttttacttttcataatgaaaggcttctaacatattcaaccagtaaaatatgatcagcaaaaatctctattatgtatctatatgcctgtaaagatgaataataagtaaagccacccatgtaaaacatatgtaacaaaggatctaggagccttttaattttctggacagctcaatgaaaagggaaataagattttgatgacatttaacttttagaaacatggtctttgtccttttaaaccatgaggttttggggggttgttttaaaaataataccttttcttcccttcacagttattttatatattttaagtaacatgttagtgttagaaaatatagaaacaataggtttaaaaagtaggaaatggagataatttataatctcataactcaagagatagacactactaacttttgggttttgccttgaatggaatctttctattatgtttctaactggtgaaatgatcagaacatctaaaatatggctcatgcctgtaatcccagcactttaggaggctgaggtgagtggatcatttgaggtcaggagtttgagaccagcctggccaacatggtgaaacctcatctctactaaaaatgcaaaaaaaaaaaaaaaaaaacaaaaaaaaaaacaacctaggcgtggtggcacatgcctcacatgcctgtaatcctagctacttgggaggctgaggcaggagaatcgcttgaacccaggaggcagaagttgcagtgggctgagatcacaccactgcactccagcctgggcaacagagtgagactctatctcaaaaaaaaaaaaaaaaaaaaaaaaaaaaaaaaatatatatatatatatatatatatatatatatatacacatgtatatatatatatatacatgtatatatatatacacacacatatatatgtgtgtatatatatacatatatgtgtgtgtatatatatacatatatatgtgtgtgtatatatatacacatatatatatggtattttataatctcagtttaaaaatggacagaatcaatgagaatgtatggatttttaagcattcatacttcttgggcctgttttccatctccagggtctgaaagaagtataaaaagctggcatcccacgtggatgagggggagcttctgttaacacctaacacctcctatgtgttaaacacattgccagctgctctgcatacttcatctcagctattcctcacaatgactgtgcatcttacagatgataaaacatgtcccccacatgttaggatcataaatgatccttagcctttccatcacaggaggaaggtaagaatccatataggaagttagggcttccttttgtaatctttccatttgttttggaagctatggagaaaaccattgtttttctcaagtaaaagtcagggataggacactagcctgccatatagaatgaagatatagagaaatctgctgaggatgtaacataaaagggaagctcttaaagagtcaagaagaaaaaccaaggaataataagatacacgtcttgaaattgtatggcttcaacctttgtcaatgcacaattccaaccagctagtaattgtatcattcctgtttttagagactgtgatgatgatgaggagactgaagacatgaacttctgaggacacattgaatgtgattgctgttgtcatcaatttggggtaagggttgacaccaggacctttcttctgacttattcatacccatctctcctttcttctctcctcttatccattaattctatcacccatcatcttgcatatgtatacaactctcatgaattctgacattgttctttgaatgtaatcttatgtcacttgaggcctccccaaccctttagacttgagattagacctcaaatctatttcatgctctgggggacctttcagactcctgccagtgatttccaagtcttacttccttgtactctctgacttcttcttgagtctatttggccctcttgactccattctgcatcattcctaatgcagtatttcactttatttccccttttcacaggaaatcccatcaccctcaacattttggatgcctactaactgtaccgaactttagaggttgtcataggggaagtgacttacccactgacttactcttacatactccttttcatctcaaagggcacagtcttttaccccatggagagtaatccagttttctccccagccctagctcactgcttttatacagatctggactgccagccagccagttttttcccaggctccccagaattctgacaaattaaagtttccctttcttgttgcactaaggcctataaggtagtttttattttccttataaagaaataaaagaaagaacacagaagttgtgagattattagcctatggaaaggtgatttcccactttatgctttgggttagttagctattttttgttctgtggacagggttatatccctggtcccgtgtaaacaccttgcaggtgcatcccattcatcacaagggggacaaaaggtgaacatatcattaaaccactatgatttcagcacaccttgtgaaaagccttctccaagcatgactgtggttagggagtagtcaatagtaagtcctccaacaggaagaatagctctttttctgttagaatgccagagtgtatgactccaagcacaactgcaaaccacctgttagtaaacctaatttatctgctcaaataatcctctgctccagggagttatatgaatatgagtaaaatgtaactagatgtaagttaacggagtgggggtgggggttgaaagcccgatgtccttaagacagagtatgttctgtctctctcttaacagtgatatttatcacactaaacagaaacatctaattttaaatcaaatttactagttatttcatatgataataaaacaaagcaacattgtaactccagcagcgatcaaaatcccctttatttccatgagaaaaatacaggtgcttgttttccactcaatgcatagtgtttttatttagacaatagtgtgagggagccacaactgccatggttttatttagtatagcttggcaccagctcctctttactctgatcaagccttttaattaaactgactactataattcctatggaaattagtgtttatgttattttcctgctacaaaagcatttctccagaacttattttttttaatcccaggagcataaattagaatttttttctgcttgatatgtaattaaaaactcatttgattacaatatttctggctctgttttacttattaaattcctgtaatcagttttcttttatgaagctgctgggaaatgatcttaaaagcaacacatttttttcttccctggcaggtacccaagcatttactaaattacattcatagcacctgcccatgattcgaatcattccaccaatttattccttaagccatttaagtttatttggcatagccccaaacagctttcttccctttatccttgctctttgttctccttcttgcttcctttgtatggaataaagaaattggggagggaggaggaatacatatttctcagaattcctttctctttgttttatattctcctgaaacacagaattgccatactagaatatcgttttcctgtggccaggtgctggttctaggcaaaggtaacaaaactcctatcttgaaaacttactttttctctctctcttttttttttttttgtgagaaggagtctcgctctgacgcccaggctggagtgcagtggggcgatctcggctcactccaagctccgcctccctggttcaagcgattctcttgctcagcttcccgagcagctcggactacaggcgcccgccaccacgcctggctaatttttttgtatttttagtagggacggggtttcaccgtgttagccagggtggtctccgtctcctgacctcgtgatccccccgcctccgcctcccaaagtgctgggattacaggcgtgagccaccgcgcccggccgacttattcttacactcttaatttgttacagaaatgcagttagctgagagaatatggaactattaaaatactagtaaagcaagggtttatccacgaacctaaattccaaggcttatggtgattatgtgtagtgagtcatcagcaagagaattgcttctagtatttaaaagtttcttatcaagtgatacgggatgggttctgtgagaatgctattgtctagtttgacttgctcctcagtgaaagagaaggggggaaacttagcacccatctgatcactctccatatacacacggaggaactctaaaggttatgtatgcggctgcatcagcctcaagacacctgactctcctctgtggcatccctgctgcgtgaccacacagctaccgttgaaaccctttcagaggcagtgcgtgcacaacctcccaggggagtccatttagtttttgattgttctgtttttaaaatgttgttcctttatgttggactgaaatctatacccctgtaacttctacctaatggttctaatccttagggtgctctttctttaaaccagaattttctttagtagtgtaggactgataactcaggttttgtttcaagtgtaggttagagttgatgctgacctaaaaaccctatttgggatgcagtgcttctcccttggggcaacctttttgacatcactggggccccatgttccttccagttccctcctggcccatcgcagacaggacctcggatacttgccccactatgggacacagcctgggcatctggtcatctaggtggccaagggaccccacttatttcctgatttcattcacactccactgttgagttctcttgtgaccagcatatacagtttattccgtattttatttatgttttgaataaggaacacattcacatagttccatggatacaaaacggtacaaaggtgcaatataaaatctccgttctactatttcccagacactcagtttcctcccctagaggcaacagatgttttcagtgtcttgagtagataatcaagaaaaattttctgaatgtgtaagaacataaatatatttgcccctttttacaaatggtagtacaccatacagagggatctgcactttgccttttattcttaatatatcttgggaaaaactcatatcactacaaaattagatttcctcattttttatggctatctagtattccactgctgtcaaaatttgtttaaccagttcctttttgatggaacccaaacattgtttatatttggccattacaaataatgctgtaatggatatccctgtacatagcctctccataggtgtgaagtttatcagagagtcaaattctagaatgggtattgctgggtgaaagggaatgtgtatttgcgttttggtagatattactgaatcaacaaatataattttacttaagatatatagcaggatttttataatagccatactaacaaaagagagggaacagaaaccatagctactgtttagattaaggccttggaaagatagtgtgagggtgggtagagctaagaaggatacacaaatctagaatttgatccctctcttctctgtatactccagatgctaatttctacacagtacacttggtatcactgaagcatcataatcatgttgtccagaaggttttgattttactccctctctgaaagaaactccccaaatggtacttgaatctactgaaatctcttacagcatatcaatcatttttgaccagttacaggtgttttcagtgtgtttcatggactcttactgtcattagcaaacttttactgaatgcttagttggagtcagactgtaataagtgcttaacactgtcatataattttctcaggaactttatgaaatggttactattattatcctctttatatatatataattaagaaaaaccaaggcctggatgaagaactcactcgtggtcattcacttggtaagtgaagaactgaaactgcagggtttctctacctcagtactattgatgttttgggttagataattctttatggtgggggctgtcttttgcattatagaatgctctagaagccagtagcatccctccccaaagttgtgaccaccaaaaatgtctccagatattgccagatgtcctctggggagcagcatcttcccagttaagaaccactgctctgctgcctctaagcattatctcgtctccatcaggtcttcaatgaactcagcttcccctcaaatagaaggaggaataaaagtaactagctacagtctgaaccccagcagcatctctggtagcagagaaggaaagacttcttcttgggccaaatacatactcttcctcacctcctttttctgaagacatttaggaaggagaaataagaggagtttctatatattgaatgttcactgtgctgggctagggccggggcctaaaggccattatctcataaaatctccacagcagtcccacgaagtaggtacttttatcatcttcactttatagataaggaaattgaggttcacttaggttaagtgccttgtccatggtcatataatgagagatggagccaggatgtttacctaagtctttctgactctaatgcattgtgtaaaaaattccttccctagagaactaatccttcgccactcagctcacattctgtcttctctgtgaagtcttctctggtcttctggtatggaaccagaactctccttccttaggcatgcctgtagcacactctccatctctccaattctatctatcgcactgaaaaggtatttgcatttttttgcagttcttcaaagatcctgttctggattgtgtttttgtctctttgtacttgtcttttttcccccttctgggtccttttaagccaagttttaaaagtgctggttttcagcaatttgattctcatgtgcattgctgtagtgtccttcatgtgtcttctgcttggcttcattgagaatcttggttctgtacatttatttccaccatcctgtcttcagctatgttttacatctgtcttttccctctgggactctaatcatacatatttagccattggcattgtctcacagctcaaatgatgctctgctcatttctcttccatcttttctatatcattttggatagtttctgttgcgtcactgagtttttcttttgcagggcttaatctgctatggatctcatctactatacatatatatatatacatatatacatatatacacatacatatatacatatatacatatatacacatacatatatacgtatatatatacacgtgtatatatatatatatatattttttttttttttttttttgagatggagtctcgctctgtcacccaggctggagtgcagtggcgcgatctccgctcactgcaagctccgcctcccaggttcacgccattctcctgcctcagcctcctgagtagctggaactacaggtgcccgccaccgtgcccggctaattttttgtgtttttagtagagacagggtttcaccgtgttagccaggatggtctcgatctcctgaccttgtgatccacctgcctcgccctcccaaagtgctgggattataggcgtgagccaccgcgcccagcctactatattttttttacctcaaaaattagcgttttcttttctagaagtttgatttgggtctttttaatatcttccatgaccccttaatcatgctcaatctttcctctaccctctgaaatatctaagtataataactatcttaatgtctttttctaccaagtctatgatctatataatctctgaatttgtattgattgatttttctaattattatgggtcagatgtttttgcttctttgcatgcttgataattcttgatgaatatcagacattgtaaagtttatattgttgggtgatggattttttttcctttgctttaagccttcttcagttttgttctggaatatagtcaggttatttggaaataattcaatccctttgaggcttgcttttcagctgcgcaagctgggtccaaagcagcctttttttttgtggagggctaatttgctcccactactgatgcaatacccttctgagaactgcatccaatgcctcatgtatttcaaggcttttcttgggtactctagctggcaggagcatggactattttccccaggctgtgtgacctctgtggatcactttacttgctcctttttgcttcagcctcagtagtttcctcacatggatatgatgaacatcactaacctgaagactcaaagtggccctctgcagatctctgggctttttctgtgcagtcctctcttctctcttactcttccctgggaactgtaacctctttggcctccctagactcctagctctgcctccttaactcagcaagatcactgggctctgcctggattccccctgcctgtgccgtggcctagaaattctatccaggccacaagctggaacagttgtaggactcacttcattcattccccttactcaggaaccactgtattatgttgtctgttgcccattgtctgaaaagtgttgtttcatatatttttcaggttttggggttttgttgttgttgttgttttgttttgttttggcccgttactcaaccatggctagtagtagaggtcccttatcactggttttaaaaactctgtcttgcttagtatcccacaagctcagagagacagtggaaacaaggccttttatctttgtatcttcaacatctggcacagtgaccccaggaagcagcagcctctcctccattcttccccatagaacagtggcaggaagaagggttaaggctaggacagctgccagtggctgagagtggggttaggatgttctgacctgctacaaaatcctgctgtaaaaacacatctagaatgagccacttgggaaatggatatattttctcttattaccattattcctgggcctttgtttttatcagtttgccaacctgctaggagccagatcctggcctttgtgtttctctgccatcgtggtccacatctgttatcatctggctcagtttgtgcttattagttgaccacagttacctcttggaacccagctgctggatagatagggcagatgtgggacaagggaggagcagagagaagtcatgctcttagaaaatgtgagtactcctatactctgttgttggaaaggggcatagaggaaccccatcaaattaaaaccagattagtgtttgaacctgaaaatgtccaacggtgtcattaatatattttttaaaactttgaggaaattgtctgactattcatttattaagaaaaaaagacatttattaagaaaaaaaaggacaaagagagaagatggttttggccccctattgttgaaatctatttccagagttgctagtgacatcacttagtattttttgccttctctcacccccaccttacccaagagaatcagaaactaagtgacacaatataccatagaggagaaagaacttagagtattttttaatgttgatttttaaaactataaagttagacttggaacttatcttacgtatctgtttgaggcagcgtattcctgttatgaggtcatgatcactttactaccatgattattccctttctggaggaaaatatcaaaaaaatcattggaagttggtattttgaaatggaaaaccactgatgatatgaccaactgttatcatctctgctcagattcttcagcaggagggacaagagaacatgcaaatggtggcaggccctgaaattctcatgaattcgtgtgcctgtccagcagttacagatgcaaagagcatcttcaagaaacagcttcctgttcaaggtgtatgacttcagagacaggtagccaattgtgggagcagagcctaagttataaattagtgaattgttgaactgctaatccctcttaggtccaaaggttaagattattcatgatttaatctgagatactcccagattttacatgccacacctcagtgctgcagttggctggaaatcactttggctttccagccttctacttttttatgggttgtagaggccagaaactcagtggacggactgtttacaactgaattcctcaccttccctcaagccttcctcttacgtttactctgtcagggaactgggcattatcatctatctagctgtcctacccagaaatccatgggtcatccatgacatcttcctcttccccttacatccaatctgtcacaaaagtcctgtcaatcccacttccaaagtttctttgaacatgattctgttgccatttccacaaccctggtttaggctaccatcatccccctgactgttttaaatctgctgcagcctcctaaccagtctcccagccttcctctgccactgtccaatcggtactccatatggaagccaccatggagcagtcaatcagaaacagaaacctgagcttgccattcacttctctgagactttcagtggctcctatttgatatgaatatgctcatcatcgcaagtccaaatccctcaatgtggcctataagaccctatcagaaaagagtattgtggtagtaagagagaatgaaatccagaaacaaaacaaaacagaaacaaaaccataaagactgatggaaaacttgggttatggtacaaaaacagaactttgaaatgccaaaataatcccactaagttttctagaaatcctgaagtacacatctttatatgcattttcacgttttactgagtcaaaaaaaaaaaaaaagctagactccacatggtgcgtttggcaggagagagctaaaatgttagttactatatgtgagagcagatggagctggctgtggagtccagatgggaggcagcaaacagactcctcctaaacctcactccttccctccccagttcaatggcttttgaaactcaaggttgtgtaaaaattaatttgtattaaattgcttaagataatgtattaactaccatagaaggcttccagcagtttttaaaacttgctttgaaaaacaaataatcaacctataatggtgaacacagaaggaagcccagacttccttggctgtttttaagcattcacattaaagataccagccttaaaaacatatcttttttgtgttatttgcagaagttggaaaattaataataattatttatgtaggttacacatgtaactgtgtaagacactgtggtatatttgtgcttcatatagtttatctcattaaattctcaaaactaccaggtatgtgcattatcaacccgttttagagaggagaaaatcaggctcagaaaggctacataatttgcctggggccacagagccagggtttggtcccaggtctctgactccagagcccaagttagtaaccacctaccatatgtgtaatgctggcatgtgagtttgaataggtcagcctgctggttagaattatgaatgaaaagtgcatttctagataggaattgcctgtttatcttcaggaatatctcattagctaataaatgttttccttaacagactcaagtgctgctgtggtctcagacatgttcatatgacataggtctatggaggtcaagattggtcagaaggcaagtaagaggcagagtcaccctggaaaagagtgaacagggttcaaggttacctacatacaaggctgaagtttggcaacacgaccaagggtgaaataataagaaaagacttaggcagaggcaaggacttaaatagctgattcagtgggttcataacagctgagttcttctcagactagaaaacaatggagtttaaagggctctagctttataattcctgccctgtttaaggacatggtcatttattctgccagaactgtggtatccctagcagagtttgttagttgcctacccaatacacgttttaatttaccttgagcttaggagtggccagggagatgtaagcagaattcataaaggctcagagaaaactctttaaatggggcttattctgctgggaggtgcattctcttgctcttgtccctatctgtttcttgctgttggaatattgatatggtttggctgtctccccaaccaaatcacatcttggattgtaactcccacaattgtaacctccgcctaggttttagacgtgacatgtcatgggaggaacccagtgggaggcaattaaattatgggggcaggtctttcccatgctattctcgtgatagtgaataagtctcacgagatctgatagttttcaaaatgggagtttccctgtacaagctctctctctttgcctgctgccatccatgtaagatgtgacttcctcctccttgtcttccaccatgactgtgaggcctccccagccgcatggaactgtaagtcccttaaacctctctttcttttgtaaatcacccagtcttgggtatgtctttatcagcagtgtgaaaacggaccaatacagtaaattggtaccagtagagtggggcattgctgaaaagacacccgaatatgtggaagcaactttggaactgggtaacaggcagattttggaacaatttggagggctcagaagaagataggaaaatgtgggaaagtttggaactccctaaaggcttgttgagtggctctgaccaaaatgctgataatgatatggacaatgaaatccaggctgaggtggtctcagatggagatgaggaacttgttgggaagtggagcaatggtgactcttgttatgttttagcaaagagactggcagcattttgtccctgccctagagatttgtggaactttgaacttgagagagatgattaagggtacctggcggaagaaatttctaagcagcaaagcattctagaggtgacttggctgctgttaaagggcatatgaaacacagcataaaagtttggaaaatttgtaggctgacaatgcaatagaaaagaaaatatcattttctgaggagaaattcaagccagctgcagaaacttgcataagtaatgaggagctgaaagttaatccccaagacaatggggaaaatgtctccaggccatgtcagtggtcttcaaagcagcccctcccatcacaggcccagagtcctaggaagaaaaaatggcttcgtgggccaagcccagtgtccccctgctgtgtgcagtctaggacttggtgccctgcatcccagccactctagccatggctaaaaggggccaaggtacagcttggacagtggcttcagagggtgcaagccccaaaccttggcagctttcatgtggtattgagcttgcaagtccacagaagtcaagaattgaggtttgggaatctctgcctaggttttagaggatgtacggaaatgcctgtatatccagaaggaagtcttctgcaggggtggggccctcatggagaacctctgctagggcagtgtgggagggaatgtgggggggagcccccacacagagtccccacctgggcattgcctagtggagctgtgagaagatggccaccatcctccagaccccagaatggtagatccactgacagcttgcattgtgcacccggaaaagctgcagattctcaatgccagcccatgaaaatagctgggagggaggctgtaccctacaaagccacaggggcagagcttcccaagaccacaggaacctacctcttgcattagcataacctggatgctaaaactcttgttttaacacggagtcaaaggagataatttcggaacttgaagatttgactgccccactggatttcagacttgcatggggcctttagcccctttgttttggccaatttctcccatttggaatgggtgtatttatcaaatgcctatactcccattttatctaggaagtaactaacttgcttttgattttactggctcataggcagaagggatttgccttatctcagatgagactttggactgtgaacttttgagttaatgctgaaatgagctaaggctttgggggaccgttgggaaaacatgattggttttgaaatgtggggacatgagatttgggtggggccagtggtggaatgatacagtttgggtgtgtccccaccaaaatctcatcttgaattgtaactcccacaactcccacatgtcgtaggaggaacccagtgggaggtgattgaattatgtgggcaggtctttcccatgctgttctcataatattgaataagtcttagaaagtctgacagttttaaaaatgtgagtttccctgcacaagctctccctctttgcctgctgccatccatgtaaaatgtgatgctccaccttgccttccaccatgattgtgaggcttccccagcaacgtggaactgtaagtccattaaacctttctttcttttgtaaatcaaccagtcttgggtatgtctttattagcagtgtgaaaacggactaatacaaatatgcacatgatagttggaaccagagtggccatcttgtgactatgaggcaaacttgactacggcagccatgtgctaaggaaagataaaggagaactaggtttctttatctttttctttctttttttgtttttacatagagtctcactctgtcacccaggctggagtgcagtggcacaaacttggctcactgcaacctccacctcctgggttcaagtgattctcttgcctcagcctctctagtagctggaatttcaggtgtgtgtcaccaggcctggttagtttttgtatatatataatctttttagtagagacggggtttcaccacgttggccaggctggccatgaactcctgacctgaagtgatccaccactttggcttcccaaagtgctgggattacaggcatgagcaaccatgcctggccaagaactaggtttctgatggctatggaactgccatataatagcagtatagcattggcttttctagattatttttattttttactaggagctaaatataattcctaaatgagaaaattgatttcatattgtaggtctctattttctgactatctgtgcaggtggcacagtgttttgggcatcttgatactcaaagataatgcttagtatgaaggcatattagctcattagaatccaacacaagaataattcagatttgcagttggaatattaagggcatagtctacccaagttataacaaaagatgatgtttgtagcatcaatgtctaatatcctgtaagctaattatactattagtaataagttaggaagagaccattttttccccaagatttgaagcagattagtcgtgcatgtaaaagtgaaaatgcaacaatgcattacagcagttttatctccttctttcttttctctttccagttccttcctgacctctcaagttacttgttttgcttatttatatgcacaagagattcttttgtggaaaataatattcacaaatgacattaacattctgaattaatgaggcaggaatgttagtctttttggattaactgcattgttatttccataatatagggcaagagtctgaaactaaaatgtttacagggccaggccactaaagttaatgactgaaataggctgcatgatagagttgggagtggtggggactatggcaaactggacattttacaattttaaaaactgtattcaactgaatgaaacaagtctgtgagctgaatctattctgtgggccacctgtttgcttgctgtgatagaaagtaaagcacatcttgctaacatgaattaactactgagtattcatgtgccctatgttccaggagccatacttggagttcttcatatgtgacctgattacaactcagaatggtgctgtgagatagctattattggctctgttttggcagatatggaacctggaattggaaaaactaagttaaagagccaaagtttacatggttaagtacacagcagagctgaaatgtcagtccaggcttggctgagtaccaggctcatggtgtctttacatcaggggtctcaactggcacactagtaacaatgggtatctcacaccttactgcagtgttgaggacaatggtgcaactttttttgttctatgtctctgatgctggttcagaacagattcacaggaaagtggaggtcttgctgagtaaagaagaaacaccacttcccaaacgttagatgtagtctgtgcatcttttatctttgactcatctactctaccctgccctgggaaaataaaacaagagttctaagttgtaaaggacaggcaagcctaaagacagctcatgtaaatgggagcaagaacagtttcttgtgttataatgagcccctccagaatgctgtccttggttatcctgttagttggattttcagagcagactggtagctaatcaatcatgttcattgtgtaggcaacttctgacttggaaggaatggctgctgacccagaagccacagcctttgatgaatggggcttcttacaagaggtggttggaacatgtaactaaaaagcagtcacgtggtaataatccattttccatatactggaatgttttctgctaataccatcacctgaaatttcatagaaatatataaaactattattttttcaaagttcaatgtgtaaaaaggatcacttaaaacttttagtttgttgagctgcaaacattcattcactgtacattttttgtatatttcccacatgcctcaagttctaggatttcctaaaataatggatagggtgtctgtgtgggaatgggtttacaaatacagaattgccaatatctgtccttggtgtgaatggtgctcggtgtaagtcactataggacctcaaagaatgtattctagaatattctattagcattggttctaaatttttagcttatatttgagggtgccaaaagagtcccaaaagagagtcctaactatacacactactgaactgcttagtgtgcaccatgcaaatatgatgactactgagcatttcttgcaagagtttaaaggtggcttcctgcctagcaccagacatgcttagttctgagacggggaggaaccatcaagtccatgaatcccaatgtcccggatctacagaggaccagacccaaagcatcgaggagaaatgctttgtctttaggtaaagatccttgggggataaaaatcctttattatgttggtggtctctctccctatggcaagggaaacttctttttcttaattttacagcctgataaagacagtgggccaacctcagtagctcatgcctgatctttggggggctgaggtgggaggatcgcttgagaccaggagttcgagaccagcctggacaacacattgaaaccctgtctctacagaaaaatttaaaaattagcttggtgtggtggtgtgcacctgcaatcctagctactcaggaggctgaggcaggaggatttattgaactcaggagttcaaggtcacagtgagctatgatagcaccactgtactctagcctgggtgacagagtgagaccctgtctccaaaaaagagtgacaattttgagataataaaaagatagaaagggaatatgttacatataccactaggtatatgtctgaggaggatattgtatcattagctggccttctctttgtcctagaaaggggccagtctgtctactggaagacccggtagaaggtatgttattgtggctcttctttaactacattgctaactccccaaaagccaaagatatgggaaaagtttgtttgtgtaggcacagagggaccaatattttcagtagttttatttcatttttagagtgcagtttaagagggaatataataactttataaattaaacttcctaatgggcaacattttctatcttttaaatgttggaaagtttcatattaatttaactctcgaacattcaccatgtaaaattaaataagcagccagtaaaaagacaaaccagatttccttttgaactaaattttaaagcttatgtgaaaaaataagaatacctagaaaatattgaaaaagaataataaggaaggtgaaactaggattatgagacattaaaatatattataaagtgatattaattaaaatagtataactaggcagatagatcagtagaactgatagaaagactaaaaatagaaacaaagttaagggaatcagtatatgataacagtgaccattcaaataataaggaaagagttcagtcaaaaactgatgtgaagaaaactaggtaagataaataacaaacttggaaacatatttgtcacctttgcaaataataagggtttatttctttaatagatagtgagctcctatggatcagtaagaaaatagccctagttcaatagaaaaataggcaaaaatataaagcatttacagaagaaatacaaatggcttctaagtaaataaatctatactaaaaatatgatcatacttatttataatatggaaaatgctaattgaaactataatgagatagattttatagctatcgtattagcaaaattgaaatttggtaatacattgtgttggtaagggcatagagaaataggcatctcagacattactgataggaatgtaaattggttcaaactccacagagagaaatttggtgatatctatcacgatctcaaatgcttatatgccaaatgcccagttatcttatttcttggtatttctcctaaaaataaagtatgaaaattgtgtatttacaagaatatttattgcacattgtttacaacagcaaacaattagacacaacatcaatgtccataaataaataattaattgttgtttaaataatttatttttcatctttaaaatctaatactatgcagccatcaaaaagaatgagacatcttctgcatggagactgaaaaagaataatctaaaaaataaattaagtgtaaagaagcaagatatggagcaggatatacactatgctcatatatgttcatagatacatatgcacttacacatagatacatatgtgtgagcatagtatatatagatgcatgcatatgcactatatttacatagaaaacaatgtagaagcattatgtattaaaaacagtgtaaaaacacactgtatataaactatctttagaagcatacgcaggaattggttaacagtggttgccccagtgaaaggaactgggtgacttgcaaaaaggagtatgagggaggatctcttttctctgataatttgtgccttttgtactttgtgaattgtgttcactgagggtgtctaaactatttagcaataaaaaatttaaaagtctatcatgaacagataaaggaaatagcaatctttggtcatgtgttagaaatattaaatcacctgattggttaattgttaaaaaaggcttacaagtacaggggcacaaagtagaaatgcttatttccacaaagatcaaaaaaatttagtgctttaccaccataattcaaaaataattttaataccttaatgtatgttgcaataacatcgtatataaataaacacctccctcctcccactcccccatccatatcacaaataaaggctgactacctcattgctcctcagcatttcctctgaaaagcgatcgatgtctcctgcctggccattaaatagattttgaaaaactcttcaatccctatcagtctcatatccttatttagttcctcaaatttgccctcagctgggaattctgcaggcaactgtgattctgttgtgttcaccactcatttgaagggtcccatccatcatcatttctagtccttttctgatgcaatgtagcttgttatttgtctttcttataaactgaatggctgttaaattatccatttatcttccttcagattttctgttcagtttctcaggccctatcagggctgtcttttctaccttgtttgctgacttttcattccattgcccctgttcttggaggcatcttggttcaccatgctgcccttcaaaacaaactctctggttcagtctgctttttgcttgtttgaaagcaagcagaacttgctacttcagtagatttccttttaaaatttttttccttagaatagttttgaaaactttgaggtaatatatttcaaattttatacatagatagtaggatatattggaacaaaccttaaacaaaaagtccaaagtctagggttctaaacccagctctgccattatcaagtcaggtcacttaatagtgacctttcagggttttgctttcccctcctacagatggtctgcaggtatgcacctagttaattattctagtataaaaatagcatgtttcttctgttaaaggtgacccaataaatgatctgaggtttgtataatactaacacctgcacatacattatctcaggcagcactaggtcatactggttaggagtcacagatttgaaagcagaaagaatctatgccctgtcacttactatatattcttaggtaagttacagaagctctatagcttcagttttcacatctgaaataaaaagatcctcatagcatctaacttggtattgtgaagagaattaaatcagatcatgcttggaaagttagtcttgagcacatactaagtgctcaaaagtgttgttatggactcactacatctttgtgagacaggaagcttggctattattatccaaatttacagcagagatactgaggttgagagatgatattaatgataacaatagtgactcacatgctggagggctttaactataataggtgtactcttcccaaagcttttccacatacttcacctccctttgttcagactcttggaaaggttgatattgcctatcatcaattccatttgctccaagaagaaagtcactttgtgaggcccaaaacctttaaaaagtgcagagtgaagctgctttcagccaaacctacgagccagtggtgatcaccataaaaagaaagctgaggatggcgagtcctcagtttatgagtgtagagggcaggtttgaaagaggacagttagaaaaacactcagcccttactgcctcctcttaggccctcttcttaggtctttttttttctccctcctgctgtctctctttctgtatgtctctgtttctctatttctcttttcttctttagatttttcagctgttcagatcacctgtaacactaaaacctaaattcgatgatgatatattgaatcaaagacttggagaataatttgtccttttttgttattttatggttctgtagctcatccctctgcttgtaggagttattggttcagatgctgaaactcccctaattcactggggcgattgtgagcagcaagtataccctccctagtttctcatccgtgaaataaaggcaggaatgttaacaccgccacagggcaattcaagagtgataggttatttcagggcatcctgaaagcataagatgctgaggaaatgcaagcgcttactagtaacaatgtgataacccgatctttcccgttcctgtcactctcttgcgcttgctttgttgctgaggcagccctgtggggtctcccagtggctgataacaacacacacacactgctgctgcagcttggatgagggaagaggttggtagattcagctgtgctgggcatcctggctgagtaacagagacagtgaatgtaaacaattaagatgttctaataaaggaacccaaagagggtcccagaggctagaatatctacctcctgggggcaaacagaggtttcctaagaacatgtcatctgagcagagtcctcaagtaagactaggagttgcatggggagaggaggggaaggtaggcctgcagacggctaggtgagcacaggcacggggtgtggaacatttagcttatggcaagagcagagggtacaaaggaaggagagagaggaggtgggatgggaaggtcaattgtgccaactaagatttttttcctgtagtaagggggagggagggcctgaaggactttaaacaggtgagccatgcaatcagctgtgctttgggaggatagctctggtggtgacatggagccttgaggatgggactatacgcatgagactgggatcagagtggaggcagctggcaaggaggcagtcaggagaccctactaatatagggaatccaaatgaaggagaaaaatcatgatggcacagctagaaactaatagagaagaaaaaataccccaggcattttggccttgttttacaacatatttcttagctttttgatggcaatggaagcttttttgaagttgtcttttgtttcctgcctttactgtatgctctgaattcccttctctttcatgctttttggtttgcatctattctttcatattggaggctttgctcaaacattctgtggaccttatctgtttgcatatatttaaatgcaaggcactgaaagacaaaagacctattcaaggcagagtacaaagtggaccagggcaggtaagtgggagagctgtgattgtcaaatggtggctccattttaagggcatcctgcagggaattggttcatcgagagaatatgaagtgcaagtccatgcagatcttttctctgaggctgttctgtttccctagagaagattcccacttttctgcttctggggatatctggctgctggcactccaggtgcagagtcgtagggcatctgagagtccagcaaatcattccatgggctttagatttcagccatggattctctccatgagtgctctgagagaactctccagtctcctgacttggcagtggctacacaggctgttgacctggctgtgtgggttgtgggagattcctgagatcccatttaccaacttctaacctttctttccctcttgtttccaggctgatttctcaacctctctgtcgtgagttgactcgtgtactcccaaaagctatgttgaagttctaaccccggtacctgtgaatgtggccatgtttggaaatagggtctttgcagatgttagttatcaaggtaaggtgagatcatattggattagaatgggccctaaatccaatggtttgtgtctttataagaaggtcatgtgaaaacacagacacaaaagaacgttatgtgaaggcagaggcagaggatgtcaagaactgctagcagccatcagcaacgaggagagatgcatggaacggactctccctcagagccttcacaaggaaccacccctgctgacacctgaattctagcttctagaactgtgagcaaatacatttctgttattttaagccacccagtttgctgtactttgttacagcagccctcggaaactaacatatccacccttggctgttcctaactcctgagcctctcaggcattccttctgaaaggcagatcggctggctccctgttgctctccccttgtgcagacattctgggagattacttccttcttagcttccaatatttgaggatagcttatctccacttattttctgtttccttcagagtgtatatctttctttgaaaaaaagaaatgcaactttattatttctaatcatgcttaatactattaaataagtcaataaaatgaggcaccaaagtgctcatttcagaattatctctattaggaaaaaagtgtgggacaattaaataaattacaacaagtcaattgatcggaatactaggctgccatttcaaaggataatgtgaaagttggatgcggtggctcatgcctgtaatcccagcactttgggaggccaaggtgggcagatcactttagctcaggggttggagaccagcttgggcaatgtggtgaaaccttgtctctatgaaaatacagaaaaattagtcaggtgtggtggcgtgtgcctatagtcccagctactcaggaggctgaggtgggaggattgcttgtgcctgggaggcagaggttgcagtgggccgagattgcaccactgcacttcagcctgggtaacagtgagactctgtctcataaagaaagaaagaaaaaaggacaatgtaaaaattatgtagaaacatggaaacatattaagaactttatgttgtgaccaaagcagaatacactcatgtaccctggtaaaaatgtgtttggatgtggacagtagtatgaaggggtatcaggaataagagaatgtgaggttcttatttctcccaacagtcactcttgacaatttaggtattctctaaggtgatgtatattttctttactgttctcatttgcttttgatacctcaacagcagagtttttaacattcacatatatttctccttttttccttcctccctcctttcctcccacccttcctgcttctttcctacttcttccgaagagagacgaagaagagaggctcatgaagaaaaggcaaataagcttttaaaatatgctctctaaaaaaactataaagttacttaagggaagagaacattccaagccttgtaaggacttggggttaagacatttagcttcattattccaaagcagaaatcctttaaaaaagagttacgtatgttggtcagctggataagaagaatttaagataagaattaagatcttatcttaaatctgtcctcaaaaaccttattgtgggtatatcctatttttttccattggattccagcattttaatatggattcatggcactgtttgagctcataaaatacatatgaataggaatatattaatactaacatacaaagaatgggtatttttttcaaagttttatgaaataaaacaaattatagtccattttatttaccaaaaaatatgcatagagatggttgtttatcaggtcaaaagactttttggaggtgaaaaacatcaggtatgctggaagaactctgagatgtagcgaagggtatgagatgccttcacctgccaattatcatgcataatgttggaaggaacaggaactaatccattcttctattaatgagtcctcactgctactcagaacttcttcctgcccagcacgttcttttttacttttcctttctttcttttttttaaagagatggggtcttgctctgtcacccaggctggagtgcagtgttgcaatcatagctcacttcagcctcgaactcctgggctcaagcaatcctcccaccacagactcccaagtagctgagactacaggtacacaccaccatgcctggctaagaacagagcatattcttagttgatgtttgtactgattacttttagacactacaggatcctaaaagttttctaagtcaaagaaagattaaattttaatcatgataaatttagtgtattttattgtattataatttctcgaaatcatatgtatgcaatatacaatatacatttcttgaaatctatctgtgacatatgctagctccatctcttaacctgaatattaaaataactagaggactacattttctggcaatgctggataaaagaaaatttaatgtatttcctagctgaaaaagtcaaagctctgaattcatggctattaactggccctttacagtagaattcaactatgatgagaactaaaccactttataaaaagatatcataggccatatactccagattatgggcaggaatataacagtgcatactctgatgaaaggttttatacatagtcatgcaccttataatggcatttcagtccatgatggaccatatctacaaccatggccccataagattataatatcatatttctactgtaccttttctatatgtttagatgcacaaatatttaccattgtgatacaattgcttacagtattcagtgcagtaaaatgctgtacaggtttgtagcctgggagcaataggctatcccatatagcctaggtgtgtattaggctgtacaatataggtttgtgtaagtacactctacgatgtttgcatgacgaaattgtcaaagatgcatttctcagaatgtatccctgttgttaagcaacacatgactgtatttataggtgataactaaatgacattataagcttacttcatacattccactgcttatactgcatcccatcattcacttttctgtttcttcattcctttgttcaacaaacattggctgagcagctctaatgtgctagcactgtgctaggtgccaggaatatggtggctccaggaaacccgtctaatggggaagagacagaaagataatcacatacagagtgtgtggttataaagagatggagacagtgctgtggaatgttgtggggaagtagaggttttacagaagtcacagcttgggctggtgtcttccaggcacatatgagagcgaggaggcataggcagaggccagggaagatggaccaaagggctagtgagtcctgagcttgggcaaagggtgtctggtaaggaagtgggcagggtgaaaggagatgaggccaaggaatagatgtgagcttcagaatgaatgagggggtttccgaatgctataccgaggacttcggaaggtaccttatagatggtgatagtaacctgaggtctttaaagcagggagatgctgtgatcagatttctttttaaaaaaacatcattttgtcaaaaatttggaagatagactgtagtggaggggcctataaattacataaaaccaacacttttgaatattaatgtttctcttccattcatatttgactaataacacatagaatattttctgagataaacaggctttactatctatcagcactcagatttgggtacattattatgtaacaaggacaatattttgagaatggtaaaccagtgcattttccattctgtttgaatggtgatgcctggggctcctctcccgtcatctcagtaggcttccctccttcaggcaaatggcggttcccagctagaaacaagctgccatcattcagctttgaaaaagaatagccctacttgtagctttgcaaggtgaagtggctttctacatttcagaactctcctttctctattaagaaccaaacctggctaagttagatcttcaagttttactacaaagctctagcaggaagaacacagaggagaccatgtaaggatagttcccatcaggaaaagcaaagcaaatggaaatattaggggaagagggggagtggggagaggggcagggagagagaagagaggagaaagagagaggggagagaaagcagaaagaggcgggtgagagagagggagagtagtcctggcttcacattccttgggggtcaaacctttaaggggagggcttttatttcaaatttcagagcctaattcaggaaaataatagaatcttcctaaagcaagttggtatcgcccaggcagcatattagaaaagacttaggaagttatgtggacagcagggtgaagagaaagtagctgggagttcatgggtgccccagggggactgaggaaatgccaagagaaccaatcagctagaactggccaggaagctgctgggggtggtgaagggggcttgccaagaggctgccacaaggaccacagacttaagtagccagagctggtggccagggctggcacaaagtactcatcacacccacaccatagtcacacggggctggcacagcatcacagccagagttgcgaccagccacctctcagttaacccagaaagacccaacaggcaagatgtgtaccaggggtccttctcttgaaggtcacaaaatcatcacaaccataggtgagttccctggtacctagatgtcagctggggaggagaaagagctctgattaggagtactttaaccagaagagattgagatactttaatagtcaagtttaaataatagtccctgaatgcagccaccaccctactccccatcaccaggaaaaagtggagccagatagatcagttatagagaaaataagaagttgttttccttcctttcttccttccttgcttctgtctttccttctctcctccccttccctcctctgcctctcctcccttcccctctcctctcctcttcttttttccctccctctctctctccttccctacattcctcccttcctccctccttctttcttcctgtattttttgagttatgtatgatgccattccatatatataccccctttgtaaggacaagtaagaaactagacccaactatctcttcctttcatccacaagaatactaaaagtcatagagaaacacttataggaaactaactgatttgagtggtgtctttttttttttttttaatatctgatgaagttgtttttagggaacactggattgcttttaaagtactttcatcagtatccagagaaagtgtcctggagtagcaccttatatcctcttttctagtttgtcagtttctaactcccattctactatttcaactatattttaaagttttttctcccttttttccagagaacctattaatattgcatcatgtggaatgtatttttcaaaatgaccattaaaagtgaaggcagaggctgggcatggtggctcacacctataatcccagcactttgggaggctgaggcctgtggatcacttgaggtcaggagttcaagaccagcctggccaacatggtgaaaccccatctctacgaaaaatacaaaaaaattagccaggtgtggtggtgcatgcctgtaatctctgctactcaggaggctaaggcaggagaatcgcttgaacctgggaggtggaagttgcagtgaggcgagatcaagccattgcactccagcctgggcaacaagagcaaaattctatctcagggggaaaaaaaaaaaaaaaaaaaaagtgaaggcagagaaaaaaatcaaagtttactgtaaatcttaacattagcagccctgcctgcttcagaaacctcatgacattttaatagagaggcactacccttaccaaaattttcctactcttaatggaaagagaaaattattctggctagatgctggccaggtcacatccttttgcattatctgtgagaaaatatccactccaaaatcaaaagccagtttgggatgagctaaaaatcagattacattcataataaaaatggaatctctcagttcttaacaaacaaaagatttataatgactctgcaccactgacattctaggtacactgagatttggttaagttgagaatgaaaataaggagccagaacttagcttgctattgcagacaaaagctcaaaatgatactgtgacatgagggtttctgtttatccctaaggctggtgtggcaatttcaaagtttgattgtgtctttttttcttccttcttcttctttttttttttccccctccaaagacgttgagcagcagggctaatggatccccagcagggtgcaaagacagcagaaagtgcaggaatcagatgtcaatgtattccttcgagataccctgctaggacacagctaactaaccagggcttgagtcttctcttggggaatgtgctttgatggttccctgcccactcttggcttcctgattaaaaggctgtcacccataaatcacgacttcatcctgttacaatcattttctttctttctttctttctttctttctttctttctttctttctttctttctttctttctttctttctctctctctctctttctttctttctttctttcattccttctctctctttctttcttctctctctctctctccttctctgtctctctctctttaaggaaaagtctgaagattaaaaagagagcaagttccagagaactctatgctcacatataaacatatggatataagcctggcctacatccttattagatagctattcatcgatttgggactgttctgtgcatgtgtcctacccacctggcatgttgggagagctaaatcaataccacaatgacatgctgtctttctccacttgagatagaaccagtcagcctctctcgttgacaatatatatggtaaagagggcctgcacatcgtttttttctgttttatttaaatatttttatatattttctgtctgtcgctttctgtcaatctcaagattacttagataacttcctagtgaatagattttggaggaggaggagttcctcattgttttccctcaatgtagtaaaaaattgagtggaacttgaagctatcagagataagagtttcgattttaaatgcactgggcatccaaaatataccggtgcaggtgccaattaggcacataaataagtagcccttcaggcactgagagtagtgataatcttcccctttgcttggagaagagctaaactcagcaaacaggaacacaaacagaaagtgctttatctatttgatatttgacaagcacaacccttttaaaaccatgaagtaaaactgaactacccagtgaaagtcaatgaagtcaaaaagctgtaccaaaaccatatgcatatgtactgcccagcagcctggccacccgcccctgccaaactcgctgttctgtcccactgctgtactcaagagcctccagccgtggggtgccctgggtcaactcccaccctctgtagactccaactctccaacctcctccacctgcaggaagatcccagctctctctatgagagtgcttgccttgggctctacatgaaggttcttgccacccaaccttgccctaccttggggtcaggccttagctgttagaggggacatgctttgtctcatgtgtactcctcggtattcttttgccatatgcctagaccaacatggtaaagcaaagctgaattcttatgctgtatttcagaccaatcacatcagggattcctgccacctgcacacttcccacttgccttcgatcctctcagactccttatgattgcatttttatgttcaaaaccccaaacttgactttcactgagttatctcagtgaatggtgtcacatcagtgaccttcctggctcgtcacttcctcaaggtgttgtgtcttcctacaaatggtgattcctgcccactgactgattcaatttcatttcggaagcaccaacagttaatgtgagattatccagttaaatagtggagggaagggagaacactgcatgagatcaaataaaataaaataggaccctcagagaggatacttaaactcaccctacaaagtttcagttgagggctcttaaaatgattggtttcaaagccttgtataaaacttacaaatgaaataatgagatctttttttacttagtgatgacaaggaatcaaaaagagcaagattttcaccccctgttaaatgaaaagatacagcagcaagtatgaatatgagcttctgtaaatagctccttccatattccctttcagcatgacacatctctccccagttagttaaataataaaaaaatggtgcaagaaatttccatcagaggtgaagtagggcattagaaaggtcactacaccaaaacaaaggtcaggggtgagcaggacacaactctaatttggtgggagcatcacttaatctttctatatgttaatttcctgaagctgaaaatagcagatgtatctaaccgacagataagtagtaaagtaaaacagatgtgaaaaatcaggacgatatataatgtgaagggataatattactccctaaattctagaaactgctatttccacttaaattcaagtaacttcctttgtaacctaaagatttcaaagcatttaataggaagcataagataagccctaaaggattgtcaatcagtaataaaacaaattaacatggaaaaccatatgaggatcctttacagcctttcctataaccaacacataggaagagtgtgtagactttgagttcactccaaaatagctttgcaaactagtaccaaaacttaatcagcttcccaccccaatacatatcttcatcctcctaagctttacccaaagtaaaaggaatgtagtaattgcatgaataatttcttcatcccatttattgcctaagtgtgcacacaaaactgaataacattaaaaagtaattcaacatgtatagtcaaggtcagttttgcaaagcaagatacacctgacccaaaagttgttgagctttgcacatgggggactgcttattcggagacactgaggatgggaggagcagacaggaagaaaaaagagttgaggatccccttaaaataaagtatacatcattttctattttgtttgcccaatcttccattattaaataaaagaacattatgttccttttataactaaaataagcagttgtagattattttaaaactttacctgattttatggtatcatgtatttaatggctaatataaaacaaaaatgaatttatttttgttatagttatcaaaaattacatatccatcttcaagacagtattctaagtttgtttgttttcagagttctgtgacagggctcagcagttcctaaaagtgctgaaaacaaagtggtagatgatcttgaacttgatggttgtgaggtccttaaaaaacaatactgcgtttttaatggggttacatagggtgaggaactaaagagcttttgctttccctgcatgtttctcactttgaagttaggaaagcagctcagtctgactgagctaggttgtgggtaaagaacttgccaggtttttacaaatgaaagcaaatgcttagaagtagaattaaaagccaatgtacaataaactgttagtgttaactgatgccagccctgatccgcactcaaaaagtgcagtgtgaaccattcaaagcgacacttttctcctttcagaaggagaggcctacacaccaagtagcagagctggaaacattagcacatctcgctcagaattcactggttgggatttgtctcatgcatctcagagacaggcagattttgaagctggaaggtgcgtcacaaaaccccctgtatcagaccatggggtcagagccgaacaccatgtttcatggaatcctcattcccacattatattaataaagaaaatttgtaaaaaaaaaaaatttccatggtcaaatatgtttgagaaattgagctgatcaagtttaaacgtttcttgggcctgtgagctttttttgaacagatagctattagatgatggctggatgttcatgttctatgggacacagtttgagagatagtaaataaaatattagtatccctggtttacagatgagggagtagaggcccatggagattatatcctagaaagtggagaacgcaggtctgcagcctcctagaaccaactcttcccagccagggcacagtcagaaatccaagaaagacaaactgcagccagagctctccgcaatgtgcataccctggaaatgtctcctcaaatgagtgcttttgagaaatacacacttttccttttctgattcagtcagaacatgtaggccctcccaaatcaaagtacctgatacaaaggcatgcagatgctatcaatccactccagttgcaaccgaggcagttcatccttccggttccgatcaaaaattgcctagaatggggggcaggaagaacctcgctttattacaccaaagtattttacagggtgctttgtcaaacactttgctagaatgatccattttttttacaaactgaacccttcgcaaatcacaatcaatctttacacatactttcttttcctttatctatgatgagaaataaaatgtttttacctctttttatgagatttgtaagcaaatttacttgaactttctagcgtgcaacttcttggggcaaaaacctgtcttcaaatataagtaactgctactaaatcaagtcatcaggtcactgcgaattgggtacaggtcaaggggaaaggaatatgttttactgccacaaaaataatgcaggcttttatttctgcattatgagaggttgggatagaataggacaaatcggaaaatatccttaaaagcaattttattgtaaatagaaaccatttatactaatttttctgggtaggggttgatttggcaattgcatatgtttttcagtaaggttctgtcattaataaatttttaaatatttatttatcattgtatggatgatggtgggtggactcattatctcttcattcccagcccttaagctttatgatgatataatgtttgagataatttaggtatatttttgggaaaaataaatgacatttttctgttgggcagacttaagggaaacaatcaattggaattttagtgttaaaattaattcactgaacaaacactgccaattctgtgccagtgagactgtctctccctttgttcttaaggagtcaggcccagaccagagaagctcccttgtgcccttacttatctagaagactgggctatctagttataacttgccctcccttaatgttatatagtaagttttatctttcctttacataaaatgtggcattcacattattttggtgtccttataggccatgagggtggagccaagcaatccctttggtccagagatgtaggaaaatcctgcatcgttcagatgtatgaacaagagtgggagtgggtggggcagaaatcactagctgccaaatctgaggaaaatatctccaaattggggagaaggtcactgattccaccaggcttttctcatccttgtcttgcaatggaagatgggaaatagcaggaaagaagactggaatttggagaaaattgtgaaaatgtgctggagagagggatagttcttgtgaataatatgagtcttgatccaaaatgtttctttagagctggctgcggtggctcatgcatgtaatcctagcactttgagaggttggggcaggaggatcacttgagcccaagagttcaagaccagcctggacaacagagtgaagcccctgtccctacaaaaaaaaaaaaaaaaaaaaattagccaactgtggtggcacacacttgtcgtctcagctactcaggaggctgaggtgaaaggattgcttaagcccaagatgtcgaggctgtattgagctacaatcatgtcgttgcattccagcctaggtgacagagtgagactcagtctcaaaaaaaaaataataataataaataaataaaataaaataaaataaaaataaagaaataaatacacaaaatgtttctttaaaaaatattattctgggctgggtgtggtggcttatgtctgtaattccagcactttttgaagccaaggagggaggatcacttgagatcaggagtttgagaccagcctggccaacatggcgaaaccctgtttctactaaaaatgcaaaaaattagctgggtgtggtggtgggcacctgtaatctcagctacctgggaggctaaggcaggagaataacttgaacctgggaggcagaggttgcagtgagccaaaattgtgccactgcactccagcctcggcgacagagcaagactccatctcaaaaaaaaaaaaaaaaaaattatgttttcttttctctatagttctgtctaaaattttcatatttatttaattattccatttctagtggatattataaagttacttttttaaaaaatgcagtggtttttagtatatttacaaagttgagcaactatcactacaattatagaacattattatcatcctcaaagaaaccccatactattagcagtcattctcgctttttttccgcactcccagccttaggcaaccactaatctactttctctatctatggatttgcttatcttgcacatttcatataaatgcaatcttatgatatgtggtcttttgtgacttggcctctttcactgttttcaaggtttacccatgtagcatgcatcagcacttcattcatttttattgccaaataatatttcattgtatagatgtcttatttatttgttcatcagttgattgacatttgagttgcttccaggatattatgaataatagctgtgaacattcacatacagtttttatgtggatgtatgttttcatttctcttggggatatacctagaggtagaatttctaagtcatatggtaactctgtttaactttttgaggaattgacaaactgtttttcaaaacagctgcaccattttacattcctgctaacaatgtatgagcttccaatttttccacagcctcacccaacacttgttattgtctgtcttttttgctatagctatcttagtggctgtgaagtgatatctcattgtggtttcagtttgcatttccctgatgactaatgattttgagcatcttttcatgtgctttgtggccatttacatattttctttggagatatgtctgttcagatcctttgcctatcttttaaattgagttatctttctattgttcagttataatagttctttttatcttccagatacttggcccataaaagatatatgatttgcaaatattttcccataatatgggaaaatttactttcttgatagtgtcctttgatccatgaaagtttttaattttgataaagttcaatttatttatttatttatttatttatttattttgagagagtcttgctctgtcacctgggctggagtgcagtggcacaacctgggctcactgcaacctctgcctcctgggttcaaacggttttcctgcctcagcctcccaagtagctggggttacaggtgcttgccaccacacctaatttttgtatttttagtagagtagaagtttcaccatgttggccaggctggtctcgaactcctgacctcaagtgatcaggccgcctcagcatcccaaagcgctgggattaaaggcgtgagccaccactcctggctgttcaatttaattttaatgaagctcaattcaacatctctggaccaacatctctgggtcattttgtcttttgtctcctgtgcttttggtttcatatttaagacaccatggctaacccctatccagaagatttatacctatattttcttctaagaattttatagttttagcccttacatttaggtgtatgatccattttgagtttatttcagggtatgctgagaggtagggagccaacttcattcttttgcctgtggatatgcagttgtccttgaaccattgttgaaaagacattatcttggcacccatgctgcagattagttgaccataattttaggggatttattattgtactagtcacttcttaatcaatgcttgatgagaaaaaaaatgagtgtgaggccccacacagtcctgtgcttcacagcattttgcatctcataaaataagtattagtaatcatttatttcatgtctatatttcccaccagttgacaagatccttgagggcagggaagatggtgtcttactcattgctggaaacaaggtgccttgcttcatgcccgacacatggaggcactcaggcaggctttcctaactgactcactgcttccaatcctgaccctctggctgtgggccagattagcctttgtctccatgaagtgactcccatgactcctgggaccatgatacctgagggggctccaggacagttttcctcctaaatatcaagggataatgggcacagcagctgtcagctctgggtgcatgcatttacagatatttctggaaaagaactgagggctaaccctgccacatcagccaggcctcccctgaggagatggtcatcagtggtgctccgtagtctttgtgagaagacaggagcatttagagctatgtttctaccgcaaaattaatttcatttatgtctacagaaaatgccttacctgagcctacagataaaggctccttagtgctgcgctactgcacccaccagctcaccagtgctggcaatttactcatatttttttcatttaattaaatgacctgtggtattgctgcattgtaaacccttcagagtatgcctctgaaacagtttttaaagggggaaaagcttttatttgaaagtagatatgacagaatttgggtcatactaggttttatacattaactgtatgtatcccaagctaatatttttatttttataaccaaatttgatgacaccaccaaaaaagggatgttttgagaaactaagtcaatgttgctttgaaaactcaaataattgttgtgtgtgtttcaacctatgtagcctcctgatcttttgtacataagcaaccaattaagaatattcaaaattagcaagactgtgcgttctgacttcaagcagatgaaactattcaaactaggagctagttctcttgcttttccttgtttttaaatgtcagcaaagaaggatgtcttaaaacttgaagaccttataaatacctccaaatgttcaagctcagttaatttgggttctcataaacagacattcttgacaattgataccttccttgagtatcactaaatctactgtgctatgctaggctttaaaatgctttgcaccactctcagagtcattgggttatatgtttttagctaatcattggttagtaataaagaggctgcccctcttgaggtggtgactgacgcagttatgtcttctgcatccttatgcttaaaaacagcatcatcttgagcgtaaagtaaacattcttaagtaataactgagcagataagtccaatataaatagcgttcaaatcaccagaacctagttccccaggtgaaactttttcattttacagacaaaagaaacagagatttgaaatgatttgcttttgggattttgaaagttggaaattggaaaataaaatctagcttctcaaagctagaaagccttcctttaatttttgatgcacagtgtttctattctaaagtaggcatacatgaaatgccagcactgggctttgaattattcaaactccactttgctcatcctccctcgtgcctacttgtcccactgtgggtgcgcaggaaatgcttgttaagtagctcaccactcttaatcagaaacttgggaataagagtgtttagcatttgagtttaattaaggttttaaactttcaggagtgcttccttaaacccattttcagtctttcccatttccaacttgtaatttggagttctttttgaaaatgtcattcaaaagggtaaatacgttataattaaaggatgaactcactgaaggagtgagtttgagctctaatctctcccgatctccttgttcgaagaactcactggttacaagttctgccacctgaaacatataaatattttaatctgtgattatgtgtagtttatcacgagactcagaagttctttcttgcttatgtatttggtgatcctcatcaacacaatcatttaaaaagcttatgaggaagtaagtatattaacctttcatgtttgaaggtgttatagaacttaatgaaactgatttccttttaatcaggacaacttgtgcaatgtaattttagatgcatgccaacaggcaatctgccacagtacggcttccatatttgggatgaggcaacaggttgccagcttcaaagcaggaaaagttcttatacagaaaagtgaagcaaatattcatttaataataatgtgtaattattattatattatgtaatgatagtttagccactttttattatttctatgtagattatttattttgttgcatacttttatgttagcccagcttcaatttgccacatgaaaactcctcaactccctccctaccaatatttgtatgcactctgggagggataaccccagggcacatcctctgcttcctactgttgcaatcaatcaagaggcaggactaatgccagattcactgttcatagcagacttttacagtaggtcacggtatagtttgaagagcatgacttggtcttcaggctgtctggatctacgcactaaaagtgttaatttatggtaggctctacttggtacaaggacaatgggatgcttgttctacctgaaaccttaaatagagacttatatttttctacttttaatccattagcttggatggtcagcagctactgattattgccaagctaaacagatttttttttttcttttccacaccttcacttctcaggatagtgtgtgggaagcaaattgatatgacagattaaatgttgaatggctattttcaacgctactacagtgtgcatctaggacatttctgagatgaactagctggatttaaaaaaatattggaagagtagaataaatcccagacaacttcatggtaagagggcatggataccaaacaaatttttctctattccaagttcttatgaagataaggttcttaaatctggcaaagatgagacagtttaattttggtcaagtgcacagtatcaagataatttaactccgttgatctctcaagagatttgctcaatcacagattatagataaaactgaaacacaatgctaaactcacacacacacatctgagagtagcatgtgtgcagtcacatataaagaaatcaaatatccagtaagttcagatttctatatttctgttaagaaacatgggcccctttcaagatcaaccacaaaaaactagttggaactgactgaaaaatccccttcaccccagcctcttgtatatgtgcctgttttctaggactcaattcacttgtctcctctccagtctctcctgctaccctgcatttcagcacaccaggcttctctcttctttctctggccttcctttgaagaggaaatggtcccctaagggtatgacctcatttattcagttcccagaactctccctcagattgctctaagctaggtcttttgcattaaagaatgtaaatgtgcacatcaggcgcctcaaggtgggagtcctgcataggtctgtagcccctggaaagaaaagaaattaaaacaaaattctgtcgttgctctttctcaagtacttgttggtatctcccctgtgctcctttcacagcttaacttgcacaactgctttgttggtacttaaaaacccaatcaggaacattaagtggttactgattgaattttttattaaagaaggaaattgagatgctaatcaggccttgggggaatcactggggaaacccacatgcttagagtcttgttgcaggaagggaaagtggaatagaccccagcagaaaacattctgaaagggaattttaaaaaatcaacatccaggaagttagagaaatattttttaaagaagggcctattgttttctccaaatgtttcctaaaattttgaagtgagcattaaaaaaaaaaaaatttaacccatcaatttggagacaaacaagaatgagattgctagcttagaactgtgacaagctttccgatggaaacattaggaaaaacacggttttgtgttttatttccctgagctcttatgtttctgcacttttcaacagaaactcacatccagaaaataaaataatatttacactagtgaccgagaagaccacctacaagcagctactgggcctcccaagtcggcctaaaatatcaaggcagaaatttttttccttgcaagtactttgccctgtcactttcctgttccctggggctactgctccttgagtccttgacatgcgtttcactgtggtttctgaaggtgctggcacatcatacctcaccccattccctttctgctcttctctagttttctctcagtcctcctaacttcctcacactctccacctccttccatccctattacaggagcctcccccagtactacactttttcccaatacctggaagagcctcctacctcttccctgcagtctactcaccaactctcccagaagggaggccttcccacatgggaaaggggagggggtaagatgaacagtgggcagagatgtggaaagaagctagtcaaccacacaaattcttcacaattatcctgctttatgtgactttttgtaacttcaaatatgtcacactgaaatttaaaccaaagcacaattggtgaaatactctattggaaaactgcctgatgtacattggacagtgtgagcaagaaataaacctttatttgtgttgaacaactggaatttaagaatatacttgttactgaaccaaggcctagcctagccttgactaatacaaaaattggtacggaagtgaggtgctgctgttagaaaagaagagaaagacagaaaaagaccctaaaatatgtgtcatcagcttgggggccaggtatcaagatagtgaggaggctataaggatgagaatccatggcaaaataatttgtacaattataactaaaagctaacaatgttctgaataaacttacagtcttcggagatgagattagaaaacaaaatgttagtagcatgtgatgattgccattgactgttttgcgaggaattacaggaagtgagttagaaaaggaggaacaggcttataaccaggaatgaaaggaaatggaaatagtcgcaaattcagggacttgtagggatggaagataaaattgcttctcaattccaaactatgaaaatgaaaattgcgatacactttgacgaagtttgattaggactcagctttgtaacaagaatcaaataaaagacatctagagttagaatctgaatgaattaggtagtttgcagcatatccttctagctggacaaaaatggctcgattaaatgatttacctatatggttctctcactgaagcctgttaggcccaaggcactaggaattaagtcagaagagagaaagaaataaatatatttgccacatttctttattcctaaatgtaaagaagcaaataaatacagaaaatctaagatgtttgtatggaatgtggatgtggttatgggcaaatggaaaggacttgaatcaaaaacataaaaagctgactaaacgtacaagagagttttggtgccaaagaaacgctaagcccatgattacacaaaacaagtgttgggacttcaaccttctttaggtgagaagaaggcagtttgaccttcagataaagctaagaagggtgatgggaaaggaataatttcccagggaggattgaaaggtcaagggaaaaaggaaccagagaacatctcccagagaatcagggtcccctgcatggtagaacacctcacagtgagtacccagtgggattttggagttgccatggaccactcaccactccacattgctatgaatatcgctcatctcttccctttccgaatgggagtctttgggtgcatgttggactctgtattttgggtgtgtgtaggtctttaatctgcatccagatctgttgtagagactagcatgtatctcccagagatcctggacttaagagtttgatgccgtgactgatgggacatttgggttgtctttcttggaggaaggatgggtatattttgtctgctggagggagaatgaatcacatttttggtgatgagaagggtaaactctggtagtcatgcattcactatttctggctttctcctttctgagcaaatagaaggatggtacttcctggttgggtggggtcatgtgacaagttctggctgatgaattgttgcgggaagcatttaattgccagtgcaagaccttccagggcctctgtcagaatgatctaggtagtggctgttccttcagccccaatacagaataaggacaaagtggcgcctgccaaccctaggtgcccatgttcgtgagcaatttgttgtttaaagccactaagatcttgggtaaaatgataacatagcctattctgtggatacgcttgcatcatttaaaaatgctgactgatgcatcatgtgaaggaacccataacacactgctaagaatgaaagctttggagcctaatctgctagaatctatacctagctctgccacctacaagctgtttaaactcaggctgcttatcctttctaagcctcatttttcccatttgtgaaatggggataataaccatattagtttcctaaggctgctgtaaattaccataaagttagtggccaaaacgacaggagtgtattctgtcatagttctggaggccgggagttctacatcagttcactgggcagaaattgaggtgtcagcagggatgtgctccctctggaggctcttggacagaattcgttccttgcctcttccagttttcctttgctcacggctgcatcactgcaatctctgccttgtcttcacattgccttcttctgagtgtgtaatttccccctgctccctcttataaggacatttgttattggatttagggcacacctggataatctaggatcagtctgcagctgagatgcttaatcacatttgcaaagatactctttcctttcacggtaatgtttacaggttccagagattaggacctgatatctttgggtggccattattcagctgactacaattttaaggattaaatgagatagtatatataaagcagtcaataaatattagttatttattgatatggaaatgcatcttattttccctaaaacgtcaagtctttagatgccaagttactgttctggaccccacacagtaggtgcatcataaaacgcacataacgattaacctctaaataccatcagtaatccctggtcttcagttgggtagttacttaaattgaaaactattcttatagaactaatgctttatggcagagaaatcagataggtggtaaaggcatggtttgtttttctgcaagttaaattggatactgcatattttgaccacagaggtttctgatatctaaataatatttaaaaagaaaaatataatttcctttttgcctccttttattttcagatattaaaaaaaaagaaaacaagactttgtactgagatgtgattatcttgccaaaaatcctatctttgaaactcttgccttaatggtcaatgtattattcagatttcgcacattaaaaatatcttacagagtcagaaatactattgcttagtgaaagcacgataaaaaaaaaaaaaaagggctgtgcaataaactgtgtcgtgcctaagcctcctgctattttttacaccatgttaatactgatgcaaattgactagggtttcagtgcctggtagtcagggctctgggaatattgtgtcccccttacgccccccagtccctcctctgctgagccctgccattaatcaccacttgcctgtctggagatctcccacggtttggtcacggctccaaggtcacaggctgtcattaacattgatctgaaaaacagaaccaaacaaaacagcctgaataatcttttgttgcattcctaaacaaacccgtcctagatacataaataaataaaataaaatggaaacgaggccagctcacatcttcctttcctcaacaaggggcagcactgtttatagtccctgtgttcagcatctccatcatgtggccacgctgcttaggaagacaaagctctcacacatcctctggtggcccttttgttttgtctgcagcaaatcaaggaaagcaaagcactactttctgtacacctgagctaagcaagctctgcttaaaataatttataatggacaatgttgttgggtttttttaaactataagcaagagaatcagtatataacactatatacatggctgatgaaactacttaccaacttatcattgattgatgggaacaaaagaaaacccacaccaaagaggcaaggcacatgccacataaggggctccttcattttcatctgctctacagagctaagatttatgggcaagagctgtatcatttcactccagtttactacctggctccaacaatggtttataagcattatgaagaagaaacatactcagctccagctctcattaatttgggcacataagaaagcacaggaatggtctgaatcagagttttgaggggcagggttaaccataattcatacggaaccatggaaacactgggaacaattcaaattgtagatagctctggtgcttatatataatttaatgtggtgggaggaggaaaaataaggcacactctgtcccaaatctgctttctttgtgctgataaccagcagaatgtgatgaaaagtaacataggatttgagctggggaaccacatcttggctaactgcttttggaagaaaggggtatgcaaccaaaggtcagagggctgtcctgatgtcggtgttaacatttcataccctgccagatctaatgccttggaaacatgtctgctgcccagatggcagagcatgcttagatggcaggggggtccccccacaggaaacccctccagggaacaaggcagggtcacagataacaataggtcattcaaggcacaaccaggtggcaccggcatcagcagccctctcaactcgagcagcattgatgaaacctctaattccaaacatccctgtgttaagaactacgcaaagggagacacatcagtctattcatttttgaccttctgtatcaggcatttctacactgcttactgtgtgtctgcttctgtactaagtgctttactaaccaactgctaactaaactactaactaaatgaatcgtcatcaccaccccagaggtagttgctattatccttattttacagataagtaaacagaagcacacagagattaagtcattttcccttcccaaggtgagtaaatgattcaggattctgtgcctatcacaaagctaccagatgccctcttactacacatggatgctgacagtactggagggggacaagactggctaaagcattggatttctcagcatctctcctgcatagcaaataatctctatgaggttgcctatttgtatcataatgtggataattacttaggttctgtccagttgataatttgaaactttctcttcaaatgcatattgccattaatcagttgatcaacaagtttattgagtatctgctaggtcctcagatgataattctaatagctaccacttattgggaagtctccacagggtgactgactcagtctctatatgtggtagtgatactattattatctcttattaaagttaaaaaaataaggctcagaaacgttaggtaacttgcacaaggttgtacagttattaagtgtcaaagctgggattggaatcctttgtctgacagaagaatctctacttcaatgaatacagtggagcaagaagtccatgcagagaagggagacaggacaggctgagaggtaggacgggtagagtggctgcaacctttgtccatctggcactggggagtcaactaagcctggggactcaggagggacctggatagacctttagggaggaaactttaggtggtggatgtgaggatggtttgaagaaggagagggtggaaggaaggagactcattggagatgtaaattgataggagcctaaaacaaggaagggagagtgggaagggaggcacagggatggaagattgcaaaggaagaactgaagaaaacaaatgagcagttctatgttattttttagattaaggctcttcaagaagtgaaagatctttttgagagtaaaagaccagggagagagtttttactaactgttttagactgaggtccctataattctagttcagtttatagtgagttaacatacctctcctctatatgccaaaattatttcaataataatcttgtgacaatcattatcttcttgatttgttctgtagttgtaaaacaatttaaaatgaacaaattttaatgttaaagatatattcaaattgagtacaaagattttgtgtagactgaaatctgcacttgcctaacaaaaatatgacactttgcagtttgcacttatttcagttttaaattttaaccatgaataaaacccacgaatgatcacataaaatgacagaatgaaagtatctcaagttgtatgtcttcatctttaccatcaccgtgctatcattgtttgttctgaatatagtctttaaaagcaggaatatgagttctgcaaggttagaaacacaaacgacacccagagagtttgagaggttctaaatggttaggaacttactattgaaagtgtatagctgcatctacctatgtcaagagccagctgtatgcctgggcattcttagaattaacttacattacgtgtgcaaagaaaggataaataataaacatgtgcttatttgaagctttcatatcaattatttttatcttaacagtaacctcagcaattgtttggaatttataccaataaaagacatttcttaggaggtatatctcaccattgactatttagaattgctggcacatggtggtaataaaaagcagactgacttttagttggttttattactattttaaaattctctacagatggtgctcccttagagcaccacccttggtgcaaggtggtcagagtgtaaccatgaaatgggggagggagggcagatgaggggagaggggagaacccagagcacctccattttatgtaacatgcttccaaataagatatttcttccatatggggttccttgtcaaaacagtttgaaaatctctgtaggaaaatatctaggcagagaaactcagaaatggcatttcaggaaaagagctcagaagagaggcaagcccaagaaaagggctgggagtcatttgagaagagatagtagtgacactagaaggatgctgaggaaaaagagaagagaataaaaaatacatccttgggggacagttctgtttagtggatggtggggggaagaagggctagaaaagactaagaaggaaagagtcagaaataaaggagagaatccagaagcgtatatggctttgcagaatccaaggctgtagagggttttaagaaaagagaggccaacacaattaggggctataaagagatcaggaagctgaagagaacaaaggttgtagcttttaatacttggaaggtgactgtggttcaacagaagcagaaatcacatagtacagacttaattcctcagtaaggaatgggtaaatactctgtggtatatctgtattttggaatactgtgcaacgataaaagatgatgaggtaaaaacatgtaaagaattccaaagcatgtagttgagtggaaaaccatgttcacattggtatgtaaatatacaatttatgttaaaatagacaatcaaaatacacactaaacagtatttttcctaagggtgcatgtgtatgtaaatgctttggaaatggtctggaaaaacacaatacactaataacaaaatacagctgtgcaaccagtatgggaattgggggttgagctcaaaggagatctgggggcttattagcaatgtttgatttgttacagaaaatatatattcatataattactcatggcattaaaaattatacaaaaagaaagaaattgccttgcaagaaattaggaagtgtgggagtaaagggaaggagaaaactatgatggggtctggagaaaaggcagcctgtagggatgactttttgattggggaggcagaagtgtgtttttaggtctagaaaggtcatgattaataaaacagattttgaaaatggaagctgaaggagcatgattgatagagccaggttggggtaaggggcgaggaggtggaaggaatggaattagggcaccagtggaggggctggtcttgaagatgaaaaatgaagaaaaaggcctgtaaagataatacagaggaatattaaagcatagaggaaaaaaactagagccctctggggagagggctgcaggaaggtgacatgaggacagctacagagggtggggcaggcagtggcctgtgttcagaagatggtgccagagattttatatagcagatacggcaggactatgtcaaggtttccgcttggggtaatccagtagttgcctggttgtggagcagacccagtgtgccctaaccctggcctcacgagctctcccagcaaaacttagcaatgttagaacagggataagacagcagaaggtctggttgaggtggagagagtagaaggatggggtatgagagaaagaggaatagtgcccactctctggagtggctgcaagagaggctaaaatttgccccataaacagagtgggttgctactgtcctttctaaacaacttggaagacgtcccaggcaaaggctagaacagactccttatctccacctccaatattgttctgactggttttctatccgcaatgcctattgtctctaaagaaaagcaaaagttactccccacttcctttgtgctatgtaactctgatttctaggatgcaaaaatcccttctccacccaacttgcacccccacttccccaggaaacagaagaaatcatggcttgccaaaactgaactaatttgaacttcattttctaattttgatggcagatttttgagacaaaaataaattataagatgaaaagacattctcagtaatttctttaattattcaactgatctctgaatgttttgaatgtaagctaagatttgttactttaaaaatcacttctatgctcttagtactgtcagaaaatttatgtggactaaatgtccaaataatgaagaaacacataaacaagagctttttcttaccgaaatatatcacgatggtttttgatgttccaatcgtattctcctttactgacaagttcaaagaattcagttctcctcctgcaggaaaatcaaatgaagaaagaaagaaaaaaaaaactggaatgagatttcccagtctgtggggtgacataaacacatctatgggaaaaacataagaccacttgaaccaagtaacttaatatttgaaatcatgaggctaaagcactatcaaaataaatcactttctaaaaaatgttgaggcttcaaggaaaagccacaatcatttctgaatgtatttacaacagaggagattatagagccataaaacagaaaacaatgtggtgcggcatttaggattatgtgctgtgaagccctagtgatacttactgaaagtcagagaaaggaggcaaggacaaataaaaagtggggacaattctagaatgttcttttatcatccaacaaagaattgagctgcatgatgatccaagataagataaactccctggtagtaaattcaagataaatatatttttttccaggttagaaaataactatttcaccatttcagtgcttaaacgcataggctatgaagtctgaaagtaacggtgtttaaacactcgctcagcaactcgctttggaaagttaattaaatcctctgagtctcaatttcttaatctctaacacgggggtttcagttgctaactcacagagttactgtgaggattaaatgaatgacatgtggaaagcatgtagcatagtgtctcaacattttaagtgcttgacactataaaccaaaaataaaattctaagcccccaaccaaataaatggccttctgctcttggccaagggcattcctaaattaacctgaaatgctagtacaggccatgatgggaagtgggagttggacatgtctcattattccttcctcccttttggaattcaggtacagctgaccagcattaacattaaaacagagaccttaagactgacaaagcagacactttgtagcaataagatatcaacatgacagacagcaggccctaaaagaaatcaaagtattttatcccaaaatatatttatttgacatattttgaaatggccttgcaaagctgtctcttttggagaaaatctacattctgtagagaatccccttccctttccaggtccttttcctaatccaggggagaattaagtaagagcttggcaccttttaaagtctgataagaaacatttacaatttattctggaaggctgctacctggaggcttcatctgcataacaaaaacattggtctccacaaccccttatcttaacccagacactcccttctattgattccaggtctttagatagaccctttcaactaactgccaatcaggaaatctttgaatccacctatgacctggaagccactccccacttcaagatgttccgcctttcctgactgaaccagtacatcatacatgtattgattgatgtcttatgtctccctaaaacatataaaaccaagctgtagcccagccgccttgggcctatgttctcaggacttgctgagtctatgtcacaggcatgtccttaacctcagcaaaataaacttctaaattgattaagtcctgtcacagacactttttggtttacaactcacacatacacccatggaaatccatttggagatgcgtagatacggaaaagacaagcaaggaatattttagttagatgattttcagttttagtgagaaaaggaaaaaaagaggacatcaccattttgatttaagaatcacttcccaagttttcatcctcttggcacttgctaatgagagaatatttaagagatcctaacacaccatttcccaaaacgcatctctcaaaatgctagacttaagaggtgctccatgtgaagatgttcctgccaagtaggtttgagaaatgctgcccttaatatacctctcttggagacaccatctatattagcctttgaagtctctgagaaatatggacgtagaaaagcctgtttaaccttatttcatcacaaaattccacatagtactgatgtttcaaaaactacactttggaaaataccatcatgacatataatttatggtagaaatcagacatatttggaaaataccatcatgacatataatttatggtagaaatcagactaggatctcagaaacttagtgctgaccctctgtactgggggacaaaggacaagaggttgagaacaactggctcctctgtgtctggcctggggtgcttatcaccaactgaccaactgtgtggatttcttgccaatgggtcagactaactactaaaattacttgaaaggagacaggtcaggaagacaaatgtatagttcacttctgtattagagacacaaagacaggtcctggatctatcctttcaagatgatgcaggtcaaggccatactacatacagcatggaagaatctccaagacaaccttacggcaactggcgagatggcataacccaattacacagaagggcccaggaactccttctactttgggtgggcaggtgtatacagttcttttcttcatataactttcttatcttcttcacttgacccattcccttcttcatgaccaatggtcgtgcctttttcatattactgagatagccaagtaaaacgagctccccggagaatctccaacccgcctgcgcattgggaggatgggtgaggcctccggaagtttgcgctgtttgcagtagggaggagcctggccccttctgttcctgtgtgggaacctgggattcagtctgtgagatgggggcctgttaacaggaacctctcttgctttgctgagtctttttcctttttgcccaataaattccataacctctcacccttcaaagtgtctgcttgcctaatcttttctggtcgtgtgacaagaacccagtttattctacaacattacagtcactgactgtgaagtgaaatagaaagggaagtggtggagtggaaagagcccaggtttggacccacaccgacctggcttaatgctgactgtcacttattagctgtgtgatcttgggtgagtaatttcacattgctgagccttagtttccagctttgtagtgagaaattgagataaggtgcactaaacatttggccctgttagatactcaatacctgaagctatggttaatttgtaaacaatattaatactattactgccaacaataatacaaattggactaactggactaatggagatctaacagtttgcccagttttctcctctcactacatagaaattcatctttttttcaaattattatgaagtccaacaagtatttattgaacatctactctgtaacaagtctttattaggctttacggtcacatgataattgggtgttacttttaaatgtctctgagtttagccagggctaccaacaaataaataggtaattccctctttaaatgtaatattaatgagaataataatattgggactagagtgatgtgagagaggcactcacctggggcacaaaactgaagtgggtgccaaaaaacttagttatcaagataaatattttaatgtgatatttaacaaaataaaaataaatgtaaaacatccataatgaacacaacaacaaaattctaaataaagacaagatctgaacttgtacttgaaccactcacctcacttgcttcaccctagttccagccctgatgaggatgatattcactgggtctttactgtgttcctggcagacttaatggggtctggcactcactacttacatgactgaccttgagtaggttacttaaccttgctggacttcagttttcttattagtaaaagagttatagtaatgggatctgccttgtagggttgatgggaggatcaaaggaaatgatttatgtaaaacatttagcagattgcctggcaaaattaggttatcagtaaggattagttactgtgattaagctcagaagggtgagtacctggctcaaggtttcacagatggtgagtggcagagctgggatacaaacacagtaggttaaaataacagctgccccaagcagctaagatacatccagggtgtccttggagcacagaggaaggcactttgcttggctgggaggatcctggaggattgtgaaagactttctgaaagtttgtcagccatcctccttgtcatatgttcctgggtggccatttcaattctatgagttattccaagaaatcgctagaattaagcttcatgaggacaaaggcttggcccacttttgttcacttctgccccttaatacctacaacaatgcctgacatgtagtagaagctcaataaatatttgttgatgaatgaatgagaatgattatcttagaaagctaatcattaaacaaacaaactctttaaacactggtttcacctagatcctaatttttctaggggcttcacagttgccatttggagagagagattgaggtaagtaaacaacacaaaatctattcaggaaaagccctgtcagattcttgcagagtagattctaacatgaaccaaatgggcaacataacaagttgtagaaagtaagaacaccatttccatccaatatctgactcaccttccactaacgattgttatatctgcccatagtatgttcactatagggaacataacatctttgatgcagagtgaaagcatgttccctgtgtgactaactcattgcagaaaacaaatcctttttttctcttttttttgtttttttgagacggagtttcgctcttgttgagtaggctggagtgcaatgtcgcgatcttggctcactggttctgaggcgcaatctgcctcctgggttctcctgggttcaagcgattctctgcctcagcctcccaagtagctgggattacaggcatgcaccaccaggcctggctaattttgtatttttagtagagatggggtttctccatgttggtcaggccagtctcgaactccagacctcaggtcatccacctgcctcggcctcccatagtgctgggattacaggtgtgagccatcgtgctggcccaaattcctttctataaaaaatgcaaatctatgatatgaaaatcaaacagcatcataagaataaattccccaatgatagaaattttaacagctagagttgctggtgtgaaggtcttaaatcaacagaatcaaaatcagtcatagacttcacatcacattagcaacactaggacaaaagggaacatccagtattcctagggaacagtgagaggagccttttcattgggtatatcaaaacgtagcatgctaatttgattcttccttcacagacaaaaggatggctacttcgtgataagttctatttactctgtcgtcccaaggtttgattatgttcttaagagagattaggaatctttctggataataggaatcatgaggaactcatcaacttgtataattttgtcaagaaaaacatgagaggccaggtatagtgggtcacgcctgtaatcccagtgctttggggggccaagggaggaggattgctcaatcccagtagttggagaccagccttagcaacaaagtgggattccgtctctagaaaaaatacaaaaattagctacatgtggaggcacacgcctgtagtcccagctgctagggaggctgaggtgggaggatagattgagcctgggaagtcaaggctgcagtgagctgtgatcacaccactgcactccagcctgggcgacagagtgagacgttgtttcaaaaaagaaaaaaaaggaaaagaaaggtgtagtcactggtggaaccatgtataacacatctggtaatgtatttggtcacatataaaatagccaaagagatattttaaagtttaaaccaaagtacatgtaaattttttttttttttttttttttttttttggagatggagtttcattcttgttgcccaggctggaatgcaatggtgcgatcttggcttactgcaacctctgcctcctgggttcaagtgattctcctgcctcagcctcagcctcctgagtaattgggattacaggtgcctgccaccatgctcagctaatttttttaatttttagtagagatggtgttttgctatgttggccaggctgatcttgaactcctgacctcaggtaatccactcacctcggcctcccagagtgctgggattacaggcatgagccattgtgcctggccacatttaaatttttttaaagttcctgaaaaaaatccttcttgaaagctcaggagatagagttaatcattttcacaaggctacaaaaaggattttgaagtgatgatatggcaagatcatgtaataaatttattgtgcatatttaataaacgtaaaaggtataaaaattacacagtggacatacatagagtttccatctacctccctgcctagaagtaagtctctgccagtcctgttgaggccctgtgcacctcccaactgttgcttctgtcttcttcccactcaccatacaatgaccattttctaaattgtgtataaagcatcatcacatatatccttataattttactaggcaaattttgtataatattgctctatgtgttttaaaagtttatacaaatacggtcatcatagtgtatgtattctctggcaacttgctttttccattcaatgcttgcgagagttacccatgttgttatatataattctaggccattccttcatactgatgtatgctatttccatctattattataccactgtctatttacccatttcctggaagatgaaaatttatatttttctaatatttcttgctattacatacaatgcagctatgaaccaccttgtacatgtttccttgtgaatttgtgtgagttctctctctctgtgtatatgaatatgtacatgtatatgtaaaattgctgggtcatagaatgacttcttttctatgtttgaattttcattatagttatagactggtagggctgtatggaacttttgagaaaaatctcctattaattctctcattttataggtgaggaaactcaaggtgaaggaaggtgaagtgacttgttcaaggtcccagggcagttacagaaagatttattgttgccaataaaaattactaccgtggtatttgccagctgatgatttttccatttccacctttccatgtgtgttaattgaaatcttctataaggaagaacttttccttctgggtagattataagtccccagcctcccggttctgccctctgagataatctttgtaaactatgtgtagcataaacctttgggccagatagcttttcatgttgtaagtgtatggacagtggggccagcagccctcatgctatgtaacagcatcacaggctgctgtaccaaggcaataccaagtatcaaggcagacacagacagggttctttccatcatcaataagggggtgctccaaagaagagctgcagattgcttgtgccaggttggtggttcacagctccaggtgatgtatttctgaccttctccctagtaataatcattacaaagtaacaatgtgaaattcactgtgcttttgggaacaagtttgcctatacagctgttctgttagcatctaaatgtacatgtgtatatagattaaacagagtaaacagcatgaacatatgtgaaactgttagaaacaggggcatttttagaagcatgaggctgctaaaaagaatatttgaaaatccacaaaaatacccaatacccgctggatccagacttctttgtcatgaggaactgtatcattaacttctcacgcagatcatggggaaccttggttttcaaggacaatggcaagtacctcagctagtgaaaagcaacttactggaaaatctcatttataatcagatatgtttttattaggctttcatcctgctcgcctgacatatgtcccactcagaaaaatagcagtctttaaaaaagcatcatttgaacagaacggctaaaattaccttcaaaaataattctaaagattggttaccagtcacccatcaccacattgaaaaactttctggtttgtaatttatctgcaaggcatcttttatttgtaaagtgagaaatcaccatttctgtgaacattttaatcatgaaattttttgcaaatttatgtatctatacatgtacttaggaatatatattctttatctattcatctaactcctttgaatctactgaaagtccataaacattaggaaggttttactgctgaggtggcaaatcatcactgtaactctcctcaatttctttctttttgtttttttatttgagatggagtttcactcttgttgcccaggctggagtgcaatggcgtgatctcggctcaccgcaacctcctcctctcgggttcaagagattctcctgcctcagcctcctgagtagctgggattacaggcatgcaccaccacgcccagctaattttgtatttttagtagagacggggtttctccatgttggtcaggctagtctcgaactcctgacctcaggtgatccacctgccttgttctcccaaagtgctgggattacaggcgtgagccactgtccccggcctgtaactctcctcaattttaactccagagttgtcaggcaggggttgcagggtgcacagatgtgtggatgcggtgagtgggtgcttttggtcttcttacagcttgctcaacaggcaaatcatacatctgcaattaattgttacatgcagattctagagagatttctggactttctttgcatacaaacattgaagaggaatagaaaattaatatacagatgttaactccagttattatgactaaagaaaaaaagtgttctatttaattttgaagtgaactttctccctgcttcagactagcactgataatacaagggcctgccaagaacctgagtgaatgacttgtttgatgctgtgcttttgttgatggcacaaataaaaccggcaaaatgcaggaagtagagataagaattactctagatgttgaaaatggcagaagattagagaccacaaggccccagcagtcagttcattcaaaccacaatcaccaggcaaagaagctgtgtaagccatggctagaaggagcgcactccagctgctcctgcattcacttccacacagcccttcgctgctagatgttgctgccttctctcttccccactgggctctgagtccctgaaggtaagaaccgtgtcctatctgcttgtacattaccagcaactagcacagtgcctggcacaaagaaaccattaagaagtgctatttggctacatttctcattttttagtcagttttgatatcatatggatggggatatggaatgagtatatggaaaaattctttgaaatatgtcaagaattaccaaaatatttcctccatcaacctactacaggggctgctgacctaatgttataataatatataatttcaatgagttaagtcatcaggctctgttaaaatataataatgtttgggatagagtaatggcttaagttttgtcagtcattaacaccttattactaatcagtttactttcatcctttccagtatggggttggttgagcgcaggcaactgtggaagttgaggacactgaacatagctggcttttaataaacttttgttgaatgatgaatgaatgtttgcctagcagtagaaacatttgttgagttcccactgtaatttttttaaatgaattgtctagatattaatctaatttttaaaagaattggtcaaactatcacattgaacaatttaaaatagtttagtgcatttttctgtcatcatcagatgctttcgagaaatgctatttactgcatccctttcgagagacaaatacaaagaaaccatcagactgggcattttccataattgctgatgagtgtagatcacaaagagaggtggcaaattttcaatttgaagataagtctgattaatttaggaagccgatcttaaaagcattgagcacccaagtggatttatctgaattattggaaaattatttgcttaaatcatgctctgaggcattgtgtcatggagaactgatcacagacaacttagtgactttggacaaattactcaacctctataagcccagttttccctatttatcagatggggctaacaatatctaccttgcacattgatatgataattcagtatcaaaaagttattttgagaactcattatgtcaggcagtgtgtcaggttttgtgggttccaagagtgagctaaagagtaaggtgtctgcattcatagagcttccatttcagtgctgatacaggaagatactgtaatgcctagaatggtgctgggcatggagcaggcacctagaggatgagatatagcgttatgtaatcacaacctgttgaggatcagtgctaaactgtttattgctacccaatagcaacaacccctgtgactgtattaaagctacagaattttcaacccctggtgcaccaacttagctcaacttcacacaagaagcctctaattgcagtcttagccccaccagactgggtccgagtatcactgacttggagcctccacatccaccctgcactcccagtggtggggcctggcattagctgaattgctaacacttagcatgctaacacaaagtgtgtttggaactagctttagacatttgcatcctcaaatttctgctgtttctaatgcccaaatgtttcctggattggccccagtttccccttgagtactcttggactgctatataactgcagagtaactaagaacattttggagtccaactacttggttcaaattccagatatactatttaatattgtgagcaatttactgaatcactccaaacctcagtttcctcatgtgtactgtggggttaatgagaaaagaaaaaacagctcagagcagtctgagctccttgaaggcccagagagtaatgagtatgggacttcagtcacgctccccactcccctaacccatgcttgggggccactgttgaaagtcattttgtttctgactagctacctcacccactatcttcatgttcctagaatttgtgatacaagagacaatgtaacaaagccaatcaatagcttatgttatgttaatgtaaattcttggtaaacaatgtagaaaatacctttcctttccttttgaaaatccacttgtaactgctgctaattggactgtatatttaaggcaacttgaatccatgctccggggttgcagtcctcaatcttggctcaaataaactctctacttatattaattttgccacagtttctttcttttaggttgacattaataatagtacctattttaataggactgctttcactgttgaatggcataatgtatatataaaggtcctaagtaagcactcaaaaagtattagttgttgtttttattactaatagtggaaggtgcataggtcatctttgttgatttacatgcagataaatagtacagggcatttgtatcatccctttgaagttataacatttgtaattttagatctctctgcccactccaacaagcatcatcttttatggtgcatgttttattaagttttctggctgagtgattcctttttttataaggtactttacattgtcaaagctctttcataaaattaatctcttttcactgccacaaggatcctaggagattagaatgggtgatatgcctatacccctgttgctgacaaggaaactgaggcaaagagagatccgactctcaaagctggtgaaattactacttaattatcaaatccttattcactgcagggactcagaaacaggcacagaaatcatttcagaaagttgctcagcagtaactggaaaacgttttcagtgagttggaaaatcagagtgaatcattaacccccaggctcaggttgtgaaacttagaaattcacattaaggattttgtttgtttttgtattttaatcttgtgaattctgctttcatatgccatttgaatgacatagaatcccaaggacacacaaggtctttagaaattaaagtcataagtttttgtggatgttttgaaagcctttccacatttccatgaatctcatatatttttttccttttagagcatggcaagaaatcttgcctctaggaatgagtcagaaacctgtctccaaaaggcagggctctaccctgcccagcctggccctttcctagagtgactttctccctctaggggaggaaagcagtgagcttcctttttggtttcttcaactgtatcatgacttttaggttgagtagtcagggcagaagaaccaacaataatccagacttccagaaactaattgtacggggagcctaatatcctcttggctcacccacccctctcctgccattgctgctacacgcagtgcctcagcggtcctgcggatcacatactttctgccctggcacttcacacatgacttcatgtgtgagaacagggatgagacagctgcaggaatgcccagtcatcaggcacacacaacatggaagtacatgagagttaacatcccacagatcaacatttggttgatgaggatggtgggtggcggacaattttgaagtgcgatatatgagacttctcagatggtccctgcaggatcaagactggctgaccatagtggagaacaacaaagaaatgtgtccttcctttcactggcttccctccttccccatttcactgtcccagcccctcactcttattcttggtgtcatttccaaaactaaactacctgaatgcaagcctttatctccaactttgctttgggagaggacacaggggcctcaagctagtgtttaaactgattacagaacacctggaaagagtcaacattatcacataatatatccccaattaaaatgacaatgatttcttgattcttccattagagagggaagcatggtgattgaagaaaaagccctgaaagaggaggtgtgggttccagttttaccaataatgagttatgtgacctaagctacgctatttaaccatttggacctctgtgcctgatcagcaaaaaaggagatgaattggattgcatcatttctaagatccttccgattccacaattgcacatttattaaataaaaacatcggggcgacagtttgtagtagctgctttccctctcattataactctagggattgttctggctaaaaatatggcaatattttaatgcaactttagacaggcaagtgaatcaatcctctgaaagtctagattagagaatgggcagctattcagaacctcaaaaaacaataatgctgatgaaaagagaacaagccagcttctttgggagtcagcaaacattagcaggggctgcagcattaagataagaacagagtaatgagaaaacgagttgcaaccaacttcgttgactgcatgccagtggtcactcagtgattcgtcaaatccctaacagagcttgataaatggactctgagtgttgatatttttttttctctctttagaagttacttggaaagatggcttgggaaaattcttctactttgaggaaaataacacaagatcctgcaagtgtcagggacaggcaataaaacattaaaaggatacagactttccataaatcccaaatcaaggagcattaatccagaaaatagatgaaagatcatgatatttaagtcaaccaaagggccacaaaacatgcaaaataaataggttataaagcaaatgaggttgtagatgtcaccatttctaagacatgacataggtactgttatctccattttatacttgaaagaaaggctcagagaagtaaataatttatctgatgacacacagctaattagtggcagagctgggattttaatttttaagtatatattttaaactaattaaaattatatttatcaaagtaatacatgaacatagttaacaaatcaaatagtactaaaagagatacaatgaaatatagcagtgttttctattttgctggcttttgtccttggcctgtgtttcctaatgctttcatttgattttttttattttggctatcatgttcttaatttttgaaagtgccttctttttcatagttgctcctactactatttttaaaaagcatcctgttcttgtttcatggatgcaatatcttagctctctgagaattctaacaacagtttttagttttgttttcttcctctccctgttttctctgaatttcattttttttttctgtttgtttggcctctgtctttcctatcggatgctgaaaaaatgttctgtgattcttggttttctgcatgtaatagtaaggtattaaaaagctaaatgggagttgtgtgtggggggggaggggtataattgctagataaaataatttgtttccgttaaaaataattattttaaaaatattttattgatacataatatttatacatatttattgggtacatatgacattttgttacatgcacagaatgtgccatgatcaagtaagggtatttaggatatctgtcaccttgaatatttatcatttctatttgttaggaacatttcaagtcctctcttgtagctattctgaaatatacaaaaaataatttttagtataaatatgtcccaaatgtttcatgggacatctaactatctattctaaaaaagtatttattgtttatctgaaatttaaatgtaactggactttctgtacttctacttgctaaatctgacaaccctgggtgtatggcttatagactcctagcttctaagtgcttggctatggcctacaggttttcaatccagagactggttccacttaacttaatctcttcttctgagcactgtatctcattcccaccctgtgcctctcctcagttcagagctcttcattttatttctccagaggatacatttctggccttctaaaggtagaataaggggagtgacctggctgtgttagtagaggacttcctgggtgctaagcattctatatactgattttctagcaatctctttgagcttttcgtgtcttaagctttgaacatcccttacaattgaacctaattctaactgatgcaatgccacagtgcttttcaaagggagtcatttcaaagcgaatggcacaagacttcctagaaaaagtgacagaagagacagatcttaaaggatggtcagtcaggaagatggcgagtggaggaacaggattcgatgtgggaatggtgatacatcagggcacagggggcattacacagggtgttccaaagggtaatgcgtagactagtctggttgacgtagaccaatcatgtaggggagaagtggaaggtaagaatgaaaaaaggttgggggcagattatagagggccttgaaagtcaaaccaagtttagaacttcctttgaaagcaatgtggacactgaaggtttttgagatggaagctggaggtctacagtgtgaggaagtttggagtgaagaatttcagagtcttctacacacaggtcataacataaatataggtaacatagaaatgaggccaggggagtggtctgagtagagaaagaagaacatgtttcaagagcttatacacaggagcaaggagaaaagaaacctgccaaggatctagaaaagaagagagaaaggcagctggagattgggcaagcaaggagagtagaaattaataataactaactaaaccttcagatatctcagagaagatggaaactatcaaaaatgagtacaggccattgaatttgaggaaagaaatgtctctggtgacctctgagtgtacaattttgatagagtgcggagatggactctgctcttcacggtgtaaatgggtgttaggaaaatagaggtactaaatgtgctctgtttatttaaaaaggtagacagtaaaagaaaggtaaataaaaaagcaattaaagatctccatggggtcaaatgaaaaatttttttaagggagtgacaggctttggtctttaagataggagaaaattgtgcaaatgagtggtggaagaaatttccaggctgctaagagagatggcgcctgatagagcaggtcccactggaaatgggagggtgcaatttccagcttagagaaaggcctgaactttggtgaaaaggagagaaagcccttctaagaaagagatagaaaagaatcaaggaatgaactgttgcattgctagttaattttccatcactgaatatttttcatcttcgttatcaatgccattatacagctgaccagaagttaacagtcttaaatagcaatattagctaggatctaagataaaaatggccatcacttagtttcagagttgtgtgtcaaacaagctcataaaacagaagaaaaatagaaatcttgtgactgtagtcctgactctcttggcttatacacaccactttaatggacttcatttatatcagagagaaacaacaacaaaaaaagtttagctggtttacacattgatatcaatgctagaataacaggtaacctccagtgtagacctggagattagttacaggatggaacttccatttgtcaaacagatcaaatgccaatacctactcaaagtacagcgtgaggtctgttgccaatattgactgcttcaaaagctgcataaggtcactatattccttggaggacaggttagcaaagatattgtgaccctgtaatgagaaagtaaaaagtcacaaaagacattaaatctgtggttgttgattacatgtttttcctctatttaaaaaaaagtctgggaacattaaaaaaatcactttttaaaaagcatagtgaaattttgtataaatataaacagattctctggcaaacctagcaaagccagaatgcagtcatttttgacaaagtctaacaagggacactttgttacatgcttagtctcaaagggaaaatctgaaattgttggaacttatcttactatgaatatgttgtgcccacaattccatctgactacccatttcctatggaattacttagaggagaagtttgtgaaacatttgggaacatttctccccctaaaataaatgctattttcactaccagtgaaggtttaagctggcattttggaaacacttgctatggcaacaaatgactttaagaagaataaaaagccattagaacagtggttctcagctgggggccgttttgacaatggggaactttagcaaggtctagtgacatttttgattgtcacaaatggctaaggtgctactggcatctagcagtggaggccagggatgctgctacacatcccatgatgcacaggagacccccacaacaaagatttactggcccaacacgtcactgctgctgaagcggaggaaccgtgcctcccaccattaaggtgcactttgatgaagtgtgtggcaggctaaattcagtatggtgaatatgaataattctgaatagctaggatgcataagacatcgttcttggcacagtgggactctaaaatgacgtttacctaagtaaagttaggatgacatctttatcctcatacctttgacaggtacccttgttttcatcaaaatttgtgttagctacacttaggctaaaatatttgtctttagtaaagtgaaaaatccttctgtaaagtgaccaacaattcacttagtttgtttttaaagtcaggacttttcattttttaggttttcttagtgtgaaatatgaactcatgagcatctggcctgggaactggaccagttttaaatctcgtgttgagagccggaagatgctggagaaggaatgtggtggaatgactgcctgagaatgaaccattctccagtgagaggtaaattaattatttcagggaactaggatatcaactagcaaattacgtcttaccaggcaccagatgattatctgtttccccaagttaatttatttcattgggtgaacccgccactccttaaagactagagtatattggttctacctgggaccaggtccaatattaataataattttcaaatgagctcttcagacccttaattcagctgttaagaagaagacaaataacgaaaggaatgctgcaccataattctgcccaggtttttttgcctgtgcattacccaatgatcaatcacaggcaggtgttctggggccagagaaaaagtggtaggaagctatggaaaagcagtcacctgggtccagcgatgcacccagaatctcccaaagaaacacagcatttaagagcaagttacagtaaaagttaacattgagatatgaagaaatctggtctgaatttgaggatgtggattattttatgaggatgtgtgttttattacagtcatgcatcacataacaggagggtacattccaagaaatacattgttaggtgatctcctcattgtgtgaacatcacagaaagcacttacacaaaactagatgatacagcctactgcatacctaggctatatgggatagcctattgcttctaggctatacatccatacatcatattactgtctgtaacactgtgagcaactgtaacgcaatggttggtatttgtatatctaaacctatttaaacatagaaaaggtacagtaaaaatatggcattataatcttatgggaccaccgtcgcaccaatgtggtctcttgttgatcaaaacatgttgcatgtgactgtactttgaaggatatataatcactaatgctatttacagctaagagtgacagtgctagccagaaaaagttaatttgcaatcagtttattgtttatatgcaaattagtcttctattttcacgttatgtgccttaacgttttggtccctgaagtagatttgagtctccctgaaatactgcatctactctttgtttagggaggtggtgagtgtggtgttaatggaaagacatgcagatctggaggaagaaaggtctgggcaaacttcctcaagctatctaacttctctgcaccagagctcatttggaaagtggaacaataatagcacctgcatttctgcctttctgatgggcaggaccacaggggactggaggcagtgctgggacagtgcatggttccgtcattgatagtctctgttcttcatagggaaccccagagtgaaggacggccaatgtgttttgtttgcatgaacacaaattctgagtgagtggggtttgtttccctgaggaaacctgacatcctgtttataatacttgttattacaaaggtggtggtttgtcagaggtgtatactcatcacctttaccaacacagaaaagatagtttgaaccaaagttcttccatagttctcagctaagacactgtttttggagggcaattccacagccacagaggccaggatgctggcttctgccagttactgagagcctaactcttggtgtttaattcccaactgaaaatacatcattcccagcaggttttccctttcgcagtctgcattcaggttctggagtgccaactctcctttatggggtcgaaggcctccatgatattgcaaaagacatgctttctcaagataggctggaggtaaaaaacctccatatttaatgatgctattctagtgaagcagggccttaatgatgataataataataataattaatggcacagctagagaactgacaaataatggggaacagatgatcccttcctggcctcaaaaaaaaaaaaaaaagtctgtacgcttgcagaaaatgaaacagatcctttcctggcaatttaaaactcagatgccgcagccagactcagttagtggtttctgtttttctctgtggagagctaaaagtataaaattccaactacttctaactcctgcattgccacatgaagcaaaatcaggcatatggcattagctctgggtcttaagtttagctgcagttctcacttcctaactggtcccaccagcaattttaagttcttttaagttgtatagtttctcaattgtgctaatgaagtgtaactttctcactctgtttttgcttctaccatcttttaaaatgactgagagttttaccaaatgggaatgttgggccgctcattatttggatcaagttgttcccttagtgctctgtatcctttgaggaaggtcaggtcatgctctggtgacaagcagtctatatctgttaccctgctaagtgaatctgaaaagcctcctaaccaataatgaaatccaagtaaatcagctcaggaagactctgcaaggtcctgctcaggcatctataggaacagaaaaagctactaaggcccattaagttgacttagaaatggttttcccactgctttgtgtctacctgtggcaccacaaaggaagagagggaggaaacaaagagttgttttggtttctgttaaggggagaagcagaacatcaggcctgtacctcactttgaaggatcatcacggcgtggttgaaatggtgatgctccaaggtagcagaggttccatagagttgggccagggcagagccactcctgaaagaggacagagggtgagtgagcagggcctatcgatggttcccccacaccagctttttggatcaaactgcttttcttgcttttggcaaaggaccatgagcagacacatccttaggtaactgcttttgtagtccattcatctatgaaataaatcgttcaggaactttctatatataagaaagttcctaatacatagaactttctatgtattaggctagatgctgcaaatgatatttgatgaatttgacacagtctctgcccctaagaaatttacagactagtaagaaagatgagatgagataacaaggaaaaataatgcacataaaaacaatgcaaatactaatcactgtagaaatgtgttccaggtccaatcgaagtgctatggacgttctgaggaaaaaaagacataatttctggctccggggatcagggaagcttcatgaactaaaccttctgtgacttctgagtgttcagaacaactgtcttatacaaaacgtatttgaccttccataggagaagaccttgtgaatattctgcagagtgcattttatctactctacatgaaaggctgacagccttctactacagctttccagtccatagtcacactgtgatatctcagtgtggaactctgaaaagttctctggatttggagggaaatctcagctcttcctccaagtagtagctttggacggttacttggcctttttaagactcagtttctttgtctctaagattatattatctacctaacctgttatttatgagaacaataaaatatttgaaaatgcctattacagttcccagcatgtagtagattgtagtctgtattaattattaatcaataattgaaacacatatgactatttccattttaaattagttaaatactcattgatacttaaagggattactttgagttatctgtaaatttcatttatgtagaacaacccattccttaacaatgtcagttctgcaaagcgttcattacttgggagtctgaggcaggagaatcactcgaaactgggaagcagaggttgcagtgagctgagaccatgccattgcaccccagcctgggcgacagagtgagactccgtctcaaaaaaaaaaaaaaagttcaaaaaggttcgtgtccaactctgtttaagaaatgggagttagagcatcttaagaatcaagagacatcccagagaagcccacagtgtaaacggcagccatgggactcaggataaggatccatctagatcattttgttctttcttgcttattgcagggggcttcgatattgaaagggcaatttggccttaacttggaaatgctggagattgattgcatacaatctgtcctgctagtgagagaagcaaggactgcatctaagtgcaacatgaagacttttggtcccaagctttcctccaacttcagtgggaggcagcccaaaaccaccgtcggttcaagaatacaagtgacctgcaattcttggaaagactcccccaattcttctcccaatatgtggtcagcttttccagcaggattaggttcggtaggaattattgaatataatataatataatgtaaaatatcggaattatttttcttaggtgcttagtaaggagggtattagattttaatcatatatgtgttatttctttaaatcttgccttaatttatattatttaataagtgaagatttgctaggcgaatcttagtgataaattaatacttaatgttagttactatttgtcttacatagagttcatttctatgaagacacgtgtttcaaaacgtatactatatgcctttgtcttggctgttgaaattctgtgatgctttatatgcatatcacatcctagagcctggcatagagtaagtgctttaaaaaatattggttgcttgtctaataagcttacagtagttactatgtcgagagattacagttcaagttgggaggttgataataagtgtgttagcatattttataatactaatattattattaataaagctaccattagtatctaccatgcggtagtctatatattaacaacttaatacattatagcatttagtcctgacaatgaccatgatataagtattattttctcatttacacatgaggaaaacagggctcagagaagttaagtaacttttccaaggtcacacagctagcttgtaccagttccagatttgaatccaagtttttaagcttcttgttacataatgaaaatgataattataacatacatttctgacatttgattctccatttttactaagctgattgttatcaatgaaagaagatttcaaaatctaattcagaattctattagtatcattgctaaccacaggctgattcctgtgatcattcctatgaatcagccatgctcacatgcacctcacttactagtgtgaatcttttgtatctagtcaagatacaaaatgttatctcttcccttattcatgttgggttaacagactccacaaaagctgcatcagctagatgatcagaagtcactctgtatcttctttgttttggtgaataaggaatgttttctcctttaagggagtggggatggggacgataacaacagcttttaacaaatacaccatggcttctgaggcactgctccttcctgtgcgtaggatggaggcctctctcccatatccatatgtctccgatctggtgtgttctatctcccagtatttgtgcaaaggcagccactgtctatggtttgaccatcttcctcgtcagattccctctttgttctcttttgtaattccatcttactttctgcccagcctcacacaatactgattcaatcacagaaaataggtagattttgccactgaaccagactaatgccatgaaagtgtggggagactttgttattcattcattcatctatcattcattcaaccaataagcattgataactattatgtcaggccccaggcatgtggaatacaaagagaaataagacatgttctgaccttcaggaagctcacaatcccctataattgtgtcaggaatttttctctgatcaaccttgcactaaaaatgctcacttttctgcaaacaaggtgccatcttagccctcagagaatggagcatggtactaactcaactttgaggggtttttttaaagtaaaaccatctaagcaagaatacttccatttccaaatggatcccttatttacactattagatttggcccctggcagattttctagactgccaaagccctcagtgccttttgtctcaggccaaggcccattaggaatgctgcctgtatctgctgttacacactgggaacttcctgggaccaccaagagccaagtctacagtcttgatataagtggcaaaaaaaataaataaataaaacatatctgtgaagataagctttatcaaaaagtattctacagaatactagttcttctgaatgttaaatggcattaagagaagaagtaaaaagggttccgtggccaaataagtttggaaaatgctggctttaaaaagtgaatctgtttatttatggtaaggattttccagaggcggcaatatgtgaaaatgcattgtgattttgtgggaggggaacataacaagcagcattatctacttttaattgattgtgaaacctctttttttttgagacggaatctcgcctgtcacccaggctggagtgcaatggcgcgatgttggcttactgcaacctccacctcctgggttcaagcgactctcttgcctcagcctcccaagtagctgggattacagacatgcaccaccacgcttagctaattttttgtatctttagtaaaggcaaagtttcaccatgttggccaggctggtctcgaactcctgaccttgtgatctgcccgcctcggcctcccaaagtgatgggattataggcatgagccactgtgcctggctgattgtaaaaccatttttaaagaggtcatgtctctcacataatacacttccacttataaaggtatgcttctactttctcacataaaatatgaaaaaaaaaccctgagatcaatcacatatggaaaaaattgactttaacagcacacctcattttaattgtttgtgctaagtatatccatcatataagtgtctttggggcacacatcctttagttgtgaaaatatgattatatatacatagggtgtatggagagaggaagagaagagaatccaaattccataagtacaaatacctttatacatgtaagtattcatgatgtgcattattgatggtaggtcatcttaacatactaaagcttttcattttggataggcagctcaatgaggagaaacttattaaaaagaaaagtcaaggtggaaatttccctataggcatttggcactttgcacaggcaccaaaaatgtgtgcaaatgtaaatgtaccttcataacttccctagatatgcatattctttgaaaaagagactgaatggcagtgtgcagctgtgacttaaaggaaactttaaaaaggaaaactatgaaaggtaattaggaaattgagagttgttgggagatggtgaggaatgggattaggctgtcatggcagattaatgtgccccagtatttcacttctgggacctggccgaaagcgacaagatgggttttcattcccaagaaatgagtataagagattatgctagaaatgaatagaagaagtctcctaggagaatatactacaaagctgcttggtactgatatttaatcatcaggggcagctgtaatagagagaaggatgagtggggaacgctgtccctagagaaaacaggggagaggtgtgaacagagcaatttcaaagcactgtggtattgctgccctctctacctattgatcattcattgtatgcactccaatacttaaaaattaagaacaaaatatgaaaatgcgaaggatcacttgtcagaaaggctaagagaataaatcaaattgtgctctaacgaaagccacactttttattgtagaggcattttgcattttatatagtaatttgtcccttgctaaatgtctcctgtttttttatagccttatatatgaaaaaaaggtagcatatactttgctgcataataattggtgcatttaaatcccattttcaaatcacttcaaagactagaattcgactgggagcactttaagagaagggatgtttgctatatctctttatttctcccacaattcctagcacagcatcttgaatatagaaaatactcacttactgggaaataaaaaacaagaaaagaagataggtttcttgcaagggattttctcaacaatggcacactcactgaataaatctcattctaatcaataaaaaggtagttccttgaccatgatgctaaaaagcctctttcagcattcatcgtcaagggaaatcttaacggaggttgggtaatggtggcattaagtgtcctaagtgcaaaaatgactccataaggtaggtgcagtgcccctgacatcccatgagctgataaactgcgtacaaagttaattgtcttgagaaaaacgcatcacactaccttggaataggcagatttgatcatgtgatgtgaggatgcaaaaaaactctctgaaatctagtactagtgactcaatacctacctcatatgtgtgaatgttgttcagtcttatacaagcaacctgagatttggggacctcggtttttgtttttttttgtaaaattgaggaagtgtaaaacatagctagtaaggtttactttggttttataatttttatggcttcatgtctttgaactgttggatgtcaaaatatattttagttcaagagctcacatatctggaaaggcagccaataaactggaagctcaacaactcaaaatagatgtcacaaagtcatggaccagagtgtgatacagtggttaaagaatggcttctgaaaacagacagccctggtccaggctccagtctaccacatgaatggatttgggcaagtttacttaccttcctgaggctcagttcctcctgtaaaatggagacaagaatatcaactctaaagagttgatgttggtaagggcttaagacacagtaaacaataaataaactgtagttcttctcattgtctcaggaagtgttagttgcaaagaacagaagtggagtacaaccagcttcactaaaaggaaggctgattgaatgataccaggaactctgaagtagcccaattttcacaagcatggctgggtctcctagaaataggaacaaggatggagagagccaggcatcaagcctgtcttttttctgtctttctctcaggttacacagtctctccgttctgcttctctttgaatatcagctccatccttctctcctctttgtagactggttttcttgtttttttcatccgcttggtatgtggtcatcatagcttttcccaaatggcagcctcagctcccaaatctgcatgagcctgcagcttggatccctgcagctaactgtcttaatatcacggtaatccaactccaaattcctgtgagataaaatccgatcggtccagctttgattaggtgtgcactgttggtcccaacagctgagggatcaactagcaagaagagcagcctctgtcagcgccatacaccagctctctctctggggaggggccattggtatctgagtataagtattgggcacttcactcttgaaagtactgaaaaggctctgactcttgttttacagacacaattctaacacagttatcccatctttctgcataagtggtagagtggtagggggctggagagagcatgctagagggagatacagtgatgatgataccattggcctgggggagagaggaatcctaaaaaagtaatgcagtgcagacacaagaactccaaacaaggagcaatcggaccctacaatgaaagcatacacaacgtacacaatgggctccagctgtttagtgcagcatcaagacaatgtataaaacaatgtttcattgcagctctattcacaatagcaaagacatggaatcctaaatgcccatcaatgacatttgattgaattttaaaaaatgtggtatatatacaccctggaacactatggaacactatgcacccataaaaaagaatgaggtcatgtcttttgcaggaacatggacagaactgaaggctattatccttagcaaactaatgcaggaacagaaaaccaaacgctacatgttctcaattacaagtgggagctaaatgatgagaacttatgaacacaaagaagaaaacaatagatactggggtctgtttgaggcaggagggagaagagcagaaaaggtaactatcaggtactgggcttaatacctgggtaatgaaataatatatatttaacaaacccccgttacacatggttacctatgtaacaaaccttcacatgtacccccaaacctaaaataaaagttaaaaacaaacaagcaatgttttataataatttataagaggttgcatctgttaaagaaatcaggaaactttgttaaagtgctgtagttaaagatatctcatccactcatgcagttatcctttgttcattcaccaaacatttattgtttattatgctcccccaagtactgtccatgcactgttgtacatgccaaataagaagggaagacacatctgcaagtcagcaattaaaatggcatgaagtgcacactttggaaaaggcacaaccagggcataggaaattgaccatgggggtacattagggtggatagaaacacgaaggtgatgctttcagaggagttttggggaaagaaggagagaagggcatgccaggcaggggaaacagcatattgggcagcagagagatgtgactgagcaggaccccaccagtgcttcttggagtccctgtgtctggaacatagatgcatgagtagggtgagctgcggcgagtgggcactgggccagggaaatgggcaggagtccgaatgaaaagggcccgaaggggctaagctaaggaactggaacactattctaaaagccacaggagatgtggatggcttttaagcaggggagtgacctggtcagctttgtgaattagaaagattattctggagtgccaagcagcctcgggaggagagtcgtgctgttcgttgtagcaaaccaggagtcatgccaagaagcagtccttgctgtaagcatgcagaggaggcactggctttgaggggagctgcagggtaggctgggtgactggcgcatttttggtggggccattccttggggtagagaatacaagaaagaggcatggagggaaagactgaggttgaggggactgtaggactttgaagaggaggtcttcctcaagcaatggaataagtgcctggagataagctgggaattatggttcaaagaaatgtattcagggctcatcagcagatggctggtggccctgcctgaaggatcgtgaagagtgagagaggaagagggagggcatcatcagtgaaggctggggcagagggacagaggcctgaaaccaacggagattcaaggttgtacaggtggatgaaaaccctttgtctgtgagataaaggaagagagagtttcaggaaggagggagcgacaaagtatatctcatggcaagaggtattatgaaagaaggacaacgaaaaggtccgacagctttgagaaaagggggccacgggtgtcattcctgaggtggtttctccaatgattggaaccggaagccatgtgggaggacaggggttgggagaagggaaggaagtgaacccagacagctttccatgaagcttgactgggaaggaaagaaggaaatagaactgaagctggagagtgaagtggggattagggtaggcttttttcaagatgcgggggagctgtttctattaataggatgcagacagccagcagaaagggacagcagatacaggagggagaggaagattgatggcacaaagtcccagaggagaagcaaggaagggtccaaggcagaggtggagggattagcctcggacgagggaaggacagccctcttaccgagataggagggaaggagggaaggatggggatggacagataagtttgtaggtggcaggggaggaaattgagagaattctcgattgatggcctcaattttctccgtgaagtaggaggcaaggtgatctgctgagtggtgcgggggaggcgggggagcaggaggtggttttggaagacacaagtttggtatatgaaactgctaagagcaatggggaatggggctggctagggacacagaaagactggcagcgagttctagcgtccagccaagtgggaggaatatatatttggtatgtctctaactctcacaactgtgacattttctcctaaagcttttataagtctaggcagagtagcaagagactgaattgttagactgaaccaggactgagtttctgcagagtggatgtcacagagacttggtcaggaaatgataggatattgagaagagagcactgaagtgatgggctataggatacagattggacagagggcacaaaattgaaattcatctgctagatcaggagtaaatacaagagtccaagactcctgaagtcttagtgggtagatgtttggaggaaaaaagagaatgatgagctgaaaagaacctgttgacaaagagcagactgtgaaagtttcagataatagaggctgacttgttctagaggctgtgaaatcagtcatctgaagttaatcttacctcttcgttgaggccttctctactttccctaccccaaaacttttctctccagcctctgaaagcctctgtcttttgtttgcaggcagacagtgaaagaaacattaacggcagactctcaatatacaagtcaggagacctgggttttggtcttatttctagcacccataagttctgtggccttggccacagtatgagccacaaagcaacagctatcttgaccaggaaaacctgcttagggacagattattctatctatacacatcatgtgtgtggcaaatagttgcccagacatccctgtatttctgtaattcctttgtttcttccacctttctatgggagtagggaatgggaggagcaaaaactatattccttgaacgtggctttattttactatagtttatataatacccaacatcaaaagaatcctggaagagactctgttggagaaggaaaactatattttgcttcatcaaatttcctaagactgcttttattttaacagtctcacaccagagtttgagagtagcaagtccaagaagcttataacgccataaaggcaaatattctgggaggaaaaaagtagaccctttaaaatccaagctttgttatctgagtaaggtcaacagagaccgaccaaatcaacaagcatgacatgaagggcaaatctgcaattaaaagaagaatagggaattataaagatggatgggccccatgacatgcacgcccaagcctgcatggccttggcctcggatgccagaaattaatgctttactctttagcattcgtcacctttggctctgaacagaaaggcaaatgcattaaaataacaacagtttagaacacttacttagcttggaaggcattgttggttcccctgtggtcgaggtcatgacacaggcatcccacaatcaccgctaaaatttccacctcggtcagaatgtcttgaaacccagcagtctgggaagaaggggaaaatggcaacagtcactactggggtacggaggatggataaggttaggtgctgagcaacagtcaactctgttttcatacccacatcatttaaggagatgattaactgccactccctcagacaacagtaagttgggtggtcagttgcacagcctaaggtccccacagtgatgaattagcttgctgtcacagcagcccacgctgccacactgggacatagttcagactattttgttccctttttagagagaaggttggactatccagagacagtgacagtttagcaaaggcccagggcaaaatgtgttttgttattatacattttaatgatgagcatagggtttggaggttggaggttggggaataggaaggggcagtgaattgcaaagtgaacactacacctgccagatcccacccaaatgagagcaggcagaaggagaacacaacccttctttttttttttttttttaacattaaaaggagacactttaacatactcaaattgttatacaatgacatcctagaggttatcttgtaaataccctaattcatattaggttggtagacagatgaaattcatacagataataaggcagtgcatgtcatggacaccagaatttgtcagaggattgtcaacccagactgaggattgagtggggtatccattactgggaattcttttttcttatcttgtggtagcttgctggtgaaatgcacagctgtgatgtgatttcttttagaagcaggttgacataattatgtaatcaacagcagcaatgcttcttgggttgctgctggccctttcattagtttagaagaggaagtggacctctgggaatgcaggtctatgcattttcttgatcgaaggcctttatatctccccctcttttactttgtaagtctcccatttcattacttattaaaatctttatcagagagtgggaggagggggaggattagggtacaaattgcttcacttttcatgtgtttttttccaccaaatctaggatcactggcccacacctgtaagacacttctcttagtaaaatgaaaattttgtttttaaattggttatgtttgtgttgcagaaataactgaataacaggtttctgtgttgacaattttattttttttttaggagacagtcttgttctatcacccaggctggagtgcaatggcaccatctcggcttactgcaacctctgcctcctgggttcaagtgattctcctgcctcagcttccccagtagctgggattacaggcacccaccaccacgcccagctaatttttgcatttttagtagagatggggtttcaccatattagtgaggctgggctcgaactcctgacatcaggtgatccacccatctcggcctctcaaaatgctgggattataggtgtgagcctccacgcctggctgacaattttattttaataaatagacttgggtccactgctacatttagaaatacatataacttcatttgtatagcaaatgggaatgttaataaattgggagtatgaaatagtccatgtcaaagcttgcatatgccggccaggcacggtggctcaaaattgtaatcccagcactttgggaggccgaggtgggtagatcaactgaggtcaggaattcgagaccagcctgatgaacatggcaaaaccccatctttactgaaaatacaaaaattagcctcgcttggtggcacgcgcctgtaatcccagctattcgtgaggctgaggcaggagaatcgcttgaaccgggagacagaggttgcagtgagcctgtatggcaccactgcactccagtctgagcgacagagcaagactccatctcaaacaaacaaacaaacaaacaaaaaagcttgtatatgcccttcattttaaaatctgcagttggctgttagtttttctaagttaattttattttacttaaattattacctgcagtaactaaaaaaattcaaattatactgagacttagaactaaaaatcagtagtccctcattattctcctttcttgattcctgaaggcaactactttctattttctttttcacctaaattcgtagttttcccaccatatttcttttcttttttcttttttttttttttttttttttttgagacggagtctctctctgtcgcccaggctggagtgcagtggcgcgatcttggctaactgcaagctccgcttcccaggttcatgccattctcctgcctcagcctcctgagtagctgggactacaggtgcccgccaccacgcccagctaattttttgtatttttagtagagatggggtttcactgtgttagccaggatggtctcgatctactgaccttgtgatccacctgcctcagcctcccaaagtgctgggattacaggcgtgagccactacgcccagccccccactatatttctatatagcatgcacatattattagcacttggttattcaccaagtactcatattgtcctttctatgtaccatacattgttctaagagctttacagccatttaacttatggagttctcataacagtcctgttaggtagaaactattactgtccccagttatagatgagaaaactgagtcacagagaggctaagtcatatgcccagggtctcccagctagtgcatagcagaagggagcaagctcctagcatcctttcaccagaatctgcccttgaacactggcgacgtctagcagcgggtgagtttatggtcaccctcccctcacactcccaatgtgatccacagagctttcctatattaccatcctataaatatcattcaccgctgagccaaccagtatacaatgattgtttccttaataatgtacattttcttgtttcctggagttaggatttctgtgaaacatctaagtcttctcacaccctacacaattctgcaaaatgcttctcaaagcaattttgaagtgggtcagaacggtcacagcttgtttctagatccttcctgtcctggggactccttcctgcagcctgaccctggggtctggtctggattctctcctctgctgccagcagccctcggagcttcctccaccgtcattcagggggttcctccttcccctcctgtgtctggttccccacctcctgcagcccatgcctttctttttcctcatttactccctcattttacaggagcacatctgcaggggcttcatgagaaaaggtcttactgtttttaaacactggaggagttggttgttttcgaggatttgcatgactgaaaaaacatctttattctattctcgtactcagtgtgcctcacaattctaggctgaaacattttcactcagaattttgaaggcctgctctattgtgttctagcttccaaagttgctttcgagaagaacataccattctcaatcctaatactttgaatgttatttgattttctttcttttagaatttcctctttatttctggtgttcagcaatttcacagagatatgctttgggttggaacttttttccccgttcaatttgtgtgttaagcctaatctggagaatcaatttcttcagcacaatgaagaaatttactaatctttttttcttttcttttttttttaaaataattttctcttcaggagtttttttctgccctatttgaatgaaactccaattagttggatactggacttctggtactgattttcttatctcctcttttctgtttcctatataggtctttcctcttactttccaggcataataatatgtttagtttataaaaattttcttgtttgctgctccttgtcttataatagcatgctattcttctcccatggatgcatgatcttttcttgtctttctgaagatattgattataattcttctgaaaatttcttctgttccccgtattgccttttttctctgaactccttcttttctctgtgtttggtggtttctctcaagtgtctgtctggtaacctttggtggtcttttcattcttaagagtaaagcatcacaaaactcactgtgcaccagtgtatgtgggtggtgcctggagattgctgtgtcttatcacggggtgactgtgtggccagctggtcttttgctggagatgcccaaatgtcaacatctaaactcattttctctggactttccaatctgttgcctgggaatggtgtaaacacgtgtgttggcatcctgagaaaagagaactgtagctgtccacctgtgaggatgtaggctttcacttaatcctcttattttgagtgtgcacctcatcctaactttgctttaggttgtgtacccaactctgggattcagtttttctggcaaatactctggttatggcagaggcagggggaaaagtagccctccagctacagagaggggatggagacttaggcactcattgtttccatcactccctcattccacatcacctaattttcatggtatctgaggcctccagttcctgagtctcgttaggtgctgggggtagcattatttcttatgggtaccccttcctccacaccctcacctctgaagacacttgggtttctcttctctgctaagttatgaactatcctcccttcactttctgccttcatgtgttatgagtccatgcaaggcaggatttgtgtacatttctttctctccgtattatttgaggatgatttttgagaaggggaggggggataaatgtattttgttgtcatctctatcatcttaaaactcaaaatgttgagtttggtcttgctaatactaggtaaaacttgaaaagtctatcaagtatgaaataattacctatgatactccagaaataagtgttgtgcaatgatattgtgctaaaatttagagagactttgcccatggaaaagctattgactagaattagctgatgaatcagagcagtaagttagagataatgttaaaataaggtaatttgactagaaatttaatcagtagttaaaatcaaatgccatctaatagatttgagatcaaaatccccagccatttttaagccatcagttatcacccattttataataagatggaacatattttgctaaaatgttccacacagtccctgtcccctgctctgcccagaaatctagcatcttggtcttaaactactggtatcatggatacttttaagaacataacagagccctagactctcttcctagaacattttctataattttataatatcaaagactatggagcctatctctagatcctcggagtagagaatccctgaagtacagcacccacacacagtcacacaaaacatatttacctctcccgacggtgatacctgagttactgaagcagcacctatctcttgactgtgatttaaagctgcctggtaaatggtttctgggagtcatcaggcctgaaaaatgcccacctgccactaagtgtccttttgcccctcccccgccctcatccatcttcctcccagggctatccattcaggcctgcacgtactgatattgagtagaaaaagtcaactgcctgctgaagacaatatactttcaaaagaaaacagagaggcggcaggaagtatattttaatgcatttaccccattcttgactctggtttattcttttattttcaaataaaattatatttttctgctcctgacccaatcattatgggttttattgagctttaatgttaatatatcttctcacctgtattccctcacagttcgtatcagaaataataagcagtaaatacaatatatctaagtaaagagtcagccagggcatataaacctatttcccatgtcaccccctccagcaaagcctttcacctgtcctctgagcaggcctccaatgatattccttcattgggctgaaatgtatactgggataagcctacccccagccactacggcatataataactagaactccaaaagacccaagccagtaagattgattctcagggtctcctggactacccagtaatttctatcattagccaatgtaaaatttaaatcagccaggatgtactctcattttaatgttgatcctgtatgataccagtgaatgggggaatatcatagccagagaaaaatgactgttactttgtgactctgttgaatccaaacaggtgtaaaaacacccataatatcaacactagatggtgctatagacaatttactaatttaagaagtgtcattaagtgcctattatatattgagcactgggtagatttgagaagaggcctgggataatgtcaacaacagttaacttttatagtgcttagtatatgccgggcattttcctaaatacttcacattcattagctcatttaatccttacaagaactctctgagacaggtaactgttcttatcttcccattttgtagatgaaaacattgaggcaccaggttacaagactacaaagtaagagaggtgggataaaagcccaggtagcctggctccccagtctgtgttcttacttactgtgctacacagcccctaagttgaggtgtgggttcagttgcacagcttttaaatcctattgtgatgatacagtgttagataatagggctgtaaagaatcccttggtgtgtgctttatttcacgaaggacgttattcttgagtaggaagagattgatactgcagagccattggatatttttagtttaaatatggctctgtcacatcaatatgtgcttgataatatacagtgctttataagtgaggtttggagagaaaagaaagatacaatagtttgtaatatctcaactttataaaatgtttaaatatatgtataggaaaaagactgttaagatgtatatcaagatattatcagtagtggaattacagttggcttaaattttttcctttgtgtctaaaatttccataaagaacatttgtttataagaacatctatatttatacacgtgtatgtatatttgtacattcttttttgtttcaagaattagcccacacttcatcaaactgtcccagcttgaaatgaaatagtgatattctaaaaagtgtccattcattcattgaacaaatatttattatttactgatttcctggcactaggaacagggcagtgaagaagacagccgccccttgctgcacatagaatctggttacccttcgagccagcagagcagtgccacagagcactgttttctaaagagaagctgtcataacattggttgtgctttgtggaagacagaactggtaggaatgtccagctcctcctgcttggtttctggaggaggtgcaccatggactgcacacccttgccatgtgtgcagtcctggctcagcaatctgagaaaatgatgccagaaattctgctctcacctttctttttgaacccaactatcggaagtattgaatgataagggatttcctgatgagttcatcctgttgattctgagatgtagcagatggcaaactaagacagagggaatctaatgatgtactagaaattcctaatggttgcagacaccctaaagctgaagacagtaggctccatatgctccaccatggattctgatgtccaggcactgcagcagagccctaggtggattggctaaggttgagggacaatatgatagattttggagagtctttcttcctcttcttcatctttctcactcttttggaaaagaagaggaaaaagtacggctcagacaattccaaggggttggagagacatggtttctcaaggaggtgcctcctctagaagagtctgcacaccatattcctaatctgtgtcatcgtgcctttgctgatctatagatggcttgaatttgaaggccttatgagcttggaacagaaaggcagtatttacagaagaagcatttaatttctggtattttaaaatttctggtacgtagagtgttgcagggtcactctctggggtctttgtttggtacattattaaaatcacatttatttcagccaaaaaagtgctctttgaaggtttcattgtaaatgccacaaacaagatgctcatatcatcttaacaacaaaaaaaaaggcccaatttgcaatgctgatggctggtccagctctgctgggtcatacttaacatgaagagtctgcttgtgaaacttacatctcctaatggaagctgatggttctataagaagggtgccttcaatcacccccaagttcagcacatatcccactcatgggtggatcacggtggtcagagaattgttagggcaatgttagggctccatgtgcatggacagcaaccccagtatgcttctttttgagaccctattttatttgctttgtgatggaatggcaaccactcaacatatagatcctaggggcagcctaatgggtatcaaactgttttatatgctccaaggcaataatattgagcagaggactatctcaagctttggagtggaagcagatttcaattgcttactaggagtgcttatgagtatttatactactggatgtcgcagcataccttctttttaaaaaaggatcttacctttgtcaatcagagacagtgtgtgatgaaagcataaggggaagaacaggtatgcaaccacaaacttcaatggaggggaaaaaatccctactgagcaaactatagcatctagatttagtggtcatactccctcggcatttacagtaaagtttgtctaccaataaatgggtctgctgaagagaaaagggggcaccttagccccattttgaggtccagagaccagaacctttccagctgatagggaatcaccatctaggaccaacaaactcacatgtctcctttaccagagtatgcaatgtaacaagccaattgcaggttgtctaattattcatgggaacgggatagttttgattgaatttgcttatctttcttttcaagatgaatgcaaccaaatattgatttggcattaattaactattgatttaggcctaactggtcctttccttaccaagctcagagttggaaaaaccttacagtctatatataaatgactttctttcccaaccagaagcttctgaaggcacttactatcaaatcataaaaccttagtcatgttttgggaatatgttgaccctttagcctcaactacggttgcaagtgcttgtgtatgtaagtctcagaaaggcaacacagtccagtacaattacatatgttgcgtagatgtttgatgcatacatttaaaaattggattaattttatatataactttattattatattctattacatttataaccacttctaaggcttaatttttaacctgtttattagcataaatttcaaattctttattttggagagttaaaaacatacaaaaaatagaataccattaatataatgaacccagtgcagtcattgcctaacttcagcaggaatccaggttttgcggcttgtttcatctgtctcttcacatgcagtgtgtgtttgttttgttttgtttgctagcgtatttcaaagcaaacctctggtatctgtcaacactatttcattctcaagaagtcctaatgtggtcaaataaaatttgctcaatatatttctgctgtcttattttgataaaatgtacaaaaagatatacaaataatataaggaaattttcaactaaataataagacttgagaaagtggaggtttctacatcaaaagataataaataaacatagctgtatgtatatagcacatataatgcattttaaaaggaaccaaaagaaaaatatcagattcttaaggacttagctttcaaccctaacaatatttgtgctttatgattttttttgaggacaaggacggtatgttttgtccatgtttagaaatataatttatattttatttctgataaattaccagtgaactgcatataatataacatatggtttatgaccacagaaaatgaagcagatcacttgctgcacattaattgtgtagaaagacagatctctcaaagtgccacagagcccaggttggtgaatttcaagaatttgaggcttcttcaaagctcaaatttttattagccataattcagccgaaactaaacttgagacccatgaaaatttaaaactttttatagctcccaacttaacacccttaggtgccaggtttcagtcccaagaaagtgccactaggaaatcatacaccgtggaaaatggaggctgtgataaatgaccatggctctgctgctgggtctccctgacctggaggatttggctggcgtcataaaacacaaagcgacagattaagcagtttaccaacatcataaaaatctcaagaataaattcactttaatcaaaaatcctatattgtaactaggcagccccagcctcgaaaccacatacatttacgtataagcctatgtccgtgagcaagaggttatactttccctgtaacgtcggacatgattatgttcatacacttttacaatttacatgtcctaagaaaaatacccagctctggctgatggtgcgggagaatttattttcactagaaagggaatgacccataactcatgaatggcagcgcttaaagtgagttatggaggttactctcctgtgagaggaaatggattggattatccttctgcccaattgtatgtttggttattagcacaccaggttcttaattatgtgcagctttgccttttttcttttataaaataaatgtggataaaggcaatgtcagctggaagcatggagtgcctaattggggctctgagatgcagtcagagagaagaaaaatagaaaccttttttaaatgattaaaagacaggagtcttaaatgtaatttaaacacagtattcaaattgattagccccatagttaatttattgtgtctggtgctgatgttctgcaaaaacatttaaaaattactccttttctaaattaaaaatttgccatcttgtaggttacatttgcatgaagattaaagagttggttattctatcatgtagattttattatagtattacaataatgctgccatttattttaaagtaaatataacaagttactacttttttgataaggaaatacaatgtaaaaatgatgtttgatgattacaaatatgattactgtttattaatttatttcagtcagttacagaacaaaacatctagatctctctgtaacttccagtgttacagtctacaaaggaatttgatttctgttgagattaggattctgattattgagtaaaaatattttatttaaaatttcaattggttctgtatttcttggacagggagggaggagtttcagctgtgcttctaagatcttccagaatgaattttctacctcaaaaatcaaggacttttctggaaactgcagtcagaggacagaacatcagcctcaagctggtaaataggatggattttctccctaaacatcccttctgctttctagtttgaattatcaataaaatggtttggcttatctctgaaaataaccttgttgacaacacaaatatggatttaaacacgctacctccacattaagatttaagaagcccccagtaaatgtcagggggtgtcaatgtgtttgctgtgatacttggttattattagtgtttaactgcaattccccaccagcgccacgctgcctgcaccaccataaattttaatgtgatcatgtgctcttctcttttcatatccagtgaattctgcaagatcataatattctatatgaaccctagctgaaccttagtgtgatatgaagaaagaacaagatttcaagcaataatagttgttcaccattttatagctttttttaactggacactgagcaacatggttccttgaataatattaccctaaactaaattcactcattcaattaatctttattgataccctacaggatgcagggcatggctcaaagtgctaatgagtacatttatgggatagtaaagaatactgactcttaaagaaatctttttttttccccttggaaaatctgtcagagctcatacatcatttataaaaccgaaaaaaatgtctctgcaaccttggcaccactacatgccttttattttacagaatacaaacaaaagcagagtcatttccgatatctagtctacatcgtgaatataagaaatatgtccctcatcttttatcatgtatttatagttataatttatttattatgtatgtgcatgatggaatatttgttctataaacttctattagtaaagaaaatttatatgatgatcattcatctgcaggttttcttcctcattttaaccacaaataataactgtcactacctactgtatttgtcagaggaattcaaagtatttgggaaattttaactatctaaatatctttttaaaaacaaagaataacattgaagctttcaaatttataaatgtgaaatttcagaccagaggcatggaacaaattaataagtcattaacagggttcccagtgaataaaatgttcatcattttatatcaatttgcctgtcctacacagtagttctttttttttttaatttctaaaggaacaaaaccgctttgttacctacacatgaacctgaatacttttgcaaaacacaatgctgagtcaataagtttattttccacccgtgaagtgattttagggttaaaggttaggaagctggggcatatatttataatttgcttgtcctgttgtacgtggtgccaaaatttgttcagcagtgacacacaactatgcatttccccattcccagagacaataggcttggaaaaatacacaatcacagatttaaggtcacacggagaacactattattcactttaacagcacggtatgcaaggtggcagtcataaaacaggcccatcctgatgggagatgctcttttccgacagactggttttgttgctatctcttttaggaaaaacatttattttgtggtggggtgtgtacctcagtattccctgtgctagaagaaaagaagcactttcaaggaaggtgggtaaggttttttcccccttttctggaaaccagctgagaaactttgccttggagcgccatctagaggaagcctcagcacacacacgctgtgctttcttagccttatgacatgacccaggttgaatccaatggttggtacatggtgagtttcttttcttttctttcttttttccccccagattaatagagaattttggttctaacacaacccacagacaggaaatatgagatcactggaatggaattttaatcactgataagatcaaaacattgaaaggcttttagaatcttcaggagtgccaaaagcatgagtgcccattggtggtaagaaatagggcatcattttaccataggccgagtcacattccagagatgagaattgatgagcgagttaaatttatttttagctacactgattgagtcgtctttgttacttctgtaattattttcttaattaaaaaattctgattaaccagattgaccagagtcaagcttggagaagatacttacgttagagagaaacaaatgttgacacttttaactgactgtaacccttagttaagttcaacaaaatttaatgagcagaaaatactatcttttccagatgtggctactcaatacaatgtgaaggagaacaaaataacgttgtattctttctgaagtcatgtttttgttttgtgatctcctccacccaccctccttagagaaatttgacaatgaagtctcctctttctgtgttagcatgaatgcaaaaaaacaaaacctaagccttctccaacaatgctgctcttcaagattgctgagcatacttgcaaaaacaactgtaccctggaaatattctgacgatatgagcatccccattgtggtgacatagtttaagaattctattctcttcaatttcttggaaaggatcaaaattgcccatataatggaaatacccactgcagaaaactggatatatatttccttttgctcctaagtgtccactgtgaccctgctgctcttgccagtttcccctattccaactattttaaggtttgttataaaaatctgtctctgtccttgacatttctaactcaaaaatgtcacagccatttctttttccttcattgaacagggttcctacttacttattttggcaattcgcataaatccataggttttcccaaataatgggttaaaaagttttttattgaatgtcctctgtgggccagacatatgaaatctgtacacaaaacattataccttgtttactgaggtaggatatggaaaaacaaaatgaagattttttttttccaagcaatggttgttacttgagctattaagcctcatggttcaaagcaccttcctttctcacttgatggctcactcctctaacggtggatgcaacagaagaatggaatcagtccagttttcccaggccagtctgcctgtttattaagcagttgaggacccaaagcacaagtccctagtataaaagacattctggccccatcttatgctagatgcacatttcagctcatgtcaattcaacatacattttttgaaaacccaccaagtacatgacagagtgcagggtgctggtgtgaccctcaataaatggtggttgagcaaataagtagatgctgttgaaaaaacaagaaatgatctcttccctcagcagcttactctataggaggatgacagatttgtaacttaaaatacacagtagcaagaaagatgtgttgtactagatacagtacagggaaagaagtaattattgatgatttgggagaaaggggaagactttgtagaaaaactggcactagatgaatgccttaaaggatgagtaaaattttaataggcagaaaatgaggcagagttttttttttttttttgagaaagaagcagaattgtctttgttcatttggaccaaaggaaaatgcatttcatttggcgttctgattttgtgtttaaattttagtctgggtgcaaaaatataaggtatttattttatgttggaagagtccaagactcacattctttttttttgtatggcaatatgtttacacacacccacagatatgtacgtacacatgtgtgtatatataactatgaagccaaagaaaccaacatatttaagccagaaaacattgtacttgatgatagtgtaacaatgtagtagaaattatgccaaaaaaagccttatttcttgccagaagaagtaaatagaggatttgtttcaatatttgccacaaacatttgctttgagattaaattccaaggcttatatctgcccagctgcactagatatctccgtgaaacagactggccaccatcactgggttaaaaccccacgggacgagattttaaggcaagtaagccctaaacctggagagtgcgcactcttacccctcttttctccttggcctccctgggcattgtctcaaataagcatcctctcaggatttccatattcctgcgggtgatgttcacacctccctactggctttccaccagccaagagagtcatatccagtgatctctttgttctgttactcaactacatttcctctgcaaaaagattactttaaaaatctgagcatttcttttgtaaaagaacaagtttaccaagaaaaaatactgaacagaagctcaagtaatcattccaaggctacactggcttcaaggggtcaacaatgttacagctttcaagctcagaaattgctggcacatatatactttcataaccagggtaggtaagttccaacataaaatgatcacatggtaatttttcagagaaatggaaatgtaaaggagaaggcctgccagttcctacgaatgagaaatgatcttccaccatcactaagcacacttacggttaacatcgcgaacatcagctgacacacgttgaaggcatgtctccagttgtggtatagaaccatccgatagtttttcctcactgtcaaaagccacctacacagtgtctgaaatgggagggagagggtgcgtcaggcagttgtaagtgattctagtggacccttatctcaatggtgccttatatctgagtaaccctcagtgatcaaaggccttccacaaacatctcttctggttctcacagtaatcccatgaggtgtgcagggcagggattatcatccccattttgtatttgggaaaccagtggttcagagtggctaacacgttgtcccaggtgaactgcttggatcacccaagacagacatcttacctcatagtcaattttaaatttctgtaccatccccagctccatgaacatccggagagcagctgtgatcatggcatcaacgtcgagagaaaagtcatcaaaatgaatgtcatcgatggcaagttctgacaccagagggatgttggctgcctagaaaagcaaaagacataagtcaagccaagttcaccagctttcccaaacccccatcctgctctcctcccctgcttatcagaagtgccacataaatcaggcctgacctgcacttacaccctgatacagctaaactctgagctgtaaatgtcttttgtttctgaactgcaaatgccccaagcaaatgaaggtgggggcagggttgggggcggggggagggaaactaatctgaagataaaatacacgcactggatctagcctgcagaatttataatacagaactgtcaagtttatggaaactgtggtcatacaatatattctgatgcatattacagagcactaaatgcaagaaacatctgggcagccagcagctgtgaattttaattgatgctattcaggagaaggagaagggaatacaccactttgccttgtttcttatatccttatatcctgtagcttgcacgtgttctttgttacacacgtgttctgtatattcagaatgatcgaaaggatcagacagcacatctctggtgggaaatatgttgccttaataaaatagagatatctgaaggtttagcataagcctatgtttcactgaggagatcaattttgctttcttgtttagcttcattctatataaacatcacaacataattacaatactggtcatacatattcaaggttttcaaaacacccatgttaggcaactgtcaatcagctgcccacaaacgagcctaaagaggagaaaaaaaatctttggaaatcatttgtatggtgatttcattgggtttaccatattctttggatcactcttggtaagggagtcacttttatattttcaggttatcagagaccattctgtattcatattcctatctattcactgggtttaaattaccctgacagtaatttatgccctggagctacttactttggctaagagattcaatccaactctggctgctctaagcattccagaaaccacataattaatccttgcttcccaactctatgctcctccataggtggagcttagtttttccatgtacttgcaattaattcaacccctaaactctctatcagttgtctaagtctcttctcaaaatgttcatatgctttgggcattccgtcagtttcacgaataaatcactcctggaacttcccgcatttctccagtctagaccaactatcttataagtctgatgtgtagttttcatcctaggatattccttcaccataattgtggggatgcctttctctctttcttttgtttctctagcccacatctttctctttcttgctttctcctctcattttggtgagacacatcctctaacagattcccaagaaaaggtgtggggtagatttgtgaggctgtgcagtctgaaatgtttttgtattactgtcacatttcattaatagtttgcctaggtaagatttctaggttggaaatcattccattagaatgttaaaggcattgctctttgagctttcgatgttacttttgagaagtcagaagctattctgtgctattatactttgaaaataactcccccctccaactgagtttttgtagaatctttttgcttcaagagttctgaaatgtcatacaaatgtgccttggtgtgagtttattttcattcattatcctaggcactttgtaagcccttttcttttttccccctttttttttccagtgtatctattacaggtttttgctttgtagttaccatgaggcttagctttagctgtagtaaattattttaaaggcttatcattagctataataaattattaagatgacatcttaattttgattgcaaaaaaagaaacagagggaaaaaagatacttaattccatccccctctgcattttgattttttgttgtcactttaaatcttttttaaaaatttatttattatactttaagttctagggtacatgtgcacaacgtgcaggtttgttacacatgtatacatgtgccacgttggtgtgttgcacccattaactcgtcatttacattaggtatatctcctaatgctatccttcctccctccccacaccccacgacagatcccggtgtgtgatgttccccgccctgtgttcaactgttctcattgttcagttcccacctatgagtgagaacatgcggtgtttggttgtaagcccttttcttaattggaaaattatgtcttttaattctagaaaaacattttaaaataagctctttgaagatctcttcctctctttgtttttctgaaattcccttaacttgacctttggactggtttgtctttcttttctttttctttctttcatttctcttttcctttagtttttattttctttttcttacatgtttttcatttctcatattttttcttttcctttttgctctgctttctaggaaatttcttcttactgttgagattttaataccacggttttcattctaagagctcttcttttgtcgtctggatattcctttttatgtatttttaatagtaccctaattttatttcacggatacaatattttctcttacctgcctgaggatgtgaatgacaattctatttgtcattttcttctcttcttataattggcttcactctctgtactttgttttagtctctccttttttattgtggtaaaaatactgtactgtgtacagtacagtagtgttaactatatgcacattgtcatacaacagatctctagaactttttcatcttgcatggctgaaactccatacttattaaacaattccccatttcctcctcctcccagctactgacaaccaccattctactttctgtttctatgagtttgattactctacctcctacaagtagaatcatgcaatattcgtcttttttgtcattggcttatttgactcagcataatgtcctcaaagtttatccatgttaaagcatatgacaggttttcttttttttaagctgaataatattccattgtatgcatataccacatttttgttccattcatcaatcgtttcatctctgtcttcatcagccaactttcaagaaattattttaatacattagaggctttagaaatattagaggttttccttagcggcctgataatctttagttttccactcctgtgtaaaagtggggctctaaaagtttctattggagcttctgggggcttctctgtagggggaatgtgtctgacctgtttccttggggaagccaccaaatatcagtgtctttgtgtctttactctttagctactcagaatccccagagaagagtcttctggctggagcctagcggggaagcaggttggaggaggagtctcagcattggtttcctgttcattcagtcctcctgctttcaccctgcacgcccaccctcaccctctgcactgacgattccctaacccaaagacccaagattatactctctccagaggacaagcctctagtctttatggagtgggggagtagaacaaaggatatggggctctaactgcttcttagactctctgttttcctgtttataagcccatcttcatttgcacttccaaaggtacttaattagtcaattcctgagctatctgtggggaggagtctatggtataaatctgcttgcctctcagcttttcccattgctaggttattttggctgtcttgagtttgctaaattactttctattcatccatctgttttctagcatccaaaattttgtcaccattaagtcccttcccaatttctttggctttgagaatttatgcactaaaaaaaacctttatttttgttttaatagggcatggggagagaacaaaagaaaatgagtgtagttaatctatcatctttatccaaaaataaatgaagttatctttattaaatgatacctagaatggtcagcttggagaactcagagggaagccagcctttggtctgtaggccctttgtttctatgtgcacacctggctgcaaccatgtagatctcgttctcttattctgcgcccctgtgggttcacttgtgccagtgaactcacttattaggctgtaacaatcttagaggcagatgccatgtttatttttcttagggaagatccaaacaattctttactcctatcatgtgtttgagggtttgtaaatagagaataccaaggtctcagaaagatctgtgcttgtggtaatttgttccaattcaaaatcaaatgttagtgggaaaaacacttttcaagagatagaggccctgtcccaaaagacacaaatctttctggtctcaggagagaagtttagttctgaattggcaaaggaggctgaaccttgttacagtttgttaccaaagaagcagaaatggtgatagaggcagcactactccactccaggtggcccctgtcttgtagattattaatagtgtattccctgataccattataaatcctctaccttccaaaggcactaaatccacttaattatcttaaaaattaaagaatataggaattttttcattatgaagtgttaatggaaaggaaataagaacattacgttgaaaatgtaaaatgacctctggttcaccaagacccatccttattgaccttgtctttttttcccctaataggttgattgatccatggttaaatcataccggtgtgtagatcacactaagccctgccataaacccttgctggcacttgtagatgaaagaaagttccaagcctttcaagaatgaccattttcagctattttgagaagtctgggtagttttcatccccacattgctgggttcaagggcaggttctggagaaaactatgaagagtaacaggcagtatgtatcctgagcagacaagcataaaagatttgggaatagccttccattgacaaattccttgttatagagacacagtgctccccattgcttccagtaaacagaaaatgagattgcatcttccaaacctataattactctagccataggatattaacaaaacaaatcaaagtcaatttctccaaatgtcagtcttcaacttttcaatatttataaggtgtcatatccctaaatcaaagaggagtgccacaatccaaaataactactgaattaatagccagaaaataacatttggataaaagaaccatttactttactgcagcaataaatgaaaacacagaattatgagtcctggagctaatttgaataatgttcaagaagtgagactctagctggctggaagcacctgatatcctttgaccattcctcttctttgtttgggtcttaacagttaagtggttatcaaagggagtcataaaactgcctcctctaaaattgaaaaggtagctttacaaagaggccataaaatgttaaaatacaatcctggatcccttgacacatgaatattacattttgtgatgctcagaaaatgggaagaaacaacaaagtgggtggtagtccagccttggcaattcaaaggaaaattgacttgttgctaattccagcccactcactctcttaatcctctggacaaaaagcagtagtcaggagccttacgattctgggattaatggagacaggaggttgagctgtggtgatgtggaagggacagcaaagttctttcttttgccaatataattatagcccttattatgtgccagatactgttttagtgttatgctttgcatatactcactcatttgatgttcacgagaaccctaaaagcttgggaatagttttaattccatgttatgatgaggcaactgaaataaataatgaataagttggtcaaatttgcagtgtgattgtcagaggcagatttgaacctggggagctttgtgctagagactggctcctaaccatcacactgcctctcaaaatgggcctatgccaagcgagggtccccctttctgtattatgcaaactaacttgggtgcaccatgactggagtttgggatttatatccagatgactagcttttcaatccgttttttattataagcaacctggacctatgtgagggacaatgtttttgtctttacctatataaaactccttgggaaagtctccaaattcagagctgactttggaatgaacccaaattgttactttgtgttgattgtagctaacccagaatcaactcgaatactcccaagaccatgctgaaaaaataacttgtcttctcggggagcaaacaatgaggaggtgacaaacgaggagataaatagtattagcagaacagcgatgttatgaaaaagtaagtttttgcttgatcacaggagtttgaggctgcaatacactatgatcgcgcctgtgaataggcactgcatacactccagcctgggtaacacagcgaaaccccatctcttaaaaaaaagtaggatttaaattctcctggcaattgttttctcttgatgccattcattaaatttgccttgtagttgcctagaacactcttcatgacagatatgggctctcatcctacctttaacacttacttggctgagtggcagtgggcaagaaactaaagtaagcctcagattgagcattctttgtataaacaatcacaaaattgtgttgcatggctgttgtgaggagtgaatgaaataatgcacacaagagcctagcacagtgcttggaaataggaaatagtaagtaacggtgcctggcatgatggcgcttgatgttggtgtgttgttgttatgctcattatgatttttatactgatagcagccccatagaaggatagggtgagtggagaagattttggtaactagactctgaagagtcaagctctgtcctctgccccaggagaccgcccagtttaatccattttaattcagtacatatgtattgtgcatctaactgtacgccaggcactggcatatgctgtagttatgtttgtaaaattagtgtggtccctgtgctcgcagcctgtcagaggatacagagaagcaaacgggcaattacagaacagtatgggttaagagctgcgatgggggaaacacggggcaccacaggaacccccgggagagtttagtgaaatacattcggcttcacgttcctgccttaattccaaactgtcattaaacctcagctttataaagtatatttagtaatttaaacagttaaaaatagttactatgataaaaaaatgtttaaaggtcatagagaatgtatcaaaacctaagaaaagccgtggactccattcctgagatgctcatggcctacccaagaagaaagaaaaaacaatgattcgtggaaaaaaaaaaccccaaaaaaccagaagcataaagttcagaggcaacaacaggaatgagcgtatgagatgcaaagaagcacaatggaggaggatcatctaatgtgggcattggagggtgaatacaagttcaccaggagaataaggaaacatggcggagaacagcactacagagtagagttccaatctcccctgaagatggtgcaataccaggaggcacagacagggccccattgttaacaaaaaaacagtgcttgttcacagagatccaagacttcctctaataggcttggaccccttggctgcctaaacaactgtaaaacttgagttcatccaagtaaagggcatccgctttgccaagctccagtggccttggaccacagtgcaggcgcctggtttgcctgtgactccaggactgacttctgttcgctgtccatgccaggttggctcccttgacccctggtagtgaccagtctccattctctatggccaaacctcccagaacttcccctttgaagctctggtcccaattttagttgtggcaggtggcaaatgtttgggccgttttcgtatgggaaagcaattgtcagtgtttccttttccctttctttgctgcactcaacagcgaaccctttctttcctctcctgggaatatttgaagaccaagcaaccctttgtgtcctccagggaaaaggaatttgttttcggttgagtggggttctgggtctaatgggtctatctattttgaaagaaccagggaaaaagagagagtactctagaaccagaaggaaggaaggacgtgctcccgggggagataagtaacagaggaagggccaggcgtagtggctcatgcctgtaatcccagcactttgggaggccgaggcaggtggatcaacagaggtcaggagttcgagaccagcctggacaacatggtgaaactccgtctctattaaaaatacaaaaattaatacaaaaattagctgggtgtggtggtgggcacctgtaatcccagctacttaggaggctgaggcaggagaattgcttaaacccaggaggtggaggttgcagcgagcactgcactccagcaggggtgacagagtgagactccatctaaaagaaaaaaaaaagaaaaaaaaagaaagggaggaggaagaagaatttccccctttcacagagatacaggaatgaggaaagagagggaaggagacagcccctgggagcatggctgctgatccttgtgcatttacctagaaagtggatgcacctagcaaaggacccccatggaggcaaaggactcccatgttggagctcccataagctaagtgacagttgaatcagaatccatggactgtcccatgtttaagttgaaacctctcattatttgcactcaagagttcaccagctcttcctcccatggaagagcggtaaggactttagctcattagcatccagcacctcaaccactgaccacccaatggaaatgacacctgtttgggtaatgcacccttgcttagtcaccaaacacacaatacctaaagacactaataaagccaagaaagaggctgggtgcggtggctcacacctgtaatcccagcactttgggaggccgaggtgggtggatcacttgaggtcgggagttcgagaccagcctgacaaaatggagaaaccctgtctctactaaaaatacaaaaattagctgggcatgatggcacatgcctgtaatcccaggtactctggagactgaggcaggagaatcgctttaacccggaaggcagaggttgcggtgagccaagatcacgccattgcactccagcccaggcaacaagagtgaaactctgcctcaaaataaaataaaaataaataaataaataaaataaaataaaataaatcacattattggctgggtgcggtggctcacacctgtaatctcagcactttgggaggctgaagtggacagatcacgaggtcaggagatcgagaccatcctggctaacacagtgaaaccccgtctctactaaaaatacacacacacatacacacacacacacacaaattagccaggcgtggtggtgggtgcctgtagtcccagctacttgggaggctcaggcaggagaatggcattagcctgggaggcggagcttgcagtgagctgagatcacgccactgcactccagcctgggcgactctgtctcaaaaaaaaaaagccaagagagaggggcagggttctggatacctacaacctacaggaatgctgggagggtgggagtggaaggtggagaaggcttctacacctgaactaggttgggaagctgaaatgaagcagcttaaaacttcctgagagccaaggcagtggttaacgatgtccatcattaatatgttgtgtaattattgttgaaagtctgatggacaaggataggaattacgtctgtcttgtttactgttgtgtcctaaatgctcattgcagtcttcaccactgtaggcagtaactggcacatgggagaaactcattaaatatttatcagatgaatgagtgaaggcttgataatcctgctggaagtcatcttactagtttttcccaaaccatgccacaatatcccctggtgaatttgagttgtgtgaactttttgccaaccaccctggtgattacctcacacttagatacacgtgcacatggaaatccaagatcaggtaatataggtgagtcaagttgccttctaagtttgtgtgaatccggtgctccattttttatacatcagtggggcagtttttagtagaagacacatagaggagtccctaaccctgtgaccccaatcttcaagttccaatctgagctcaccagctgggtgactctgaggttagcctgcttcatccctccaagaagaaggtaggtccttgcagggtggatgtgtgagtgcagcatggtggctctgtgagtttgtcatgaatttcctgtagtgtccttctttctatgtcttagtagcaggaaagtgatggaaggaaggaagtgctcttgggggagacaagaggcagttaagcttgtgttgactacattacacattaaggtttagagacgtaagatacgaattccccaaagatgatgctgccagtccagcatgatctttctggctcagagattgctgccttttgtcttggttctgctcagacctactatgctctctgtatactgcttcttaactcacatgctcggttgaatcttaatggcttcctgcctacatcaacctcaacctgctgcattgtgggtctttcttgagtcctcactgaccctccctgctgcagcctcaccagagagagggagggcacaaccactattccttcttccatattccatggtgcttgatagcacacaggcatgagacaacaattcaatgactgtttcagtgactaggcagaaaaagaaggaagataatgagagaacttgttcaccagcaggaaatgaagctgtctggaaacatcggcctctagagatggaccagggttcgtaaactaataatagagaccacatgagttggtttagcactttagtgtcaaacagctaagcctaatgaacatcatattcccttgtttctgcagtttaaaatgtcaagtttatcaaagcattgccagtaacaataagtcaaaggaacaagccaacactaacatggaaccaagctcttaacgcacaaaagacagcaaggggcatcaagcctcaaggcctgtgaaatggtagagaacaatgttagagggcaaagggaactggaggctcaacttcctgtttttatcgttttgttcaaaattaacctgatcttgccctgcttgtcctggggtgatgagtgccaatggtcctgttacaacgtgctgcactccaccgtgcagcaaagccagtgaagggtgaaactggaaccttgggattagacttagtagctaatggcaatagtaggctaccttgaggatgaagaggatggtgcaaagccactgccagaagaggggttttatttgggttttctattcatgttactaactggatcccatgctcttcctcaatcttgtcctgtaccccaagctcccatattttggcctgctatttggagataggagtgtactctgtcaccagtgacacatgaggctagttacccaatcatcaccttccagtgagctggtcagaagaaatgtttcaaaatttatgcattcaatataaacaatttcccatcctgtgcatcaaaaagtatcgtagagtctctttgtcacttctgaaatgaagcatctctctgctgttgtctcaacattcagttgagtgtcttcttaaagaaaaacagactctagtttccacatatttttcacggtccctctatgcagcaagataaataagaatttatatacttttacttgtaaatccagtaaatatttatattggtttttgccataaaagcacatgaagcattatgaaagaggtttctactcttagggctgaataaagccatcactcgcagtgaggaagtaatctatcaaatgaggcaaagaggggtgtgtgtcctgattcctgagccacaattccctgtcttgaattgtacctggatttactcttggctggatggtggtgttcctgaatacacacacaagtacatacatgcacacatctcatgtacacacttcgtttttaatctgctctttgacttctctcagatattttattagtccattctgtcttcagttctgttagactgttattccacacagacaaacatttgaattttgcctggactgtgttgttggtgaaatatgttagtatctgacttaagctgaatatggtggacagagcaaaactaccttggaaatgaaattatatttgaataacccacatacaaaggtcagtgaagatattcataaatttaacaacactaagagctttaatttaaaaaattaagaactcaaccatgtttagacaggttggctagttttgttagtgctgggtggaacacgcattagaaactttttttcatcatggtgcatttattaagacatattgtgtatcaagcattgtgctaagtgctttatagtattccatttaatcctgcaacaaccccatgggtaagattctattactagtcccagtttagcctccatagcacagatgaagtaactgaggttaagaagataagcgactttctcaaggtcacataactagaaaactgctgggactagaaatcaatcccaatgaatctagccctgccctctgtgtttgtaaccactaccctatattgcccacacaatcatttgaatgcctcttagcttagatccactgcagcacagcatggaattattgcttccagagattttcttccatgcagctttaaaaaacttatttatttttgtggtcttgtgaatctgtctctcatcattcataagttccataaggaaaggattcagattctcatatgtcagcaattatcatagcctagtacttttctcatggcaagtaattaataaatgtgggttggtgggatgccaagtgcataacctcctgagccaaacagatgtgcatttgaatctgagtttgctgcgtgctaaagctgtggccttgagcatcagtgtcctattctgagaagggaacacaatgataactatcttacagtcattgaaaagcttcagtgagacaaaatacttagcacagtgccaggttcataggaggccctcagaaaaagacagtgtgttagtctgcaaaataccacaaattgggtggcttagacaacagaaatttattttcccacagttctggaggctggaagtgcaaaagcaaggtattggcaggtttggtttctcttgaggtctctctccttggcttgtggatggctgccttctcgctacgtgctcacacggccttctctctgtacatgtgcacctctggtgtcttttcctcttcttgtaggacactagtcattggattacagctcaaccatatgacttcatttagccttaatgacctctttaaaacccctatctccaaatacagtcacgttctaaggtactagggattagggcctcaacatatgaatttgggagtggggaagaaacaatttggtccataacagacagttatcattattgcaaatgaattgagcactaaatatctagaaattcaaaataaatgttccatgtcagacccaaaaatggtggtccctttaaagtgtcctgattacaattttagttctttctctccttggtgccttagagaacgcaacctagaaaggctttttctctttagggaactgcaccatattcactcttggaaagaaatatattcaatatggggttatccaagatacactggaggaaaacatgatacatcaagtccaagttaaagataagaactgggtgtgatggctcatgcctgtaatcccaacactttggaaggccaaggaaggagattcacttgaagccaggagttggagatgagcctaggcaagatcctatctgtacagaaaaaaaattagccgggcacagtggtgcacgcctgcagtcccagctacttgggaggctgaggtgggaggattgcttgagcccaggagttcagggctgcagtgagctaggatcacaacactgcactgcagcagccttggtaacagagtgagacactgtctcttaagaaaaaaaaaaaaaaagataaggatcagaggactgtaaccttgtcaaatgcaattatcaggctgcacagtctgccagggaaggagaccctcttgtgaagagctggcagtggagtgcttctccagtccaataatcttgttgagtgcaccctcccttactatgcctaggttcctatcattatactccctgtatttagagaaaactatacatgactatcctgtttagaaaaggtccaggaaagattttcccttctcggggagccctagtatgacaatcccagtttgtctcaccccatctagctctacggaacccctggcctgcagctctaatcctctctattgcccctgatgaagtctttcttggtgcctccaagcacaggcaatgtctgtcacttcgatcttcccttacattttgtccttttctctcctacagcatttaccatagactgctctccatcgaagttgctgtgcagtcaaccactcactcagttcatttgacaaatacttagtgagggcttgctatgtgtcaggtacattgccaggtgctatgcaggtatctatgcatcccacaagacagggactctctgaagggccggacagaacagaaactgtgtttgcctcatttttgtaccagctagagagtccaccccttggcaggctgtccctaaatgttagctaaattcaatggacagatgtgaaaggggactttctctgagaacactttcctcaggaggaagacaaggctaggaaagtaaaaggaggcaatgtcttgaggtctgaagaaaagctccatttccaaaggtcagtagaggtaatggaggttctgacttttaatccccatcctgaaaagggaggccccagctaagaggagaggtggcagagccagcaagaggaaagtgttagggaccagtcccagagcacaagcgaaatgatcaagcagctaaataaatatcagctgcttttcctactctgatgcttctggaattcgtgggtaatgtgtttctgaattcgcctcctgcttctgcataaacaacaacatgatttaatgatgtggataataaagctgttgaaaatgatttttctttagctctcttttgggacaaggaaagggaaagaatcaaagcttaatacagatgctgattacagaaaccaggggtgaaactcaagttttaaataattgtacttattttctgttaaactctcatggtttttgttagttataggatcactaattgttagcaccacacaaaggttaaatgtgcaaatactgctctcttggtttcagctgtgaaagaaaagagataagaacaaggacatataaagagggcatgaaacttgtaagatgaaggacaggaaagtgaagggtgagagaaagaaattgggtcatcaagtgctcactgagcaccaacagtatgccttgaactgtgcaagcattggatgacagggcacagggtagaaatgcctgcacaactctcagataaaagggtacagggtagagatgtcaggaaaatcaacctcacttggtctaggatggccaagaagttatagttcactcagatcccttgaagagaaattaaaaggaagtgaattagcattttttaagtggctaccacctgcagttagtttcttgttgaattcacacccttataaggcttagagagttaactaacttgctggtaagaatctgcaataagttattactatattataaccctaaagggaaaaggtagggagtggggtagagtaagaacttggacagttttacaactctaacacccagaaatcaggaaggggtgattgaatggggctatggatgaaattcaagttggaaatgagagaatgtgtgagcagaaggccctaaaatctctgccagccttgactgggtgagataacttttgctttttaggtatctgtatcactcagaaagaaagataagcttgctaccacctggggtccacctgggggctttcctcccctcctctcctcctctgcccctgcccagcagtgaagccaagcaagaaagggaatagtagggctggagacttaaaagtcaagaccaaatggggactccagttcaggaaacagaggggaggagaaaaccttgaagctataaaacagaaaaagttggaggtattgggggaagggaataaagggatgtgtgcaagaggaagagttattaagttgggggtaggaggataagagacatgctctagtgaccttgcagggtgcccctgaagtctgtctgtgataatctgcctgggggagagtgtgccaaccagttggacctctctgattgtttcatgcttttttttttttactatatgactttagagagatcaacatgaatctaaagtatgttcagacttctttcggattccttttgcttgtttgctctgtggagggcaggaagagaaaggacatctcgcacctgcctgaatcactgagtgctgagataccaccagccatgaggtgtaggaggtcaagggtccagttcaccttattcaatcactatctatcaggtggttttctctactgagtctcttaatgaggataatttctgaaagggatgctttcaagctcaatggctgtgatgaatggtattatttccagtatccactttcctacatgtgagaggattctacataagcatgcattgccatgtgacccagggcctccctagcaatgatgatgtttacctgtccagtgacttcaagcttggccgtgacttgctttggccaatagaatgtgagtgggttgatatatgctctctcacacgcacatgcacggagcagaaaccataggtttatcatacggttttgctagctctcttgttttattccttctgccataagaatggcatgtttcagatggggcttctacttcagcctgaatcctggatgaaggagcaacagagccacagccaacccatcgctcaaatatagtgagagctagaaacaaacctttgcagtgcttctttccgcaacataacctagtgaaagttgctatcataacaattttctctgtatgccctcctcattttatattgccccagcatttttaggtccagtgtttgtaataaaggatattcattccttttcacaaatacctttccttcttatcccaagctatagaagaccatgtcacaaaaaatcatggcatgaaagagagagaaactggtatattgaaaaagaaggagaaactgagtatatctcaggtctttgggagagttagcattttgggtataaaacacagtggccagaactcttaccagggcatatttgttccaaacacatctaaaatggcctcctattcccctagacagaagcatcagcttccaccctaaatcagtggctctgctactcagccctgttttagattcacctagagaaagcatcaactcagatttccaggccccacgttgagagtctgattcagtaagtctaggacgggacctagaatccttatttcttaaacattccccaggtgatgccagtgagatgccagggtgggaagccagggctagtcccactccactggcaggcttgctgggccttgagagtgccagcaaagcccaggtcctgaagggttctgaggctggtgtgagatgctggcctctctgggccacatcagagcccaggccttatgctggagagcactaggaattctaggaacaccctgtccccagtggtccttcttggcaggaggacagcaacagcatatgtgagtgtatttgttttcccagccctcttgtatatcttgcccactacagcttgtcaggcgggctgagtcctcctccactcctgagaggtggggatggtatcagccatggctgccagctgaggagactagggagcccaagaggtcctctgctgaagtctccatagaggttgataaccacctgcctgtgaactgtgaaccccactgcttacctgtggggcctcaatgcctttcaatagtccttggactgctgcccttgaagtctcccaggagtcagacctgagcctcaatgaacaaaggaaaataacaaggcataggaagaacccagccaccagacagaaatagagctgctggggtagacagaagacaatttgcatatcatcataatcatcatcacatctaagggttaaagcaggaaaaatgggtctaaaaatgagactttctaaaaaaaattcgtaggtaaattgaacaagatggttcttgttgagatctgaagtagtgagttggaagattaagtggaagaaatatactgaagcatagaaagatacaaaaatttggaaatctggagggaaaacacaaaatacttggcggatagatctgggaggaaacggaacaaacaccagaaattccagaagaaaaaaaaggaacctattgaggaaatgaaataactaaacaaaccaaaataagccatttccctaaaccaaggaaagaccagagtctgtagaaacaatgaaaatgacccatactcaggcatattctgatatcacatctaaggtggaaggaacaagaattctacaagctgccaaacggaaacaatgcataacttaaaaaggaaaaagaatcagtctggtattttatctctcaaggcaaacttggaagctaaaagataacatctatggacatatgagacaaaagaattgcaatcctagattcctatgcccagcaaagacaggcttcacttgtcagtgtgagagaaagatttgtggctgggtaaggcagagcttctaaccatacaagtaagcctgaacagagactctgagggtgagaggggaagaggggaggaaaaagatggtgagaatgaaacttgcagtatagagagctaaacctaaatgtgaagtaataaaagattgactgggattatctaacattagcatcaaatgaggattactgaaataagatagataccagaggaaactaagaactatctgaaagtattaaacaatgacagaaaaactgaggatagaggcagggtatgaagtgggcaggcacaggagaggagaaaagaaggaaaagcaagcattctgtaatgtcagctggatagaggccagaagtaggagtgttctgaagctttattgtggtggtgcaagagtcctggggaaacactgacctgttgtctccatataacagtactctgagggtaggattctcactagtagagaagaaagtaaagaacaacttgaaaagcatcaatgattttgtcagggacctgcttcattgctcctgaaatacagccagcgttccctcgactgtgccttgttttgacaatttggctcctgtttctaaattcaccccacctgtgggaaagaccctgttctgaccttggtgctctactttggacacatttgcttttggctctgaactcccagaagcctggtctccagcctccgtgcacctcaagtcacacacttcacctctacatagaatgggtggcacagggagtttgctgtggagcatctgggccaagtccaaaatggttctgggtctcctactcttgaaggaaggtaaagaagtcaattctggcggtgttccaaactggtctcttgggctagtttaaaagcttagagatgttggaattatccttttcacctttctcctttcctcttccacttccatccccacccaggatccaatgctgaagtttccattttgaattttgggttctcaggcaacatatggcctgccttttatcgtattgcctgtagcattcggggatttcaggaaagcctttgagagaccttggtctcatcctcagctcagctcactaggaacaaacaagagattggctgtgggcctctgaatatcactcagaacacctgaaaatgatagtaggccgatccctgcttgtctaatgccagagaggtcgaataacttgcccaaggtgagagcacctgttggtggcagagccaggattagaatctaccatttccagtccagaccctcccgatcctctagtccttgccaagtcccctttcaatctgaggcagaatttgccaacattcaggatgccctgctcaatctttcttagattggactctaattggtagcactgtgtagcttgtgtctggaatacgaggcatttcagataataagggtcatacttctacttttatgccaagaaagctccagcacatggaaacacgtttaataaatccaataaatgatatgataaataatttatttaagacagaatactttcaaagtcagaattaccactgagaggaaacattttgcctccatgaggatgatttgactaaacagaaattctagatggagtccattttttggactcatacaggagtcctgcatgctaacccatcagagaaagagtagacagattgtaaatttatcttctgaaaatgaatcaagtcgtatttctcttcattctggttactcttataaagacacagcaggtgaataaagccctttttctatcttatctatttgcgtattattaaacactgagatcgtgcaatgcctctgcctcctagcaacagtgtactggtaattcttggaagagtcatgaactatgtagggtgaatgaaaaaagcttcttgctcttatctagtgttgtgggatatatactataggcatgagacagcagttttttttttttattcttttaaaggtcacaaaggataaatgattacaataacatttcacccactgactctaggtttttactagtaaatcctgatgttgatttcaaaagctgcaaatctataattcaaatatttctgatcggaccataaatcctgaaaatcaaatctttttctgaatgaaggatctatgaaaatagatgatggatttcatgggctgtcaaagcaaaaatgttacatttcatagtttgtcattgaatatgatataaaacacctgcaggtaggttatttatattgataaaattattgttcttcaacattggaaactgttttctggggaataaaaataaaatataaaaatagcttttaccacaactagaaattttgtgctttagaattagacagtggaaaataatgtggataaatgccaaaagccattttctttaagccaaatacagtgtgtgctattgcaaggatggataggccaggctggactgcttttcccatcagacactatatagagtatcacccatctaccattatttttgctggaaatacaggagttttgtttgtttgtttgtttgtttgttttgtgagagagggtctctcacactctgttgcccaggctggagagtacagtggcacaatcatagttcattgtaacctcagactgttgggatcaagcaaccctcctgccttggcctcataaagtgctgggattacaggcatgagccactgtaggagctaatattctaactcttttttgttgtttttatactttctttatatattgtccttttttatactttcttcccagaggttaacaaacattagatttatatttcagtcaggttaagtatgtccaaagttattctttcctttctgggtagtgattgtgagattaagaagctagtttgctttgctattttctatggctactgtcggtgggccatactccagccaactttctcaggcaaatctaacaccacagctccccagacaactaagagttgtttaatgattaaattaagataacacatgtaatctggcatatagtaagtgctcaactaatgatagtaataatggtaatacaaattattattattattttcattatacctaacttgaataatttctaaggcccttggcatggagtatggtcactagtttagtttaacatgatttagaaattgctcatggttatatattaccaactacaaatggaaaaatgacattgttggaaagggagtaagtcagatattcagggaatatgtaggctcatattaggaagggaagatgcaggctcaaagagctcccttctcagatcctgaaaactagagtttgggtttcatttacaacagtacataatctcagctgcacataagaaaccttgccacttctgctcagtaaaatacaaatcactgactacccgtttttattttaggcagttagatagttagtacatcgttaatttctgcacatactcaagctcaatatcattgtcagttcggttttatttccacctcctttcagagatccctggctggaggtaaagacttgctctctgagtgtctctgggtatactaaggcaatatgaatctttaggagctccccttctttgggggcaatttataactcaaaacagcaacaaattttcttttcagggtggaaatactgacaataaaaaatgaagcagctttgaaatatacattactgtaattaaagtgacttgctctttggaaattcctgagataagtctttattgcaactattatttaatgatgagcataataattaaaggctcattcttgaaatagtatcagtgccaggatctggatggtcctgcagcatttcagattacagaacatggccactggtggatgcctcagctcaagattctctctgcctttcttttgacaatgtgaggccaaggccaagtccaaggcaagcatgtgcttagactggtgttccctagtacactgttatagaagccaccagctgatgggctttgtaaaaggtgtggtcaaaactggctgggtgaagttagtactctaccatttgaggcacaatgcccacaagggtataaagtatcagaaattgtacagtaaaggcacctgtttaactttatttaatatagcatttaaaaaaattatttgagtaccaaaacactttttgtggccatgtggtacatctattaatattctgtggagcagtgttctatgagataccagtttgggaaatattagctagacctgtgcttttcattcctagctctattacagaatcgcctgggggcttaaaaagtatatcaattctggcccactgcccaacattttttaaattggtctggggtgacatccaggtattggtattattttcaaaggctcccttccctagccaagtctaatgtccagccagagctgagagccactgacagaagcctctcacttatgcatcccaattatcccctttctaatgcatagagtcatagtgagtaagaaaaaaaaaaaaaagctctccaaagctctgatgtgtctgagaaagaagcttttcctggggtcagatctggatctactcactgatcttggagttttagctgatatgtggatttgcctgttcatggacttacttcctatcacacttccttctccttggtggttgtcattttcagcaggaagggacaggctgcctgctccacccagaacctttcctgaaaacctacacctgccactataccaactttatgtaaatgactaatagcgcttcctcacaaaaaatgatgagaacctctgttgtaggtaaacattccaagactttatctacaatttatgaaagcctttctcccattgagctggcaggtcctggaagccccagaaatgtccatatcattagtgcagtttccctgggaagtgggagctggggaagaagcctgggaggtggagcctcagaaagctgtgtctaatgcagatttctagctttaaatttgttccttgtgtctgagattttctagagttttactggaagagaaaacccatttctcctcccctttaaataagaaacaaaaatttactgattaagcaagaccaaagagaaaaatgagatgactttatagactcattttataatattctaaacaaatgagattcatcttatttaagagtacaggagaaacaggcatttaatatttattgagcatctacaatgtgctaggatacatacaggttttttcatatttccatcttatttaatcctgacacaaccccttgaggtgattcttctgttctcatttttgtgactgtggaaagggaagcccaaaggggttaaggtgttgcctacagtgggacgtgagacagagctgggacttgaacccacgtctagtgatggtgatggccaaaccagagccagatgagccagttccccacctctgcagcgctcaccacgagaaaaagaatgtgaaaaactccagcctgagatcagtgacctgttgagagctcaggtttttcatccggcctgcatcgtgactctcagtgtatttcatatcatctccaaaatagtatctgaattttatacgcatattctcttcaatgttctactctgggctttgaaacagaagaagggttaatgctgtggtgaaatgtggcctgtcctgctccctgggttcttctttcattactcaaaaaatacgtaggtttcagggtagactcttataatggtaacaacatgagctttggattagacctggatttaaatcttatactgtgattactaattctgtgaccttccgtgacttattttacctccttaggcttcagtcttttcatccataaaatgaggtaataataacatttgtctcatagagttgtgaataaacaagattataactcaggtctcctgaatttactttccattagacgcatatacccaaacatgtaaaagatcgaaatgtttcacagctttccaaggcttatcatctgtgaagctcaggtagatttgcaagttcgggtttatttatcaattcattaattcagtcatcaatgtattgctttagtcattcaacaaatgttttattgagtgcctactatgtgtcaggcattttgttagtcaccggagataatagcaattttcaagtagcttagagtctaactaaggcaaatctgactgtatcattatttatacccattagaggttcacaggaatgatattcactcactaatttgttaatgcgagtctgcagaattaacatgcatgtaatagtattcaatctaagttaatatgtttgcccattgttgattatcataactgttagttatagttaatttccaatctgtctagctctctggaaaagcaaaaagcaccttccctccattttgctgctctgaactgggaaagagcagatgcccaggtgaatggcagtgaagaacgtatattcagtgagctcttacaaatcaaactgtttgccctgaattaggctcaagtccacaactaatgacaactaatgtatggattcctggcattgaagcatttggagtttaactgtttgttgtcattgaaagtgaatgcctttccaacatgtagcctgaagtgctgagagggcagatcctcagctaggaccgaatgtcagtaatttaatcatttattttttcttgtctgttttatgacatgttcttttcagagcattccctagttgctttgattcacatatacattccatcaatattaattttctgtgttatagtaacaacaaaagagtaaaaccagaaagaggaaaaccttatttttccctatgaatagcccaggtccacatgaaggagaaattagagtagacaggtggcactgcagcctgttattcaaggcccaggcaaccctgactagttccttcgttctctcctttgcttttttctgaggaagaaaaatcagcctgaagagtcaagcagaatgacgaactttttaagggcaagataattcacaggatcagttagtgatagagtaactttggggacttgctttgcatttagaatacccaccctatatggcatgttagtcctagcagagagaggcttgcttccacaccaaaagccctaattcactttccacggaggccctccccatccctcagcagcacttccctttatcaggcagataagattgggggggccaacatctatcttgtatgcatcctatgacactgcagatgaaaactacctgccctggtgtggtgtcacattttttacatttgatttttatggatgaaagcattgcttcatctgatacttataaaataccacatttgccactgagaggcttctgtgtccaaatatctgccccgccccccatgtctaatcttgatcttcacagctgaggcccatctggatcatcctcctttccagctgacagtgagagagccaatgaaatgccttttcctgttgctgggtgactgcgaatattttgaaaacaagttccttaaaggcagcagcttcaaagcctgccattggctggctaggcatactgtgcaatgctgacgcatgaaggctggcagaggagtgacagttgggaagagctacgcaaatatattactggcctgatggtccactggagggaaagactatttcaaggctgagtgacaactataacataccctgtcagaagaaaaataaatctccctgagtctacattcaggcatctgaagaacattgcagaaaatactgcagacaaaaaaaatgcaaaaacaaaaaacaaaaaacaaaaaaactcaaggttgtcctaccctcagatctcctgctttttatggtctgatgagcagttcttcctgttcaagaaatatatgggtatttccacatactttggtagaatttgtgttcatacattttaaagcccaagcttgtttatttggaaaataattttcaacaaagtcatggaagattttctttgcttccttgtctccagcgtcccttccttcaccttcctcccctgaccttcaagtccaaaaatccagcaggcacagtatgcggtcagtgtcaggggcagcattggctgcattttatctcactctgtccacttaaaatatttgcatcctggtgggaggataagcacagtcctgtctaaacagccttggggttcagctttgcagctggagagagctgtttggatacaagtaactgcttttgctaacaccgggttaactgttcacacacaaatctgccaacgagcctctaggaaggaatgtccttctactaattgaattctaatgaggccaggaagtagattaggaattgagctattttactatgagtttcaaatatcagatctagggatgtttggcctgtctgatctccttaattctccagcaggtcccaataaattcatgaagaaatgactagaagaaatctgtgggttattggttgatccagttgcagggggcttttctatatatcagagactacagtgttcaaacacaagagaaagaggctgatctgagatgacctgatgggctagtcattagtgaggagttcctggaccaatttaattggcatgtccctggaagttatatttatttgccttataatatttgggtaagtttgagagccaaatcagggtgagcatcagtggggtcacccctgattctacttagttgtggaaatagaaatgctttaaggacatagtagaacattcttttcaataatgctatatagccaacatcacttgtggaaccacttcagcagacagagcgatcacttgtgggtgtcacccagtttctagacattacgaagaggctcttgtgagcatcttgcctgtatcccaggaaatgcctgcctgccataaaagagggcatggggtcatgcaaaagttacctgcatgtactgtgaaggacagctatgataccatccaccaggtacctctttcctttctagaactggccctccttctgctgcgaccccatgtttccacctggatttgatttttccaactgacacactttcctaagcacacactcctcatcacagttgactggtccagggatggacaggggaaccaagtgggccaagcggaccaatcagaaaatgtccctgatattttccaaactggaacttgggactccatagttcccttctagaaggggttgctgaaagatgagaaacccaggctctgccagaggccacttttacccctttgtagagcaagccagtctgcagtgagtacccaagggctccatgtgcaatgtgaggcttttcatatttggcccaaggggccacctgggtgcttagtggagagtcacagcagccagccccaggaatcaccaagtggctctgagggtagcagatggttttgcaggagcccattctgtggggcagggtttccttttggtgtgcactacgctctcatttgtaacacttcctgggaagactttgggcttttacatactatatagaggaaggagattttacatctgggaccttggggccatttcaaccctgccttcccactaatgaatttaccacacaataagagaaagagttcctgttgggagagaagcttgtttgcaccccaggtcagacagggccactgctaacactagaatagtgggcccctggtctttcaggggttatcaaaataaccagcttttgccctcacacacaactcctcagagaaccggagtaaagctgttttcaagaagaccactgatggtttaaaagatatttcaggcagaagcataaatttcttcatggttttaaagggaaagaaattccctttaaattcatattggagaaatgtcatcacagaaagcctctcactctcttctcgttcatttctgaattctaaatcttttctgttggtggtgaggggaagagtaaaaagtggttttcctcaaaagccagcttcagtggtttacggagttgtttgacaaacttaagcccaagtgttgaggacggccacctgttcccacagaaatcacaaagcttggttttcacagaactcgtctccatctccaggaaggccagaggtgaattatagtatgtgttaggaaaatgaacctagtagcaagaggaatgggatcactcagcacaggaattgtttgaaatttgccctttggagaaaataagtgctgttagcgcccacaaacatgtcccttgaagttgatattctagaatgttgaaggctaaggaatcatacctgctcaagcaatggggctggattacttttcaaactatgtaaccttaaaacaaacaaacgaacacataaacaaaccaaaacattcttagcaaggtctgttgaaacctgaacccatctatcgagaaagtaaaccaagattattcaagggctcacaatcagacgataaggagggtcaagccaagacgagaagaatctcaaacaaaacgcattccatgacatttcaaaaaggatcttacaaattcagcatgcccacccatatctcaatttcttaatgtgtgcaatgtagttacctgggcgtttctctttgtacctcagttttatcatctgtaaaataagaaaaataatagtagggtttttgtgaagactaaataaattaatacaggtaaggcaccaaaaactggcctggcagctggtaaaatgttcagtaaatgtttattttccagatgactgtcacatggagtagactgagcatatactggggcccaagaaaagggcctcagcagcatgaaccaaggtctccaaactggcagtgtaacatctctcttagctgcctgatccttaaatgggatagagccgctgatgcctccttcagaggcttgctgttaacattcaatgaaataagagctatgaaagcacttagaatcagcaaaaatgctgtggttatcatagcatttgtcttagtgaacagcaatatttgaaaatgtataatgattggtatcatgttatcctacagaaagcccaggaaatgtattttaaagtccgtccacttgtagatgcttaacaacagaacagtatttaagcctcttatccctggataggttgaacagagcctcgctgtaagttcttaccagcccttctcagactctcacctttcgtgggtgtggatttgattatagtgagtgtaaagaagtacctgtggatgctgctctgggaaggctttcagagccagtatgaggccagatgctggggcccccagcctggggggatgaggtgaaatctgttttgaacttagatcccttctaccatgtggtcttatagaaacgattctagagttttctgttacagtgggactgtaacagacttgcagtttttattaaaattctgacttgttcacagcctaattccttttagtctcaatgaaatgctttaggccctggatggaaacatcatcctgaattacatgacagtcttagaatattctctgtggaggcaaggcacggtggctcactcctgtaatcctgtaatcccagcactttcggaggccgaagtgggtggatcacaaggtcaggagatcgagaccatcctggctaacacggtgaaaccccatctctactaaaaaaaaaaaaaaattagccaggcatggtggcaggcgcctgtagtcccagctactcgggaggctgaggcaggagaatagcatgaacccgggatgcggagcttgcagtgagccgagatggcgccattgcactccagcctgggtgagagtgcaagactccgtctcaaaaaaaaaaaaaaaaaaaaaaagaatattcaaagaacattctctgtggctatcaaatccaaagacagaaaaatcctgcacagatgttgtgtattgactatagatgttctgatatctggctaaggtggtgtctttgtgaacgttatgaattgcttctagggaagcgaaaagcacctcaacagagctaccatttcaccaacatgcagtattctggggaaaaggaagagaaggagtgcctgatggctctatcagctctggcaaggaaatgaatgcattgaaggaatagagtgcaggcacacagacagcgaggctcaaatctcctggctgcatgcatgctgcaattacacaccacaataaaaagaattaatgtagcatctgacctgctgacctccagatgcctactgcaccacctcatcaacaatccccagacctccacggtgcctccttggccacccgccggctgcctcactgggatacagcaagcacaagggccttacacaggctttgttcttaaggctaaaccaaaggggagagtcccccagtccctccacctcgtgcctgggcaaatgaataagctgtccatgtcactaacatattccaggtcatgcgtacacacaaacattattatatctcgatattacttttaaattactgtctctggggttttagccattttcctagaaatgtggctcagcaaatccttacgtggagcaaggatggcacccagtggccaaagtgcttcatctcagaccctgttttctcagggattttccatttgcttctctctttggagacaatgaattgccatgagatccttttgtaaagccagagttgaaactccaaatcatatgactatcccgttaagttggagcacgtgcacacacacacacacacacacacacacacgcacacacaaatggaaacagtatcaggagctaattcagaatagctaaaatttctgaaaaatctttaaaatttaccttgagagttttatgttaaaatcatcatatttcagatgtgcagattaccatccatgatgttcccaatatcaagtatcactataggaaatattataaaaaatgcaagcccagtctcacattcttcacttcatattcccccaaatagtctctagttcataagtgctcatgccttaaacataagactttatcacctgacaagtgctttatcatgaaactgatgtttgcaatctcatatccttgttatctttcgtacaaggtacttggcaggcctggagagcacaggataatagagtgggactactctttttcctttgagctttccagatgtcaagagattttgatacagctagatagccaatcagactgtaaggaagacaggcgagatgtcagaataatgaaccatatactctcttgctaagaatgatgcaatgtctccataatgtttctgtttccaatttccttaggttcccaagtaatctaaaaccccagggcaaaaagtcacatggatagtacaaccacaatacaaaaagaagtttctaataaaacaacattacgtattaattgcccaaagagtaccataaacagtcttactaaaagtcaatatgttgagttcagccaacaattctgtctttctcagacgtcattaccattcatgcttatttgacccccaaaatgtcaaaatgccaccaagatttcaagaataatagctgaatcaaaagaaatgacttaaaaatgaaactccatgacattgcttccattttcctactccgccacttgaagaacagcattgtcttcaggaacagacaaaacattgcagaagaaaaaccaaagcagaggggttccatttttcttgctggttctttgatccttagttgccttctacataaaatggagatatgctaaccctgccctcaccaagactttgtgagcctcaagtgagataatggacatgtacctgtttttatacactgcaatttcttagtacttaagacatttttcttatttaaacatttataggtagcattagtgtatagtttttatactgatgagattgagactcttgttttacccacgtaatcacacatcttcctcatgagtattattatattatattacctttcaaatataatatagtcatgggggctttggaaattacttatatgtaattaaatcaagctgagctatcttgaacagagcttgaattaaaaaatttgagtatgcgaaaatcataaaaacccctaaatgttttgtcaacatttatgttgttttatgttttattttcccctttcttcctagagataaattttataggttcataaaattatagcattttttagctagagatggctttgttttgcagatgaggaaacctggagcctagaaattgaaattaaccaaaaggtctggtggttactttgtctttttatacacttgcttgctcttgtcttactgtgtccatggtcttacaaagactgttaaaagggcagatctggctacagagactgcagaaaacccttcagccagacattgtctcctaacttcctatttcatagggtgtcttgagaccaagagaattatgattcacaaacacttaaaagattttggatgaatccatttccaaatgaggaaaaataggaagaacagccaaaccagagcatgatttcaaaaacaggaaagacagactatagaactatataaaatagtaaatacaaatacaaataacaaagcattaggtgttttgaaggtcaaaaaaataggtttaaaaaaatttagtcagcagggtggtggtaggaggatacatgaatgaagaaacgtatttagtagtaaagagattgctgaatcaactaagagttaaagggcaaggggcttttgcctccagcggggaagagagacactatcattacagcacactccaaagaggataggagtacctatcctaaacaaagaaaacgaatccctttattttcatatagtttagggtgcacaggacaacaaccaggaacataaaaacaaggggtttcaaacagcataaagcaaggattggggtgaaattgtcagaaatttccatcgtcataggtccctgcttcaaaattccacccaagcattataagttcttttgccataaaaatggcgaacatttcaaggaatttggtcacaaggtagaaatttctccagcacccaggtgcaaggcatggctttaggtgatataagggttaccaaatgagtaagtcaaggattctctcctaaaaatgcaactgctttaatcatttgagtagacaggtgcaccaagatttatattgcaaggtagaaagtgatgaatatggtaggaagaaaggcaaatgagaaggtcacttttgactgaaggacagcaggaatgacttcatggagaaaggggcagttgagaagggtcaggtagattgttagcgatttatatatacagatagggagaaggatgggtgcaaacatataaaaggacagggaatgggcagaaaacaccaagtagaactatttggttaaggatagctcagtgggagcatgggaaacaggctggaaaagtgagctgaaagttagagtttggaatacttttaatgtccaattaaataattcgaattgaaagaatctagaggcttctagaagatactaaactttgtgagctggaacctacaccaacagaagagttcatctgttcatctgttagctgtgcacaggatggatctcggatagggtcaacagcaggaggcgggaacccagctaggaaagcagtgtacaataatggcctgcctgaaggagaatgaggatctgaactagtgagggctgtgaggatggacaggagcaggagatgtttggaaggcagaatggacgggactgcatgtgggggcgggcagtgatgaggaccccatgatgactgtacaatgatagccaaagtgtgcaactggagattgagggctacagaagcccaacagccaggaggtcgtagctctgtgcacactgaacgaacagtagagggaaggccacccattgtgatggctaacccaagcccctctcactgaagtgagggactacgtgttcttcatttcctggcgtcacagctagagttatcaatggatctaattagaggaaaactaaaaagaagataaagtgatacagtcccagatgcgctagtgttctggaaggttctgatgactttaacctctccagttcccttcacagttcaggagtcagggatctcactgggccacactgttgctctccactggaccttcaggacttgtcgccgctttgttcctagcgctctgaaacaaaaatgagccctcctttgtttcactgcctcaagttcagacttcctgcgccttcccgtgtgacacttagggaatgcagtgaattctgctgtgctaacatgggggagggagaaggtgggagaaaatcctccaggcccgctcttcctcccagggaaaggagatgctcacagtgatcttctggggagagtgtcctcgctttgttttcaaatagaaagaagtgacaaatagtggctgctgaagttgatgtgaggggaggtcagggtcaccacaggatgtattttggtcaggcgggtccttgaagggccctcaatacctagccgcttagctcagcaggagggaagacgagcctgggcttgcagatctggttcccctcatgctcagcacccactcccccgccctccgccactatcttcaatactcaagagtgacaaagtacaaccatcctttttctgatgtggcatttgattaagacacaattcatacagacagccggacatttgaacgcgaagcactccgcatatttatggatgcgtcctgagcagtgcaagccgcccggctcggctgctgcttgtgagcaggagatgccctttagggtgctgatgcagctgtttcctctgcagtcaatttcctggtgaaggttcaataactttctctgacgataaaaaaaaaactcggatattaaacttgacataaatactatttaaagtcaaaacaacttcctaaattccaaaggcgggcacagaagaggagacagcataggctaggtaacgaattccttctatatagcttcgaggtaatcttttaaacaaccttagaaatgacccgagatgcactggaaagccactgttgggatttcagaaggtagcatttcaggaaggccatgagaactgagactgtagataaacaagacaaagctcctgccctctttctggtacccagaagtcctgctttatccccggctgtggaggagcctctatgggtcatctgccctgagggggaggagctggaggtgcccctaccgatggggtgggtagtaagctcccggcctctgccaccccgctgctgtccatgggactcaggtctacccctcttcctcttcggcgttctctgtgtcgcctgagtttgggtaaatgccatggtgttaccctctgtctgcatagtgcactccgcctctgcaaggggctgctgcaagaattgggctcttccagggcttcggaaattgattgcacagggcggtggctagcgcgtgtagtgcctttgtggcaattggagaaaggagcgccacctggtggatcaactactaaaaggcactccatgcacttggccagccaagagaaggggggcagccctgcacccgcctgctgtgcaaggggccctagtgcagggcataaggcagacacatctcctggcatagctgtaaaggcagtcttgagggctgaagcttcttattatacactatttcatggattaaagtgtcttatcaaatctaattttttttaagcctagtaaatcacatcctattgctcagtctgcaaaggaggtcataagatcctatttttgatgcagtcattcttatttcagtatataaatgccacaaggagtacctattcttggtactttattttattttattttatttactaggatattaatttgtggcctagtcattaacattgaaaacttgaaatatgtatgaggtagtccaaacccaaaccccaacctgagttactggtgcttaattactgaggcagttacagtgctgtaaatgagttcatctctgattgcagccgtaacccatgcagtgctcaattgaaggaagggatgatacaaggtggcaatataacaccacaacatccatgagttgattttaattggtaaactggcaatatatagtgagaattgtttggtctgtccaccgcattgcaatttaaggaaagtccataaaattacaggagcatataattggggtactaaactcattttcttatgttatcacagctggcatctttaggttattgaaagcctttaaaccagccatcttcaaggagatgtaattgtcaatgtggtctttatacattattcctgttagcacagagctgcagagataaaaacagtcactaaaatatgcacaaattttctgtatataactttcttatttcaagttcatggaagatcagtaaatgttaatgaggattaaaaaccattttttagatcctggtttcctcattagatgcacagggcaatcaacccataaaggataatttattgatactacaacctgaatcagacttttgaaatagttaattcattagttccaggaagttctgtgatctttttgtgtataggtgaagctgcaagaaagactgtttcttgaagtataaatgatatatcagaatcaggaaaaataaacccaaattctgacattcttggatgagtaattatatgttgttttatctatttattctggctgcacagtccaaggacacttctagaaaggttttcacactctaatcccattctcccacccatcactactacatgctcctcaaggaaatttttcccaacagaagtaatagggttatcagaacaaaacagaacaacaacactctccctaacaaggcattctagaatagggggagaaaatcccaaaacataaaggagtatgaaacagaaagaccagatatgaggaagggtaagatggcatcagcctagcattaatgattattaaaagattcactacaggtttatcttatgtgaaatcaatcttcctttaggccccacaatctctgagtacaaatggtacaaactaagagtaattaatggtgtatatatcacattctccaatagtacagagtctccatctctcctacttatttttgggagtcctcagggtgtaccttacctgccttaaaatgtgaccactgagcctgcattgattccatcgatgccatcagcttctgctggtcacacaggtaggaaggggccctgccacgggtccgtagtgatgcttccttcattaggctgctgccttctgttagcacactgacccattctatcgggagcatttgatgcactgaaaccataccaaagctcatgccttctgtgtttactcacgttctgagctgagaacatggatccatgggaggctgaggtgagggataaatccaaggtacaaactacatgctgaacttggaatcatctagacactgaggtccatggccttaactttcatgaggaagagttcttgactcagaaggcctgttagtctctcatgtaaataactacaactagcttgtctcccagacatttctgcatcccagatgtggtgcaacttgggttccaactgaagtctgtcatatttacgtatgtaaaatttgacctccagatttttgtcagcattggatgaatcagtttcttcccaaactctggcttaagctctgaatcactgatcactagtctggtcgggtataatccaatacactgggactcagccatcctttaactcagtggtctccatgctttttggcgccagggaccagtttcatggaagacaatttttccatggacctgggaggggtgggggtgtgggaatggttttggaataaaattgttctacctcatatcatcaggcattggattctcataaggagcacgcaacctagatccctcacatgtgcagttcacaatagggtttgcactcctatgagaatctaatgccactgctgatctgacaggaggcggagctcaggtggtaatatttgcacgcctgctgctcacctcctgctgtgtggcctggtaccagtccatgggctgggttaaggaccccttctttaactcatgaaatctcacggataactgattccagacttcaaatcattgcacacttaaaaaaacttttttacaatcatgtttgttaaaaaagtactgcaggtaggaagaatgacaatacacttgaacgtaaacatggtttgtcatatatattggtcaaaacaaagcatgtatttactattatttagctacaatgttagaaaactgccattgcacatactccagcctggaatttcagtaaacgcttttcactgtctatgtgcaggattatgttaagcccactacattttaatgttattgctgcagttataacagacatcaactaccaattagaataatgttttatttactgtctatatcaagaaaaatcccattttaaaatggttaaaatgatctactatatctcagttacattgtaataggatactagctaatatctgtcatgataaaatctggagtaaatcagttaaattattaatcttgataattttaagataaaataaccctttgttctcaaatttaaaaacttcatattttaatatatttgtgagctaacaatagaaatgcataccaaattccaggacaatgttttctttaagcaaaaaattaagcctgaatgttggtgcctttagaaagtaaacagctaggccaggcatggtggctcatgcctgtaatcccagaatttcgggaggctgaggcaggcagaccacaaggtcaggagttcgggaccaacctgaccaacatggtgaaaccccgtctctactaaaaatacaaaaattagcagggcatggtgatgcgcgcctgtaatccctgctacttgggaggctgaagcaggagaatcacttgaacccgggaggtggaggttgcagtaagctgagactgtgccactgcattccagcctgggtgacaaagagcaagactctgtctcaaaaaaaaaaagtaaacaactatggattttggcctgctatatctctgggcagctcttgcagtcatatctagtcatatgagtcaaagctcatattatcatctttgctgtctttcttcttgcctaccccaccctcttttagcaatgatgataattataacaacagcaaaaatataatataaacattacattagcattttagcaggaactggatattttcataaataggattcctaaataattgaactttattggctaacattaaaaagcttaaatatttttgatggaaaatgtataaaatttacatacattaagtaaaatttatatgaaatatataaaataattatatattatcaccgttttaaaattttcttaatgaccaactgcttcgagttctagaaccattggtgctcttcagatgtatttattcattcacttttccattcattcattcatccattcaacaagtatctattgagtgttactatgtcccaaggaccaaaaaaggcaggagagatacagcagtgaataaaacacaattagtgctgtcctgatggagcttgagttcaagctggtatgcaggatgttttcctctgcaacaaatgggccctgactgctgtggttttagttgttctgtctcctccctctgctgtcagctgtcacctcttggtggcaccctatctctccctttttatctgggttacaattgcaggtctttccccaaagcatctctctatgtcaataatagaccctatccttggatggagcctgagcagttcctatgcttgcagtgtatgtgctgcttccggcccttgcgaggagttcttttatccctactctcagtgtttggaacaaacatcttcctttgctccctttcatcattcatgcgcttgtgtttggaacaaacatcttcctttgctccctttcatcattcatgcgcttgtgtttggaacaaacatcttcctttgctcccttttgtcattcaagtgctcagttctaatgatctgattcaattcttaggcccaatggtctctgcaccatatatatgcaaatgggactcttagaaaagtgtccatcaccaagtgatattacattctaatattgcagtataaaacatgatctttctcatcactgtggtagcttttcctgataattttctgaactgccacctaaatataaaaaggcaggcaccaaaactttcaaaaggaaaggaaatcaatttccctttactcccgtgttttgctcattgctaaaactgcctggtaggagtgcagggacacaagcaggaattctgaattgcacttaaggaaatggtagtaactaaggtgataaggaatatctaacactcattcatagactcatcagatgttggagttgaaaggggatcactctgtgcggtagtgaagcatggtggttaagaactccagttctgggaccagattgtcatacgtcttacaattgtttgaccttggcctggcatctccatgcttcaatttattcatctgtaaaatagtatgtttttcacaggattgtgaggattaaatgaattaatgcaggtaaaacgcttggtagtgtgtctggcacacagcaagcacttagtgttagctattattatcccaatctcgtcacatatttttacagatggaaatacagccctaagcttttaactgaacagcaagttagaggtaaaactgatgccaaaaccgggtgtcctgattctcaccatattatagacttttttttccctgatatcgtgctttcttaataaatgggaagaaatactgaatcatgtacatgattataaaatgactactcagttatacaaaagtccttcttcccctctaaaacagaaatataaaaatacacctttgcccagtgctagtcctccagctcccaatgggcaggattaattctctagaggcatgtgacagagctcaggaggccaggagaagtttaactgtatgcactaataaggaaaccattttcttccttaccttaaacttgtcaacttcagcttttgaacatgttgcatggtatgatagcacctgattcagaagaaaaaaaaataattttaataactagacatgactgtattttctgaaattctcctggcttaaaaataagctttgcttatgtatatcaccttgatttaaaggtggactttaatgtatgacaagaaacaacatgtctaataacattctctgacataattcacatattaaagaatattttataccgggatttttctatgggtagttatgtcatcaaaaggacaatggccaggtgcagtgcttcgcgcctgtaatcccagcatttgggagggcaagatgggcagatcacttgagcccaggaatttgagaccagcctgggcaacatggcgaaaccttgtctctacaaaaaattcaaaaactagctgggcatggtggtgtgtgtctgtagtcccagctattcagggaggctgagatgggaggatcacctgagcccaggaggtcgaggctgcagtgagctgagatcatgccactgcactccagcctgggcgacagagtaagaccctatcaaaaaaaaaaaaaaaaaaaaaaaggcatgctgtggctcaaaactgtagttcccaaaggatgtgaatacttgtcctgtgaaatgctctacaagcaaatgaaaagctagagcatgtgtgtgcgatctgtagcaaacactgtaggttgatgactcaacttccatttcctcacctattctcatttgcctgcttttattatattaggaaagattatattgatatatatctgtgaccccttttgtaagaggattgtgcttccctgccctattgacatcagcattggcatatgacttcttttggtcaatgggaaaagtaacaaatgcccttttgagtgtgtcttcaacagcaatcacatagttctgccacctcctttttccctccaccaagggaagggcatggcctgagaggggccgatccttcagtctgagcccccaaataaagaagatatattgagtagaactgcagccaacctgcagctgatggcatgtcatttgagtgagaatcaacttttgcaatttatctacatcataactcactgacacagaggcttaaaagttaaaaaccccaattcgcaggctccctgcagctggggtggtcctatagggtggcctttatgacacggccttggtcaatgaattataagtgggagtgtcggcgctgcttctttctttttcttccttcatggaatacagctgtaaagcctggaggtgcagcaaaatctggtgtgtatgaggtgacaagcatggcagtgaatgccagcttgctgtgaacagaacagaaagggaaagagaaaggaccctgggctcccctgccccagaattcttgttgtgtgagacaaataaatgcacattggtggcattttataaggcatatttacagacatatacacactcacacataaatagcatatgtatgttatatgttttatgctgccagacacatgtttgttgtggttttgtttttgagacaggtctcactctattgcacaggctagagtgcagtagtgtgatcatagctcactgaagccttgacctcctgagctcaagcgattctctcacctcagcatcccaagtagctgcgaccacaggcatacaccactatgctcaactaatttttgtattgttttgtagagacaggtgtctcatcatgttttccaggctggtctgaaactcctgggttcaagcgatcctcccgcctcagcctcccaaagtgctgggattataggcatgagccttcgcacccagcctacattcttaatctacacaaatctcaaacaaataagtctgggaaatgctaactccttcttcacctacaaaccttagagaatcacagtgcatatttggctgcaaaaagtaaagtaacatgctttatttcattaaacttagtatttcccaaatttaattagccacagaactcccttttaggtaacattaaactggtaacattcaacctaataacctattgaccaagaactttgagaagcactgacctatggcacataccatttgtgtgatacaagcaaagccacaatggaagcagtgtctcagggtggttagaacacagccttcagagtcaggctgccacgcctccacttccgagccctgggagcttgggcaagtggtttaatctctttgggtctcatttataaggtggtataacataatactacacaggcatctcctgcttaacgtagaggctcctcctgaaaacactaacaaggagtctacttttaattatttttaattggaaaaaaattacagtgtattataagatctgcagcaacttcttaaaactcaactaaagcacagtaaaattcataggtatatttaaaacaaaaaatacagttatgttatagttacttaaaatgttactttctgtgggaggctgaggcgggcagatcacctgaggtgaggagttcaataccagcctggccaacatgatgaaaccccacctctacaaaaatagaaaaattagctgggcatgatgatgggtgcctgtaatcccagctacttgggaggctgaggcgggagaatcgcttgaacccgggaggcggaggttgcagtgagccgagatcgtgccattgcactacagtctgggtgacagagtgagactctgtctcaataaataaataaataaataaataaataaaaataatgctactttctgatcataactaatatagttattaacaaaaagtttctttgtgttaagtaatactttctcttccattgtagacttttttttactgagtttacttgtttttccatagttttctcaatccttttttatctttgggaggggactcagaaaaatgttgtattgagagataaatatgttctatgaggtttggttattaaaaataaagatatattctactgggaaattttaaccaaggaaatattctatggagtgggcctgtactttacagagttcttaggaagattaaatgcaatactacatgtaaaataatgtggcacacaaatagccaacttataggtattgtattaatattcaattaaaattctaccaaataaatatttggctggatattatgttatgtcattatcttatcttaaaatatcaataggtatttcagtgcacagatgaattgattttgctcttttgtttcagttttactgtggtaaaatttaatttggctgtcattttattagaatttcttactgttttcaagtctatttctgcagattcactcttcaaactttacctttaaaaaataacccacaaaaactcaagctgcaattcaaaatctatgccaccaggtggtgcttagttaggtttgtttaaatcaactcttcccacttcctttatttaaaaaaaaaaaaaagctatttactccactaaattgaaacaatttgaaacagtgaagcagacaattattacagattaagacttttgctcatttaaaattacaatagtttgttttgtttgttattgagttgtaggagttctttgtatattttggattcaagtcctctgtcagacatatgtttcataaatattacctccagtctatggcttgtctattaattttcttttaatgtgtcttttaataaacagaagttttaaattttgataaagtgtaatttgtcaattatttaaattgctatcgtttcacatattatttctttctttttttttgaagagtctcactctatcactcaggctggagtacagtggcatgatttcagctcactgcagccttgacctccctggctcaagtgatcctcccacctcagcctcccaagtagctgggattacaggaacacaccaccacgcccaggtaatttttttatagaaacagggtttcactatgtggcccaggctggtcttgaactcctggattcaaacaattctccctcccaaagtgttgtgattacaggcatgagccactgtgctcaatctcacatatcctttctaaaatttttttactgcccccgagttgtgaatatatacctcatgctgtcttctacaaactttatagttttatcttttatgtttaggtctatgatacatctgaaattaaatgtatgtacagttaaagaataagaccttaacgaaataaatacatgctttggttactttttcatgattcttaaatttcatgggccacatcttagacctaaagcttttttggattgtatcctgagattttaagcctctactggctaatctattaagtacataggaatttatttattctacctaattagacaaagttaatgataaggaagcttctggtttaccttctggatcttcttgtttctgagagttcctgtttgtaggactccaagaaccagtagaggggggagagaaatggtctagctaaagaatctttcaactaccttttcccagaagagtacaatccatgttggtgagcagggaggaatcatcggctaataggagtacattgttctgaaggactgggccctattgctaaaccacagtccaggaagatggtagcattgttccctctaagaatccgtagaaaaaccaacaagccagaggagtggattccttaagataagagacccttaaatcttgcttaagaactctgattttcttctttaagcagttccttctgtttggtcccataggattttctgggatgcattcagaaagatggtggtgcttcagtttaccctcagtgtttgcaggttttacacacagggcacagcgagaacccagtaatatctgtacctctttcatgtattgtatcaatttagccatcatgcgattctgactggatgtaaatacacaaccaagctaagtttctgcttagctcccagcttcttgttgaaaagcctgtgaccaaatgtatttgccttgctaattttaacaagcatctacacatgctattgtggtcacataggacttttccccatcacctatggtcactggccatatcccatttactcctcaatatgcctcagttttggttctgcccccacctctccactggaacagctcgtgtcaaggctttcaatttcttgccaacaaatccattgatgaatctccaattgccttttgcagcagtattaaacttgggagagcactcactcctattttgaaaagtctcctttctgggcttccatgacaccacattattttggttttcatcctatttctttggctgctctttatgttttcttttttggcccctcatcctctaccttaactgtaaatgtggaagcttctaggctcagtctcttcttcagtgatgccatacactctcatggctttatacaccatcgttgtgttgataactttcaaatctctttgagttttgcactcacatattcgtctgcctacattactaacttccaacttggtcaattcactggcttttcaaatttaacacgtctaaataaacatgaagattttcccatatgtgatagacagaataatgctcccccacaagatgtccatgtcctaatcactggaatctgtgtatatgatatgtcacaaggaggaactgaggttgcagatggaattaagattgctaatcttgtcaccttgagatggattatcttggattatctggctttgcttcatgtaatcacaggggtccttataagtgaaagaaggagacaggagaatgagagtgatgcaatgtaagaaagacttgactagccattgctaactttgaaatggaaggggccacgagcacagaatgcaggtaggttttctgtggaaaaggcaaggaaatggattgtcccctagagtctccagaagaatgtagccttacatacatcttgaattttgcccagtaagacccatttcagacatctgacctgaggattgtaagataataagtatgtgttgttttaatccactaagatcgtggtaattcgttacagcagccacaggaaactaatataccacacaaacccatttctctctcagtcttccccagctctgtaagtgccactccatccaatcaattagtatcaattggatactaatccagtctccttggtacacatcagccagagtgatctttaaaaagtagaaatcaaatcatgccatctcccagctgaaaagtcaccagtggcttcccactgcacttttgctgtatttccttcaatggcatccacagattggtcacaaatctcaggttcatgaggttaggtccaaagcctggatcgtgactggacaggtcctgcaccatctgactgttggcacgttctcaaactaaacttcgtgctgcctgtgctctgtcttctacacacttggccacactcatttttgttcatttttgttcatttatacaccaagcgcttttctacctcagagcttccctgtcctcatcacctcattggtatcatcttctgaaactaagttaaatgtcaccccttcagtgacttattccctgaccaccatgagaaatcagcctctgttaactccattattctctgagttaagtggctgtttccttcatgccacttgcacaattggagttgcctgttatcttattcatcacctgcctcccctactagactgtaagcactttgaaggcaaggattggtctagttttggtcatgaaggtatatcctatccctgggagtatggttgatacttagttggcacttagtaaatatttaatgaatcaaggaataaaaaataaaaacattttaaaacagtatctccattacccatatgtctcactgtttgtattattaatggcctgaattagtgtatttttttcaatgaaatcatgatatgccttatatatgagcataaagtaagcaatgtaggtaggatcaccagttttagcaaataaaaatagaggacacccacagttaaacttgaatttcagatcagcaataaatattttcactatttgtgtcatatgcatacttaaaattgatttatggtttatctgaaattcaaatgtacttaagtgtcctgtattttatctggcaaccctccttctacatgctccaaattaagaaggctagaaacaaatccggaaaacgctaagctacatgccaaaatactgtttctcctttcacccccacctcacaacatctcccaatgacatttcttccaaaatattttatctgctaagcttaccaaatgcctcaagtctgaaatattttcagcaatgctactattatgaggggaattgtgccccccaatccccaccaattcatttattgaatttctaattcccaggacatcagaatatgactgtatttggagacagggcctttgaagaggtacttaaggtaaaatgaggtcatgtgggatgtgggtgtgtcctaatccaatatgactggggtccttacaagaagaggagttcggaatatgaataacagaaatagaagaccaggtgaggacacagagagaaggtggccatctgcaagccagaaagatagccgtcaccagaacctgaacatgttggcatcctgacatggtttggctgtgtccccaaccaaatctcatcttggattgtagttcccataatgtctatatgtcatggtaggaacctggtgggaggtaactgaagcatgggggggcagttaccctcatgctgttctcatgatagtgagtcctcatgagatctgatggttttataagtggcttttcccccttttgctcggcacttctccttcctgtaccatgtgaaggacatgtttgcttcccttctgctgattgtaagtttcctgaggcctccccagccatgctgaactgtgagtcaattaaacctctttcctttataaattacccagtcttgggtatgcctttattagcagagtaagaaggaactgatacacaccctgattgtgaacttctagcctccagaactgtaagaaaataaatatttgttgtttaagtgacccagtctgtggtattttgttgttatggcagcccaagcaagtttatacagtcacataacctcattaacctaagacctgtcacaaatctatggaggccattgaaggaaatataaaaaaagtaattcttaattacttttagcatagtcaatcttcaagagaatcgttactgttttatatacataaataatattatatggctcagataatgactaaaaatcaggcaaatttctatagttgagaataaatcttaacaaattgcagaatcatattatttaaaagtactattgccctaccttcctggataagttagtttcctccacaattccaaactatatatttcatagcaagtatctaggttcatcatacatttttgaataataatacctttgatcaagtaaaaatgctttaattgaatgcattataatagttttgaagaaagaggcatttgtaagacatggttttataaatatactatcatactctatgagaaacaggttatgagagtattactataacgtacatatcagttaattttttcgacagctaaataaaatttgtgtaaagcatacatacaaaagcaaacagttaatccacagaacacttgatgagcattaaactttcacaagaaaatttctgatagatggatttatcttttgtgttggtattaattgagcaaatatttttgactcagttttgttggtgagctctgacttaagaaatttttatagtttctaaaataaatcactatttgcaaaaccataccaactttaattaacttttggattgaacttgcttccagcaaaacaacaacaaaaaagcagataaggcaattatcggacccatgaaagagagaggaaagaagtcacgtttttgtgttgcatttacacagcaagaaaagacaattaactatatttcaaaagaaaaacaatgggcagagctatgagataggaccactggatcaagccttgccattctctacatgcagttcaggaccagaaccaaatgcttgtcttgcagcccccagaactgtccctgagtagctggaagacagacctcttgcaccaattgtcttgaatgttaatttgttgtggatttgggcagccatttgctcctgaaatgagatatggaccattataccagcagagagaaacacaaatgtaaagaagcacttaagagcgaggaggaacaaagaccccactgaggatccagactgagtgtctcaggcacaaaagggctgcatgaatacgtttattgctctgctggcaaagtggcacttggtaaaggctggatggccgacttaagctaagctgatctgaagtaaaatcccaaataatttatattgatgagctccaaagaaataaagaagctttgctctcagcagtagtccttaaactaagaaagatgacaaaccacaaggaatgaaaagccaatttacttggaataacccgacagaagtgtcatctaactatatgaagaaccatactccaggatttcttaacaagatgatgacagtattcaaagacatggcaactgaacagacgcgttgaaactgagaaatcatcagtttttattgtcaagtatttaagacactgctgtataatagaatgaaatgttcaaaaggtacttcagataactgtgtctgctgtgtgatctgttatcatgaccttcagaatcgatcataaaaaatatttttaaaaaatctaagaaagattcatttttttaaaattgaaagtagaataaaagatacctgccaaacatggggtaataataaaatacaggcatacctcagagatattgagagtttggttccagacgacctcaataaagtgaatgtagcattaaagtgagttacatacgttttttggtttcccagtgcatataaaagttatgtttatactatgctgtagcctattaagtgtgtaatagcatatctaaaaaacaatgcacataccttaatttaaaaatacattattgctagaaatgctaatgatcatctgagccttcagcaagtcgtaatatttttgctggtggagggtcttgcttgaatgttgagggctgctgatagatcagtgcggtggttgctgaagctatggcaatttcataaaataagacaatgaggtttgcacatgaattaactcttcctttcatgaaatatttctctgtagcatacaatgctgcttgatagcattttacccacggtagaacttctttcagaattggagtcagtcctctcaattcctgccactgttttgtcaactaaatttgtgtaatattctaaatattttgttttcatttcaataatgttcacagcatcttcaccaagtgtatattccatctcaggaaaccactttctttgttcatttatgagaagcaactcctcatctgttcaagttttaccatgagactgcaacaattaagtcacatattcaggctccacttgtaattctagttctcttgctatttccaccacatctgcagttacttcctccactgaagtcttaaacccttcaaattcagacatgagggttagagtcaacttcttccaaactccggttaatgttgatattttgacctcctccagggaatcataaatgttcttaatggcatttagaatggtgaatcctttctagaaggttttcaatttattttagccagatccattgttggaatcactatgtatggcagctacagccttacaaaatgtatttcttaaataataagacttgaaagtagaaattactcttgatctatgggctgcagaatgaatgctgtattagcaggcatgaaaacaacattaatatccttgtacagctccaccggagtgtttgggtgactaggtgcattgtcaattagcagtaatattttgaaaggaatctttttgtctgagcagtaagtctcaatgggaggcctaaaacatttagcaaaccatgctgtttactgatgtgttgtcatcaagactttgctgttccatttatagtgtacaagcagagtagatttagcataattcttttattttttattttttagacagggaatctcactctgtcacccaaactggtcttgaaatcctgacctcaagtgatcctcccgcctcagcctcccaagtagctgggactacaggtgtacaccaccacttctggcttgatttagcataattcttaagggcccgaggattttcaaaatggtaaataagcactggcttcaatttaaaatcaccagcaacttaccatagcccctaacaagagagtcagcctgtgctttgaagacattgacttctcctctctagttatgaaattcctagatggcatcttcttccagtagaaagctgttttgtctgcattgaaaatctgttgtctactgtaacaacctttatcaatgatcttagctagatgttctggataacttgctacagcttctacatcagcacttgctgcttcatctcacacttttatgttttggagatggcttcttcccttaaagttcatgaatctctgctagcttcaaacttttcttctgcaacttcctcacctctctcagtcttcatagatttgaagagaattagggccttgatctggattaggctttggcttaagagaatgttgtggctcatttgatcttttcttcagaccactaaaactttctccatatcagcaaaaaggctgtttcactttcttattattcatatgttcactggaacagcatttttaatttccttcaaaaacttttcctttgcatttacaacttggttgtttggcataagaggcctagctttcagcctatctcaccttttgacatgcctttctcactaagcttaatcatgcctagcttatgattaaaagtgatagatgtgcaactcttcctttcactggaacacttagaggtcattgtagggttattacttggcctaatttccatattgatgtgtcttggaaaacagagaggcccaaggaaagggagagagatggggaagagctggtcagcagagcagtcagaacacaaaacatttatcaattaagtttaccgccttatatgggcacagttcatagtgccccaaaggattacaatagtaacattaaaaatcactgatcacagataattgtaacagatataataagacgtataaaatgttgtaagaattaccaaaatgtgacacaaaaacacaaagtaaacacacactgctgcaaaaatggtgccaatagagtttgcggtcaatttgagaccttgcccatcttggctgaattctcaatttctttttcttttcttttttttttttttgagactctgtctgtcactctgttccccaggctggagtgtagtggcttgatctcagttcactgcagcctccatctgctgggttcaagagattctcctgactcagcctccaagtagctgggactacaggtgcgtgccaccacacccagctgatttttgtagttttagtagagaaggggtttcgccatgttggccaggctggtcttgaacttctgacctcaggtgatctgcccgcctctgcctcccaaagtgctgggattacaagtgtgagccaccatgtccagctgaattctcttttaattaaacttcttgaccaaagagatatgccgtttttgcttttgttttatccaaaggtatgaagccaactctccagtggtttgagtgggccctcaacttgggatgagaaattcattcaccattttttcacccaaatcaaaggtttaatgtaatcattctatgtcattacccagattaaaatgttaattttagtaaccacactttaaatctcaatctaatttttaaatgcaagccattaagatgcattcataaggctaaatactattcattagctagtacataatgacaacactgacattcatttggcagtttcccaaactatctttccctctaaatattggtacctgtgcccttgccagaggataacatatcttgtattatataaatcttgaaatttaacaggtactttgcaactacatccaaattattatctggtgaattaagatgaccacacattctttgacactatttctatgagaggtggggtctatgtcccttccctttgactctatgtggggtttgtgtttaaaccattaagttgccaaaaagtggttaaaaagcaataaataaacaaaacattatcaacattcaactgggacttgccaccctatgccatccaaagatttctgtaatcaggtgtcaactgaagcttccttgtctttcaaaatctaggtaagatcaacgtgaacccctaaactcatgaaatactatggaaattcaaagcctttttcaaaatgtctacatattcttggcaggtttatattctcatcttggcctttgagttcttatgtattcttgtgctgtatctgttatataatcatcacactaaatgtgaaattcagctccctcctcaatttccacaccaaaaaaatccactcacatcaagaattcataaatttagtataatgtgaagaaggttctttcttttttgcttccttccttccctcttcccttcttccctacttccttcctttctctttctccctcctttttcttctctttctctccctttcttttctttctttccttcctccatccttcccttccttctttctctatctctcccctctccacttgctttctgaaaagacaaattatgaagttgcatcaaaacaaacaaacaaacaaacaaacaaacaagcaccctctcatgaagtatcagctccaccattctcaaaatagattttgcccctgccaccaatggggcatttcactgaccattaatctcgtacagtctcagcctttactcatatttctggcttctctccaatgtaactttctctttttctcttttccccctccctatattcaaatgtataataacacaattctcttcatttctcatacagaatcatttcccacatcctctgattactagaggcagtcaatattcattccctcataatctgtacaatatcaagagggcttgtcaaggattttcccatacaactccttccttagtcttagtgaggaatgctggggcctatggttagataacatttcattcaccttgttatacttcagaagttctcatatgtgtcttaagttatttattagctcagtggttagattctagtcttgtccatgtttttgaggtggtttttttccccctggaatttggactgatttctaaattctttctgagcaacaagtacccaaactaacattttcatatttgtcttccattttttctattaagctcattaaaattactactaccttttttcctgaggccctgcaagctaaagcttattccttgcaatataggcaagaaaaatgagtcagattgccactgcattactcttctgtaactaaagatgctttaagtctaacatctggatagattttgcccaaaattaacctttgtttttattctgtttccacaaaaacgcctcttattgaaaatctgtttggctttgtatttcagacaaaagggtactggttttccagcctattcacttagatttcaaatggcattgatctcttcctataagcattgttaaactggggttaagcattttattaattatcactaggtgctatttcatttaaaaaattatttgttatattcaacaggtattcagatgggtaaagtttatatcttccaggctaccaaagttccagacaaacatgataattgactcaagggttccagcctgtgccactgcaggaaggactgagtccctataaatcattagataaggtagtgagagatttctatgcctccagatcagatagagatgacagctcctgttcaggatgaagcagttacagaagatgaaacctctgtccctctacaaccttttaggattaaggaagagtgcacagtctctgaggagagatgaaaaaggaattcagcaggacttgtttcacaagatacagaccacaaagactgctgataaaacaggatgtggtaaagaagtctgccaaaacctgccaaaaccaagatggctatgaaaacaacctctggtcattctcagtgctcattatacactaattataatatattagcataccaatggaaactccaccaacatcataacagtttacaattacaattacagttacaaatgccgtggcattgtcctgaaactaccctatatgatctaaacgggagaggatccctcaattctgggaactctcagctgctttcccagaaaactcatgaataatctactccttgtttagcacataatcaaaaaataaccataagtatagtcagtcaagcagcccatgctgctatctgcctatggggtagccacccttttattcctttagttaataaagttgctttcactttactctgtcactttactgctggctttcactttactctatcactttatactttattgctggctcttgaattctttcctgcacaagccaagaacccatgtgacctcccaagctgagttccaattttgaggtttgccctgtgacatctttggcttatgaaagcaatctgattaagatccagcttaaaattataatcatgtaagtcaactctactacatagttttgagcacagaaatcagaattcatgctatgaattgccctaggcttgtagtctgaacttgttctctccctatttgcaggggtcagtggtaggatttaatctgtttatacggattaactgctgtatagattacctacagcaattcttaagacaggctgtttcctttcatttagtaaaactttgttttcttaatttgtcaatgcttagtgtgccaacaatggggggccagtatagtttggtctttgagcataggggctttgtgtcagactgctgagctcacaatcctggctcactagacctgtaaccttggcctaattatataacctatgtctcagtttcctcatcagtaaaaggtgagaaatatatgcacttttcaatcatatttcactggccagagcaagttacagcactccacctgatttcaaggaagtgaggcagtgtaatatgatcatgggcccagataggagagaaccagaaaaaaaactgatgatgagcactgatggtaaccacaatggtttgggcaatcaaatagcaagttatgttagaatagcgtttaaagacaattctgggagggcagccaagatggccgaataggaacagctccagtctacagctcccagcatgagcgacgcagaagacgggtgatttctgcatttccatctgaggtaccgggttcatctcactagggagtgccagacagtgggtgcaggacagtaggtgcagtgcaccatgcatgagccgaagtagggcgaggcattgcctcactcgggaagcacaaggggtcagggagttccctttcctagtcaaagaaaggggtgacagacggcacctggaaaatcgggtcactcccaccctaatactgcgcttttccgacgggcttaaaaaacggcgcaccaggagattatatcccacacatggctcggagggtcctatgcccatggagtctcgctgattgctagcacagcagtctgagatcaaactgcaaggcggcagcgaggctgggggaggggcgcccaccattgcccagacttgcttaggtaaacaaagcagccagaaagcttgaactgggtggagcccaccacagctcaaggaggcctgcctgcctctgtaggctccacttctgggggcagggcacagacaaacaaaaagatagcagtaacctctgcagacttaaatgtccctgtctgacagctttgaagagagcagtggttctcccagcacgcagctggagatctgagaacgggcagactgcctcgtcaagtgggtccctgacccctgacccctgagcagcctaactgggaggcatcccccagtaggggcagactgacacctcacacggccgggtactcctctgagacaaaacttccagaggaatgatcagacagcagcattcgcggttcatgaaaatccgctgttctgcagccaccactgctgataccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacggaacaaagctggacggagaatgactttgacgagttgagagaagaaggcttcagacgatcaaattactctgagctacaggaggaaattcaaaccaaaggcaaagaagttaaaaactttgaaaaaaatttagactaatgtataactagaataaccaatacagagaagtgcttaaaggagctgatggagctgaaagccaaagctcaagaactacgtgaagaatgcagaagcctcaggagccgatgcgatcaactggaagaaagggtatcagtgatggaagatgaaatgaataaaatgaagcgagaagggaagtttagagaaaaaagaataaaaagaaacgaacaaagcctccaagaaatatgggactatgtgaaaagaccaaatctacgtctgatcggtgtacctgaaagtgacggggagaatggaaccaagttggaaaacactctgcaggacattatccaggagaacttccccaatctagcaaggcaggccaacattcagattcaggaaatacagagaacgccacaaagatactcttcgagaagagcaactccaagacaaataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaacactttacagacaagcaaatgctgagagattttgtcaccaccaggcctgccctaaaagagctcctgaaggaagcactaaacatggaaaggaacaactggtaccagccgctgcaaaatcatgccaaaatgtaaagaccatcgagactaggaagaaactgcatcaactaacgagcaaattaaccagctaacatcataatgacaggatcaaattcacaaataacaatattaactttaaatgtaaatggactaaatgctccaattaaaagacgcagactggcaaattggataaagagtcaagacccatcagtgtgctgtattcaggaaacccatctcacgtgcagagacacacataggctcaaaataaaaggatggaggaagatctaccaagcaaatggaaaacaaaataggcaggggttgcaatcctagtccctgataaaacagactttaaaccaacaaagatcaaaagcgacaaagaaggccatcacataatggtaaagggatcaattcaacaagaaaagctaactatcctaaatatatatgcacccaatacaggagcacccagattcataaagcaagtcctgaatgacctacaaagagacttagacttccacacaataataatgggagactttaacaccccactgtcaacattagacagatcaatgagacagaaagttaacaaggatacccaggaattgaactcagctctgcaccaagcggacctaatagacatccacagaactcttcaccccaaatcaacagaatatacattcttttcagcaccacaccacacctattccaaaattgaccacatagttggaagtaaaggtctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacgtaatgaaatgaaggcagaaataaagatgttctttgaaaccaacgagaacaaagacaccacataccagaatctctgggacgcattcaaagcagtgtgtagagggaaatttatagcactaaatgcctacaagagaaagggggaaagatccaaaattaacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttcaaaggatcaacaaaattgatagactgctagcaagactaataaagaaaaaaagagagaagaatcaaatagatgcaataaaaaatgataaaggggatatcaccaccaatcccacagaaattcaaactaccatcagagaatactacaaacaactctactcaaataaactagaaaatctaggagaaatggataaattcctcgacacatacactctcccaagactaaaccaggaagaagttgaatctctgaatagaccaataacaggatctgaaattgtggcaataatcaatagcttaccaaacaaaaagagtccaggaccagatggattcacagccgaattctaccagaggtacaaggaggaactggtaccattccctctgaaactattccaatcaacagaaaaagagggaattctccctaactcattttatgaggccagcatcattctgataccaaagccgggcagagacacaaccaaaaagagaattttagaccaatatgcttgatgaacattgatgcaaaaatcctcaataaagtactggcaaaccgaatccagcagcacatcaaaaagcttatgcaccatgatcaagtgggcttcatccctgggatgcaaggctggctcaatatacacaaatcaataaatgtaatccagcatataaacagaaccaaagacaaaaaccacatgattatctcaatagatgcagaaaaggcctttgacaaaattcaacaatgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctgtcaccactcctattcaacatagtgttggaagttctggccaggacaattaggcagaagaaggaaataaagggtattcaattaggaaaagaggaagtcaaattgtccctgtttgcagatgacatgattgtatatctagaaaaccccattgtctcagcccaaaatcttcttaaggtgataagcaacttaagcaaagtctcaggatacaaaatcaatgtacaaaaatcacaagcatttttatacaccaataacagacaaacagagagccaaatcatgagtgaactcccattcacagctgcttcaaagagaataaaatacctaggaacccaacttacaagggatgtgaaagacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcgccatcaagctaccaatgactttcttcacagaattggaaaaaactactttaaagttcatatggaaccaaaaagagcccgcatcaccaagtcagtcctaagccaaaagaacaaagttggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagacatatgtagaaagctgaaactggatcccttccttacaccttatacaaaaattaattcaagatggattaaagacttaaatgttagacctaaaaccataaaaaccctagaagaaaacctaggcattaccattcaggacataggcaagggcaaggacttcatgtccaaaacaccaaaagcaatggcaacaaaagccaaaattgacaaatgggatctaattaaactaaagggcttctgcacagcaaaagaaactactatcagaatgaacaggcaacctacaaaatgggagaaaatttttgcaacctactcatctgacaaagggctaatatccagaatctacaataaactcaaacaaatttacaagaaaaaaacaaacaaccccatcaaaaagtgggcgaaggatatgaacagacacttctcaaaagacatttatgcagccaaaagacgcatgaaaaaatgctcatcatcactggccatcagagaaatgcaaatcaaaaccacaatgagataccatctcacatcagttagaatggcaatcattaaaaagtcaggaaacaacaggtgctggagaggatgtggagaaataggaacacttttacactgttggagagactgtaaactagttcaaccattgtggaagtcagtgtggagattcctcagggatctagaactagaaataacatttgacccagccatcccattactgggtatataccccaaggactataaatcatggtgctataaagacacatgcacatgtatgtttattgaggcactattcacaatagcaaagacttggaaccaacccaaatgtccaacaatgatagactggattaagaaaatgtggcacatatacaccatgaaatactatgcagccataaaaaatgatgagttcatgtcctttgtagggacatggatgaaattggaaatcatcattctcagtaaactatcacaagaacaaaaagccaaacactgcatgttctcactcataggtgggaattgaacaatgagaacacgtggacacaggaaggggaacatcacactctggggactgttgtcgggtggggggaggggggagggatagcattaggagatatacctaatgttaaatgacgagttaatgggtgcagcacaccagcatggcacatgtatacatatgtaactaacctgcagattgtgcacatgtaccctaaaacttaaagtataaaaaaaaaaaaaaagaatagtgtttaaagtcagagcaaatgagtccaatgtatgaactctagtatatacatttgtggtttatttgacttttgcttacttcctgattctctcctgtgtttcagggttgtgtttgatagatatgatctccaaataagtaagattatagtatatgtttcttaaatattgtttatatttaacatacatagtacatagagtatatgaccattaagtactattgcttttactatattttgttacctataggagaaaataattatgttaaggaaaatgattggcttatttttgttctataacttttgtgaaatgcttagttattaatttcaatcatttcaatgtccttaaggtgaaagaaattgcctatttctttggaaaacgttgcatgtgataatgagtcttctgatttttctaagtttttagtattctcctataaaggatctcaggcattaacacttaaaaaggttttaatgattaattcttagtgagattaaatatggctctatacatatgcatattggactataatttataactatttcaaaattagtgttccattcccacaattgcattactcctctcattctgttttaaagtgaggctgtttttcttaatcatataggttattaaatgtattaatgtttcacaaattcttttctaatgaactacttgcttatttgcttttctcattaataagaacagagaagaacatagcattcttcgggtataattgagcaacttggattggttattgctgtttctgaaaccactataatatgtgccaaattgttttcaaatctataacttatataactagaacttttagtagtctgatttcacttaagaccatacttctgagtagcatgttattaaatatttatatatactgattttccattcctctccccccatggtttttgcataatcaaaggattaccattatgctttgagagagagatacattgcttatttgcactggttatgcaggaacaccatggagcattttatgtttgaaacagcgtggctctgctgggagctcctgaagtaaaaggaataaggagagatcaggcctagtttgggccactgtcaaactcactagggccacagaagtgactcgtcaccatggatgaaataaaaatgcaaagggcaatttccaatctgtctggaccaaggttgctggccatggagatcagattagatttgagtaaaccagggaatcacatcaatgcagtctgggatgtaccgatgaatgaaccattcattcaatcaagacatatccattgaagacttaatttgtgcccagaactgcgcagtcactaaacaggcaaacatacaagttgaaataattgctacaaagtcaagtagcaaaatgcgaaagaaaccatgggaggaggtgggaagaatggcagggagtggcagggaagttggttagggatgacctctttgagacatgatacttaagctgagacctggaaaatgataaagaaccagccagccaacgggtaggggaagagctctgggcagagggagcagtcacctttgtgtggtgttagggcatgtaagtgggcagaggagacaggagagctgggcacaggcctagtcatgcagggcctttcaggcggataaagacttcattagagtccatgggaagccatccagggtttcaggcaagaggctgacattgtctcattagttttccagtcattatgaccttggaaggccctaatgtgcccctcctcagtgataccccaccccagaagtgaccaccactctgacttttgtggcattcattcccttggggtagtatatagttttgcctgttcttgaacttacataaatggattcatattacatgtagaacatggccctggttgtgtagagggtggactggaggtgggcaagagtggatgtgggagggaaaacagtggctggatgaggatggtggatgcgagacctcgatctgtggagacaatacacagggatctgcaaaaaaaaaaaaaaaaaaaaaaagagctccactcagggaggaaaggaccagagccacagaagcactcagtcccgggtcccggtccctgaaggaaggagccatacaccagagaccatcaaaaaggaggaggaaagggcatgtgaggccacatacaagcaaactggaacccaaaacaaggaaggctgcttccctctgcttgtgagtacctggctccatcgctcacactgcggcagtacagggatcaggcacactgacttgctccggtgtctagtcagtagaaggatggggagggactggaccactttggttcacagccatctgaagctgcagatagtgaatttcattatgaatttgaggcaggaatgggcaccagtattgggaaacacaatgcctttaaacatttctcagtcaacaaatatttattcagtatcagctatgttttaggaactattgtaggtgctagggatacatcagtcaaaaaaagagacaaaaatctctgccagtatggggcttatgatctagagtggagagagtggagtgaaataaggaaaaggtagtgtatcaagtgatgatgagtgctatggagaaaaacaaagcagggaagggagattagcatgttgggggcaggaaagggggcacggcagatttaaataagactgtctgggaaggtggcactgaatagtacaaataaaacctgaaattgcagagagagcaagccgtgtggatatcaggatgagagggtgtagggtgcaagtgcaaaggtcctatggcacaaatgtgcccagcttgtttaaggaaaagcaaagaggccagtgggacagagtgaggaaagtgagaataacaggaggtcatagagggaccagggattagatcacagaagttttggaaaccatcgtaacttggccttttgttaaaacaagtaagtgtaggcacttgctggggataaaaacaaatttcccagaggcaggctcatcgaattgggcccagtatacttgctaaattaaggagccattttcctccttttcaaagagataaaggcagctttcccctcatttctgttaagctcaggggctgctgtcagccccacagacccacatgagccagatctttttctttggatgaatctaattccttggcaatctgggtatgattcccacccctacccctacaccgaccccccaacacacccgacaaacgaatgtctgctgtttgttaattggtgtctggtttttgtttgtttgtttgtttgtttgtttgtttgtttttgagacagagtctcgcactgttgcccaggctggagtgcagtgtcacgatcttggctcactgcaacctctgcctcccggattcaagctattctcctgcctcaatctcccaagtagctgggattacaggtgcccaccaccatgcccagctgattttttgtgtttttagtagagatgaggtttcactatgttgaccaggctggtcttgaactcctgacctcatgatccacctgcctcggcctcccaaagtgctgggattacaggcatgagccactgcacccagccggtgtctggtttttaaaatggcattctaacctttattcttatttcattctacgggatgaatttaatcacggaagttgaatgtgaggttgggagatgggtctgatggggccaaatttggagtttctggacaatgggaggagtgtttagggtgggacacacttttggaaatagacatataaaaatagagggtttgaaaacttccttacattcatcacctggtgacatctgatgacaggaacgggaaggggctacaacaggtaggtttctccagtctctgctctgggcccaacacctgagccaatgttctgattggctcctgtttgcttccattccaagagcagatgtttttgctagaaagtgttgattacccgcttcggcttaactgccacagagtttatcaatatatgtgatgtcacacacacacatttagggcatggagaagggggtgggggcttttatgctctttgtttttaggtgctagtcaaagaccttctgaaatgccttcttgggtacctaaagtcaggcctctcctctttccactgggcagggaattgaagataaccccaagcaggttttgttttaccctttattgatatatgataatttacatatttatggggtacatgtgtttgttacacgcaaagaatgtatatagatcaaattagggaaactgggctatccaccaccctcagtgtttatcatttttatgtattgagaaatgtggatcccacctccctaagactctgcatcatcacatactttcaggtggttagggagggccacgtgaagcaaaagtctcccatgttgtctctggggattgtagataattattactattattttgtttaaactatatatatatatatatatatatatatatatatatatatatctttgctttaagatgccagtatggggcttatgatctagagtggagagagtggagtgaaatatatcttaaagtgatatatatatatctttgctgtaagattttagctacagtaagtctttttggaaaggcctgactgtgactttaaggccataatgaaggcaggtgctgggatggagacactcagaacaggagcctggttagtgtctttgtgacactcaggtgactgacttgtgagagttggcctgggccccaagctttgaagggctccactctgtctcttctatcccctggaaagaaaagtccatggatttccgggacgatgtcattcagattatattccaggtacctgggatcagccaaactaaattccaggtatctcaaattcccccaggtaccccaaatgccccaagcccattgccagtacctgcatgggcttccccctgagatttgggctcctctggatgcacctctgcaggggctgtgtgtggggttgaccaagtttgaaatgtgcataatgtagggctcacacctgttaaaatccagcacagtgtggagggggatctagggggaaggggaggtgagtaactccaatgtcttctaaacggtttgtaggcttagttccttctggttggatttggggtgtgatctgccaccttttgatagcagcatcctggtactgtccccttatgacagcactatcaagatactgagcactgggcctaaagtgaatgtcagtttcttacttggccaactataaacacggctttcataagccaatgttttacaagagaagccagcaggcaaaggcatggctgttccactacagaaagctgttctctttcgcacactgtggggtaactgacctgagtcaactaacttagactcagcaactgctccagaaaaaagtgagctgctggagcccaacagagacactggctattactcctaggatctgcactgtaaaaccaaaagcattagggttgaaagaaacagtttccttactgacaagttagtaattttcagtgaggtaaaagaggaggaggaggacaatacatttccaagggtgctttattcagtttgagcttttaaatcaatgggcaagtcttcattatttacccttaattactgtcatcacagtctcataaaccagaagcatgcccccggtgtagaaaacaggccctttaccttggctctcctcccacttccatcagggcagccaagggctccagtggtaaatgctctcctgcaactgataggacattcctcaaaagagcccttgcggtacaatttgtacaacatggccctttgaaacagatagatctgagcttgaatcctggctctacttctagctgtgaaatgcaagccacaaaacctctctcagcaagttcctaaacctttctgagcctcaatttgctcacttgtcaaatgggaatgatactgtgtactccatgctgttttggtgaaggttcaataaaatacatatgcaaaacacataattaatgcctgacacataagcatttaataaatatagcatttcaaaaaggaccaaaataacatagcaaaagcagaagaaataagaagaatgtaaggtaatgaaagaaaaattttaaacaaataaaccagaacaaatgcatccaaataacaattacttcttaaggctactatggggactatgttaagttactccaaatgttctgctgtgtttgggaactcttatccaggatctcaaagtacgttccttagaccatgacagtggtggcaaatcatttgagagcagatttgattttggaaaaccacaaaaatcatttaacagaaaataaaataaaaacatgatcaacaattttgttttaaaaaagtatgattatgaaatactaagataaattttatcttctcagctgccaacatgatctctctaaaatgtcaaactaatcatgttcctctcctgctgaaaacacttcaatgattctccactgcttttagaatcaagttcaaattccttcatgtaacacaagcatcctttgtgatctgaccccgggtagctctccagcctcaggccctgcctctcccctgctgtgcccttttccctgtctgcattgaggtgcttgaatagcatgctacttcagttctccctacttttacctatgactttccttctccatggagcattcctgctagttgtctttagaaattgtatagctcactgctacctgtcactctgaaattgccttctatgcaaagcagttatgtctgactttgaacaagatgccccctcctctatgcttcccctaacatatctacctctttcttggagctcgttacacttggcagtaatcatactttcatttatctctgtcctctattagactgaaatcacatgagattgtactacagcttatgaaatttacatagtcgtagtctactctatgctgttttggtgaaaatcgagttcttggcacataataggtgatccattcgtaacattaatgattatttatcttacaaatctcatggtttccattaaagtgtttcaaacatatttaaatgatgatataattattagaagtagtacatagactcccctgcagactatttgcagagaagcaccatttgtgcatacacataagttcttttttgttgctgttaaaaaattaccttactggattctggtataaaatgatatctgatgaagaaaggagtagtggaatataaccctaagtgtaaaacaaatattggtgtatatatatcctgagtatataaatatattgagataaataaacacataaacagagagaagagacaaatatcccatacaaaagaattctaaataatatatgtagataattcctcttcaaggaggtggagcataactccccactccttaggtgtgagctgtgcatagtgacttccttctaaagactacagtgtagaaagaggaaaaaagagtaactgtacattggggaaacctgacaaacactacttccaccagacgatcaaggttaacatcaatcatggtaagtcattttgatagtatgtccccttgatatgatgtgattaaaatggcacttaacctctgtgccttcctcccccaaacccataattttggtgtaatcgtgaggaaaacattgaacaaattctaatagagggaaactctacaaaatacctgaccagtttgctcgagactgtcaaggtcaacaaaattgaaaagtatgaaaaagtatcacagccagggagagtctaaggagacatgatgaatcaatgtaatagggtatcctgaatgagatcctggtacaaaaaggggatatttggttaagattaaggaaatatgaatcaagtatggactttagttgataataatatagcaatatggttcattaattataacaaatgtaccatatcttaatagaggaaactgggtatgaggtataagggaactctctgtactatcttcccaatttttctgtaaatctaaactgtcataaaatataaagtttatttctaaaaaatgatacctcacggctgattctccatgtaagttctcccactttccacagaatacctaaatgaaaacctagaaaccatcaataactaaaactgataacctactactagaatatgagaagaattttcaccaagtataaggcagatgcagctggactcagaaaaataactagtagcttaaccatgctttatctccacccccaaaatgaagcagtcccccttggtctgaaagaagatgggaaggcattgttctgaaagcagtctccagagggcagtgttcctttctgtactgtctgagctctcattcagagacccaggatctgtgctaaccagaaaattaaccagttcaccttctactgaatggtagctgtttttgaagtattcgctttcatcttgtgggaaagagtcactgcaaataaagcactgtatgatggtggggggtgggggatgttataatataaataactactacttttgacattatatgaacacagtggtaaagattttactggcgttaattcacttcatcgttattaacaatcccacaaggttgggaagtgagaacaatgaagcacagagaaattgacctgccctgagatgcacaggtaaaaaagtagcacagctgaaattaaaatcctaatagtctcagaacaaaggttaaaaaaaaaccttaagaataatcctaacagtctaattaaaaaaatttttcttttttttttttgaaacagggtcttgctttcttccccaggctgtggcatgatcatagctcagtgcagcctcgaattccagggctcaagggatcctgccacctcagcttcctgagtagctgggactataggtgcatgccaccatgcctggctaattttttttcccttttgtagagatgagatcttgctatattgcccaggctggtctcagactcctggcttcaagcaattctcccaccttgacctcccaaagtgctgggattacaggtgtgagccaccgtgcccagcctctaacagtctaatttaaagcctgcccttttaatcacctaactgtagttcattcaaaaaccctcgtagcagcgtatgctgaggattgagattcttgtactttaattatgatttttatttgtattttactatacttgatccactcaacaaacatttcctacatgcctactgtgtgctgctggtactgggcacataatggtgaaccagacccatagacatatttctatacataagggatccagaatccactgagacctgatggggggaagaatattccatctcagcctagcaggagtacactagatctatgtctacatgctagatgctgagaatcagcctagtaactaaatattagtacataagtttgctccccttttgtatatctaaccaaggagattcaacaggacataagtggaccacaaaagagctcaggggcaaccccaaagtcttgcctgttggcaaacactgcagtccaagggaaggagagaagcaccctaaaaacccagagagaatgttttaatacatctgataattgtttcatgcatgcaaccttttagaaatcttatgcttagtatcttcaaagatacaagaagaaagagcatcattgaaagtggatcagaaaaccatataggcaaaatatgtttgaatgaaatttataaaacaaacagaagaatgagttaacatagttcaactgtcacttgctcagggtggtctctcctgaatgtatccacagtagccccatatttttagtcactttttattaaaacatcctgctttattttctttatgatacagtataataaatttatcttgctaatttatttgtttacttgtctactgcctgtcttactagaatataaggttcatgacaatatgaatactgtttgatttttaactgctgagtcctcggtatggagaatggtgactaccaaaaagtagaagctcaacaaacatttactcagtgaatgaatatatagacaacaacagagatggttaaaatgtggaacagtttcaaaagaactcaaattataatagcagaatttaagcccacattggagttaataaatattttttaaatgcaagagctcagaatcaacaatcaatggaaaagaatgcagaacagaaatgggccaacacttattttttaaacaatggtgccaaagtgatcccatggaaaaagaagaactttttaataaatgataaatattttatttaaaaatgaacctcaatggctatcaagatgaatcatagagcaaaatgtaaaagctaaacccaaaaaagcttttagaggagaaaacagtacaatatattcttgatttgtgggtaggcaaaggtttcttagatcactaatagcaataagctttaaattaaaaaactgataaattagacttcatcaaagctaaaaagacaccatgaaaaaatcttatcaaaagacaccatgaaaaaatgaataagcaagctgcaaattgggtgaaaatattgacaatacatatatctgaccagggactagtatccaggatgtataaagaactcttccagtcaacaataaaaagacaagcaatcctattaaaagtgggcaaaaaaattggacagctcacaaaagaagacatccaaatggtaaataagcacatagaaaaagagtacaacatttttagtcataagggaaatgaaaattaaagccacaatagaatattatgcacttaccagaatgactaaaattaaaatcaatgatagcattaaatactggtgagactgcagaacaactaagactttcatagttacttgatagaaatgtacaatggtatagccactttggaaaaatatatacctggaagttcttataaaactaaacacatactgaccttttgaccaagtaatactaggtattagcccaagagaaatcatagcatatgttcacaaaaatacttatacaaaaatgttcatagcagctttattcacacagccccaaaatggaaatagccaaagtattgatcaagaggagaatggataaactatggtataatcatataataaaatgttacttagcaattaaaaacatcaaagttatatacccaacctggacaaacttcatatgcattatggtggttgaaagaagccttacctaaaagagtacatattgtataactgaatttacatgaaattctagaacaggtagaattatggtggaaagaatcagaacactggttgtgtctgggggtagcagtgatatcctggggacggagcaaaagggaactttctggggtgataatatatcaagacatttttcctattgaaaaataacaaaattgttgttttaagctaatacattttggggcattttgatatgcaagattagattaccaaaacaaaaagattatgcctaaccaaatgttatgaatacaggtatattcatactgcaaaagcacttgtataaatttaaaaatttgctaatgaaaatgtaactaaaaatctacaatacatgaacaaaaactaggaaactatagggaaagtgcatactccaattctttttttatatagtaagaaattaaaagatactcattcatttttgtcttgagaaatattgattaaagaatgcttttgtaaaaaaaagataacaaataattttcacttcaagtaaggactaaaagaaactaagcaaaatatagtccaaatagtaaaattcaggaaaagcaaagcataagaaagtagaagctcagatagaataagatgaaataatagatataaagcaaaatccctcattaaaagcagaatcttagattagataaaaaattatattcagagcagtgagattatgtcacttataaaaaaaatctcctaacaacaacaacaacaacaacaacaaaaagaccaggagcagatggattcacagctgaattctaccaagcatacaaataactaataccaatcctcctgaaactattcaaaaaaatcaaagagggaattcttcctaacactttctacaaggccagtataacccagataccaaagccagacaaagacacaacaaaacaagaaaattacagaccaatatccctgatgaacatagacacaaaaatcttcaacaaaatactagcaaatcaaatccaatagcacatcaaaaagataatataccatgatcaggtgagatttatctcagggatgtgagaatagttcaacatatgcaaatcaacaagtgtgatacatcacacaaacagaattaaaaacaaaaaccataagatcatctcaaaacatgcagaaaaagcattcaataaaattcagcatcccttcatgataaaaattctcaacaaatcagacatagaaggaacatacctcaacataataaaagtcatacacaacaaattcacagccaacatcatactcaatggagaaaagttgaaagcattccctctaagaactggaacaagacaaggataaccatatgcagaagaatgaaactggacccatatttctcactatagataaaaatgaactcaagactgattaaagacctaaatgtaagacctcaaattataaaaatctcagacaaaatcctagggaggactcttctggacattggcctaggcaaagaatttatgaccaagccctcaaaagcaaaggcaacaaaaacaaaaatagacaaatgagactgaagctaaaaccttcctctacaggaaaaaaaaatcaacaaagtaaacaaacaacccacagaatgggcaaaaagtttccaaattatgcatctgacaaaaggctaacatccagaatccataaggaactcaaataattcaataagaaaaacaagtaacctcattaaaaagtggggaaaggacatgtaagccggcaacaaatacatgaaaaaaatgtttgacatcactaatcatcagagaaattcaaattaaaaccacaatgagataccattttacaccagttataatagctattattaaaaagtcaaaaaacaacagatattggcaaggaggcggagaaaaggtaatacttatatgctgttgataggaattagtaaatctttatgaaaaacagtatggagatttctcaaagaactaaaaacagaactaccattcaatccagtaatcctactactaggtatatccccaaaaagaaataaatcattatataataaagatacctgcacccatatatttatcacagcactattcataatatcaaagatatggaatcaacataaatgtccatcagtataagactggagagaaagaaaatgttatatatatatccacataatggaatactattctgccataaaaaagaatgaaactatgtcttttgcagtaacatagatggaactggaggccattgtcttaactgaaataattcagaaacagaaaaggcaaataacatatgctctcacttataagttggagctaaagaatgggtacacatggacatacagagtagattaatagacatggaaggctacaaaaggtgggaggttgggagcgggtgagaattgaaaaattacctattagatacaatgttcactattagggtgatggatacactaaaagctggctcaccactacataatatatccatgtaagaaatctgcacttgtactccctaaatatattttttaattaaaaaatatatatatatttagatgtatgtagtttacaaaaaaatgcctaaaacaaaatgacccagaaataaaaaataaaataaacagatgagtcaggaattattgttttaaatatatatccttaagaaggatttacctaaaaccccagtagaggttatgtcccctctcagatgctcttatggcatcctgtattttctccttacaagaatttatcacaactattactatattctggtttccatgatttttttttcagtttgcctccacattctaagctctttaaggcagaaataaacctgctttgctcactgccttatttccagtgcccaacccaatgcttagaaataggaaattttcactgaatgactgtattccagaaaaggagtaaaataaaagagaaagcacagataacaacattaatttcaaactaagtcgattccaaggtcaaatcaatgaagtaaaagggtaatcttaaatctataaaagaaacacctcatgttcttgaacctgtttttgcaaataatatggaataaaaatgtataaaacaagaaatattaacaattcaaggagagggatagatgatagactaaaaatatgtttatattccttcctgacaaaatatcatgaaattaccaaaatgctaatatctgatacattcagatcagtagtggaaaatagaaaggattggccagtggtttcaatttatggttaggtaaagaagatctcaaaagattatcactgccttcataacaagaaaaaagagacaaagcaaaaatcatacttcattttaaagctgtcaaagagtgaatgtgagacaaagagaagtctaaacaaataaaattccagtcaagagaagccttttatagaccaataaaaagcagtgactgcttccatatctgggaccaattggttacatagtggagagatgagcctgccatcatagagcaactcctaaaaggagaaaaactagcaatttttcaaatgatagtatgggttggcaaacagactcttatctagaagagccacaaatgcaaaagtaaacctcttggcttgaaaattctctgccacaggaatttgctgtgaaattgatgatgagtgcagagccagaaaactgaaatcttacattcttgcacatgaatttggctggagttgatgccaaagagaactgaaatgaactctagctgcaattcaaacccctcccagctcaaatcctgattgtgaccagttactcaatgcagcctgggtagttgggattgggttgaagggcaaagggaaatcttcataatctctttttaaagcagaaataaactgaaactaataaaaagcttcagccaatccccagctaaagcattgcagatggtcaaatttttatgatcagcctctcattctagctgtctgacatttttaaaaaatcacatatcctctttatgagaaatagaacaaaacaaaagattttatttagttcaaacaaatctagtaaaaatattatttacttttgtccttctatacaacatgtttgatatgcaataaatacttatgaatacatgcaaagaagcagaaaaatgtgacctaaaatcaagagaagaaataatcaatacaggcagacttacagatgcccttgatgttagaattaaagaccaagaatacgaaataacaattataaagaattatgtgttaaaaatttatagaagaaattttagaatatatagaaaaatttatagaagaaaaggtggatataattaataacagttggtaagtttctgcagagaaataaaaccttaaaaaggaaccaagtcaaaatttatagaactgaaaaatgtcagagtgccagagaactgtgggccaatatcatttgattcaacatatacgtaactgggtccagaaagagagagagaataggaaaaaataagtatttgaaaagatattagccaagtattttctgaaatcaatgaaagttatcaactcttagatccaagaaactcggcgaacaccaagcataagaaacataaagtaaaacacatttatgtacatcatagtcaaatgactgaaaaacaaagatctaaaaggaaatgttaaaagcagtaaagaaaaaaacccattacatttaggggaacaacaaaaataatggcagagttttcactagtaacaacggaagccaaaagacagtggtatcttaaaagggctgaaagaaagaaaaaactgtcaatccaaatgataaggtagttagctttaagcagtaagttaccactgatttgatttcttctaaatactttttacattttctataacaattgcattgttcttataatttaaaaacatttttgtttttattattttattttattttatttttttgagacggggcttgctctgtcacccaggctggagtacagtggcatgatccagctcactgcagccttgacctcctgggctcaggcaatcctcccacctcaacctcccaagtagctaggactacaagcgcatgccaccatgcctggttaatttttgtattttgtattttatagagatggggtttcgccatgttgcccaggctggtcttgaactcctgggctcaagtgatcctcctgccttggcctcccaaagtgctgggattgtaggcgtgagccaccaggcctggcaaaaacatttttaaaagaacaactaagacaaatattgtatatgggttacacttagtatacaagaatcctcagaaaactatctgactaatctttatcctcataccaaatatctacacgattactactgttttcactagtctttgtaaaatatttatatatgaagattaactaaaaaacagtttttatgtgtcaatagcccttttataaagagattaaaagtaagaaacaatcacatctcttggggtaggtgagaaaacattaatgaaagacgtgaaatttgaggtttgttagaaaatactttaaggaaatggagaaaagtttcagaataaaaatttcaagatatatttgagaaacacaaataaatctaggttttttcatggagggatgaagcgagatattgatgtcaatagtggagaatcttgaaagatctaatttgtaggcaatggaaaaaaatatttacctaatctaacatgttttgagtaaagaagaatttacaaatgagaacaattctgtatctactggtgtgctacatttggatttctaattgacagcttggtattccttgtacctgtgaatcaacatgagtagatagttatcatttggacaatcactagatcattgtctgacagtaacttggtctgaaaaaattattttggtagataaaaggatgtttaagtggaactcttcctgagtttataacttagaacaacaggtactatattctaaaggtacatgctaagccataggacttggaaagaaaatgccccaaactaggtctacctcctccaagctgagctgctcactgttcatctctgaattgtgtaagaaaagggtaacagtttatgagagagccttatatggaagatttcttagctagggtttcttaaagcttccttctacagaactacttggagaacctaatatgtatttgcccaggatgtgacatgctagcagacactggtagctgatccatacctaaaaattctaaaggttagtggacagaaggaagagagtggagtgctacattgaggggacctgtgtttgtacaatttaatgagcaaagactcattaaattgagtgagttttcccctgacccaaaaagacccatgaaaaataatcagaccatggaagcaaccctagtatccactaatgtgtgaatggataaacaaaatgtggtatatacttacaatggaatattattcaagccttaaaaatgaaggaaattcttacacatgctacaaccttaatgaacctggaagacatgccaagggaaataagccagtcacaaaaggacaaatattgcatgattctatttatatgaggtagctagagtagtcaaattcatagacataaagtagaatggcagttgccacaggctgaagagaggggagtggggagttagtgtctcatgggtacagagtttcagtttgggaagatgaaaaagttctggagatggatagtggtgatggttgcacaacaacgtgaatgtacttagtactactgaactttacacttaaaaacagttaaagtcataaatttcatgtgtttattttaccactcttttaaagcaacaacaaaaacaaaaacaacaaaaaataaccttcaccaagaggactgcctagagaagtgagctgacccccacagagggagggtcaggatgggccagtggaagccaggaatgagaatggattataagctgttagtcaggagaggcaaacccacaagtaattgctaacaggagattcccagccaggcagttatctgaagaatttataaaagcagctcattacaaaaagaaaatgttggtgtctgacacagatggccctgaaatcaagttaggaaatcctaagactttgccctttcatcctacctccctcttgagccctgtacctgaattgggagataaggtgaagtgaggaagagtaaagaagctatgactgtgtctctctcctgactacaggcttctaaatgaagggaagggaagaagctcagagacaatttaacatctgtgtgtgcagacaatttaacatctgtgtgtgccaaaaaagtggtggaatggtactagacagtttatacaggagtggggatgattgattcaacagagtaagtttaaaggaagaagagtgagaaagaatgaagtggcattctacttgtagtctctgagtctagccctttcatccagtgagagaaaatctttcctcggagcttagaagattcctgatgaaagaatcactgcttccacttctctccttctcccttaccttcaggaagtcagattggcttcttcatcctcatctaaggatatatcccatggaagatggtatctaggaagaggtctaccatcctccccaaataaaagcgcaactctgtatctgtacccatggcttatgaaggaggaagggaatacgagctgatgttatgccagtctgtggtcagcaagactgccactaagagtgactgtcaattctcccaacatagcccaagcttttccattccagaatgttgtcatggcagacaaaatgattatttgtggtgggatgcattcatttattccatatacttttattgagtaccaattatatatagaatactgaaaagaataaaagctagataagacatgatcacacacttcaaggcacatatgtttcagcagaggtaaacatacagacttacaattaatgacaatgtagggcaaacaggaacaaaaaagctttgggattagaaatttttatagaggagattacatttacattgtgctttgaatgatgggaacattttgagtggatatggcataattgaaacagagaatgacaaaagtggaggggaggttagagcagagatcagatggcagagaaacaggtagctggtcttcagactatgacatcattgggtttgtaagtagcatataatactcttgagaagagaaatgagagccaggggtaggaaagtttggtatgagatttctgagggcctcaaaggccaggacatttgttctttaataggtaatgggggagtaatttaaggtctatgagtgggtgagtgatgaaatctaaaatatgttttaggaagaacaagtagaaggctattgcaattgtccagtgcagaggtaatggagcccttaagtaggatggttgctgtcacaattggaaaggcagaaatagatgggagaggctttggggaggtagaataaaagaggcttggatcctgatagcatatgcctttttcttactctctgtcaaaccctcatttcttccctcttctgatcctaaagctgtatgcagtgtcccttagcacacagacttatattttctggcaaatttctcttcagtattaggtaaggcttcatttgcagtaactgtgaaagacaccccaaaggacagttcctgatgttcaaaatgaggaagttatattctacatctacatttttattttatttttctctgtattgtggcttttagaaaaaggttcctccttttacctaagaatttctactctcagaaaatatgaacctacattagcatagctcttctgaagctcttggtcatatagaatggaaatcaggatcatgaaattaaagttattaaaatgatagtaaatgcctctctttgttccattattcagctttaagagcatttctgctctctaagagccttaaagtattaattttatatatttaggacaaaggattttaacaatagaattgtataattaaattacaagaaattaagaaaaacagtcatcaaaataattgagttgataattcaattgttaaacaaaatccagataatgtattagtcactccaatttttaaaggctagaacagtagaaaatgttttgtatgcttacatttctatttctcaccatgtgtggattatggctgaaataagctgaagttgccaatatgtgacaacagggaaaggactgccttgcatggtaagtcttttggggaagctttgtccttggagatgtctagcttttaaagacctgttctgtttctgacatggtaaattttgtatttctatgccctagacttttctgcagatacatgtatagtaacacaggctacagacaatgggcctgcattgagcaaacactggtgccctggagcagctgcacttgcgatgcttctgggatgttcagtggtgtgaccaaacagcatgtatcaaagaactaggaaacaggcaatctgttttcagctctgactttaagcaggtagtaattttcctgataaaacaggcgaaaaaattatagctccccagtcagcatagtcttacaagaaatcttgggctaagtagacaaaactcaatgaagattaaggactccaaatgcactggttggtaagaacaactaacttttattaagtaccagttgtaactaaacactctttctaaacactttccctgtaatttttttgtaactgttaaaacaggcttgaaaatttttttttaacttataatttttgtaggtacatagtaggtatatatatttatggggaaaacaggcttcttatacccatttaacatatgaataaaacaagattgagaggttaagtagcttgcccaaggtcaatagctactgaaccaggattcaagcctaactaaactgatcaggctaatactaaaatcgacactttaaatcttctccctatgctgccttttgcatggataaagttagcaacctccttctgcaggggacactgacacaaagcaagatctgcattaaaagtgtacttaaagcaatgaagtttctggtttagaaataggtagatcaatgggacaaagtaacatgtaaagaaatatacttgaatatatataagaatttatataatttaatgcggtatttcaacttgttcaagcaggcagataagctagatatgagcaggagggtgagtcccctgagaaaagggaggtttggaaaaatctcataacccagagaccacccaaaacatgcatcctagctatgagcagagaggaagggaaatacctatggagaaagagatgccccttgactcccagtaatcactcactccacaattaaactgtcctgtcagaatgtagctagctacatgctgttaagcgggtaaagagggaaaaaggagaaattcctaagagatacacaggtgcaataagcacagctttaaccactttccaaccttcctcaggtggtgataatgagtaatgcaggcattatatagaatttgtatccaacactggcctgcacatacatgtgaactaacagtaggggggaatcccacaaatttggagtggaaactaggtggggacttaaggcagaagtgggaactagacaaagacaaaggtggaaacttgaggcagaggcagaagcctgaagaaacagtctgccataataaccacaatgcagaactcttggggctgctgctggcttatcccttttaaacaccctgctctgcctcatctttcagcgtgcactgtctctgctactacctaacctttgaggctactactcctgtttctccagctggaccagcctgctcctttcttggagtgtccttctctcaataaactctgtactctttattttctttcaataaatcttttgcttacattactaattggtctcttggctgaattctttctcccaggtaagacaagaactgaggattcctgtacttcccagtaacaaaatcattaggaaaagtagccagtattaaatgaatatatagaaatcagtggctgtttgggagaaaaaaataaagttaaagccctattttttttaagtgtacttccagtgagctctgagtgttttagagactgtactctgccccatttgtgagaattattagtctttccagggaatatatatggagaatatttactttcagaggatgtaccatggagagaagtatttttatgaaaaatgccttgggaataggatttttaaaagacagaagagaacagtgtggtgctgtctcttgagtctcatgaacacacagcaagacatgtattcccattaactctctaggccatgaactacttgtgctccctttttaaggaaggaaaagattctagggtggtttttgtcactgggtgctgtggaatggattatttccctccactcttgttgctaaccggaaaaaaaaaaagacactgcaataaggttatgggactgaaagagctacatttagacacagctcttttggggtcaaggtcaagtaggacaataatggaaaagaataagcaaaaatgagacaacacaaggagaagaggaacctgggcacacctgagtggggaatcttcccttagccacagtggaaaaggggaaagcactagcccaggatctcagaaagaagggataggaatgatagaagggtaacatggcatttggctttctctctcagctctgttattactattttactttttaaaaaactttgttacataatatatattctcataaagtagctcaaatcttttatgggactaagcaagttataaatacatactttccatagaaatatttagaaaaatattacacttacacatattcatatataatatgtataaatacataaatttaaaaatatatattcagaagttgatgtatattataatatacgtatatctcattcctgaatttgggtttagtagctctcaaaaaatcactttttgtctttataaagtcctcagggtaagaaatccttccagatactcttgcacatggattcctaggccagggagcggggtggatgccacctgatcactagtgtcaagaatttcgtactcagtggggtgggagttggctgagagtggaagcggcaagagcaagatggcaacaccataattctgactgggaatgccactttccacactggcacaaaataaagcatgtggaacaaagaagtcaatgcctataagtcaacttcttgaaagtttcagattgtcacaaggctaagagttgggctagagatttgtcagagtcagtaataatttttgtgtctaaggacagagggatctgagttacataaacaagaggtgttcactatgaactgaaataagcaattcatgggtaaagagactggggccagaaattctagggtatatgagcattttctaggtaatggtaactgtggctcattggggtaggagtagtgccagtgagagtggtgccttttactgaatcttcccatctgggggtaaatggccattcatgctgcaacgcagttattctagctccttctcaagaggacgacgatgtgccagaggtagatgagaagtgagaatatgggcatatgtaagatgttctctctttgtgtgttaattatactgtgacataatgaagtaggatttagatgggactagtgtatggtgtgtccttctttttaatagctgcagttactgaaaaacaatgggtgaagcaacactgtggagatcagaatttgatgatggtgaaggaggcataactcaacatttgctgttctaaattcctgtcctttgctatttctccccaatccatggtgatttctcagtaataaatatactaccacaaataataatagtattattgctatgattttacgaatacttattaacatcttcacatgcttcatctcatttaattctcacaattgaggtaagtgacagatccaggatttgaaaatagttctgcacacagaccttaatgctatactaatgattcttatcagttggttgaatacttatagttcactcatttattgatgcatcttatagatactgtttttagtccttactataaaaagatattacatataaacgaagcagggctgtctcagaagagcaaaaagcatcccttgccaaggtaagggattctttccttcctccttctttccctcccaccctccattcaaaaattattcaataaatcccaactttgcactaagcaccctgctaggcattgcaaataaaaatccctgtgcttctagaatccatgatttagccagaaaattaaaagcacatagatagataactataattttacatcttttacatctcaaatcagagcagtgcaggtaacatcaatttgcctacttcttatatctggcttgacacacagaatattttgaagatttcatgtgtattatatcatactcttctatatacttttatcttggcactgacattttatcttgcctacttagtaagtatttcatagatataaagaaaatatttggtaaaatctacagagcaggccaggtgtggtggctcatgcctgtaatcccagcactttgggaggccaaggcgggcagatcacctgaggtcaggagttcaagaccagcctggccaacatagtgaaacctcatctctgctaaaaatacaaaaattagttgggcatggtggtgcatgcctgtaatcccagctactcgggaggctgaggcaggagaattgcttgaacccgggaggtagaggttgcagtgagccgagatggcaccactgtactccagcctgggcaaaaaaaacaaaaacaaaaacaaaacaaaaaaaacaactacagagcagaagctagaaaaaaacgagtcttgagtcaaaacaagcgtctgagattcaggggagattagaactgctcttttggaacttagtgtctgagaggacatatgtgcagacatgggaacaggtcaaggttcttgatgggacatgtgttgggggagggaggaagaaagggaatcggataatgacaggagtagctttccccatctaggtcatatatccttgtagtgaattcttctcctacgataagaaaagttgtgactttatagattatctatacatattcaaatctaagtttaaaataaatttgaaatcctgccaaattatctttggattgtcactatttaataaatgtaattttaaaaaatctatatctaaacataggacttatatgaatgggcttcaaggcatctgtgaacccctgaaatcatatgcaacattgtgtttctctggacttcatgagatttaaacccacaacctaaaatgattaaggcccaatgaataattaaaatttgagaaattaagccccataaccagggaaattttttccctcataaaattagagctgacagcatacaaacctgacataaacactgtacttacatcaagagccacagactgcttggcccaggacttcttcacttgatcatacataattgtgttgttgatgccaagtccacaaaagatgacaaaagcctaggaaagagcaaacctgctaattaaacattgcagcaactcattggcaaaatctaatatgaaagcaggcagccaccagggatgggtctgaaaatacaatcttgttgtacacagaggtaggccttggggaaataggcacattaaaattcttaattactattgttatataacaactttatagctcacactgcacatgaggaaaaattatgaatttaatgtcattgtagagaaactatttcatatgtttaaaaacatacttacactctgtttaagtgggttcttaatttatttaggttgtggactgattttagtaaatccattctatttaaccaaagcaacctcttttagttgctaggctataaaatactttggtaaagaaaccaagttaatgtaaccataaggtaaatgttaaggggaaggaggattgagttagaaccattaataaagaagctatgaggtattcttgattagagaaagataaccatgggttttcatgttggctactggtacagtctatgaggaagcccattcaaggctagcttctccagctagagcgcctggagtgaatgcacggaagcgtgtaaacaagagaaatgtgagggcagcacgcctggcagagctggctcagggtttcatgactctgaacacacacaaacaagacaagaataagaaaatagcactttggggaaaagagagggtaattctgtaataaaattaagataaaaataatggatggttacaaaataatccaattcataaaaaataggatcaaatctcacttaagcatttacatattccttaaatcttcctgttaattttgccctccatttaagtataataataattgactaataattgtttgtctttcaaatttgggcaagctgcaaccaggggactattgatgactccacttggtttataaatttattttcttacctcaaaaagtcgttgatctgcatcatcaaaaggtttcccatcaagtctgtttaacacttgagccactcctatggggaaagagtggattatgtggtcatttttagtactggacattgtgtttctctaatagagtagccacagctaactctatgccttttttaaggaactgcactcagtttaaactctggtctctcaagtgcctgccgatttcatgagaataaatctgaggtgtaggacaatgcactctctcttcaaggctgatttatttagactagatctcagtagttcggagttctaccaaggctttaatctgattctagatgactagttacagtaactctaatatattgcccatatattatatatacaactgagtatatatgtagctgaatatgtgtgtgtattcagctacatatatatatatatttcaactgaaaatatatatatatgtgtgtatatatatatatatatcatactctgaagcacaatacttgaaagaggcagtatggcactgtgattaagaacataagctttggacttagatgatctgagatcaaatttcaactccaccatcaggtgtgtgaccttgggcacgttacctaacttttttagcactcaatttcctcatctgtaaaatggggattaaaatgttaactacctaagaaggttatgaagattaaatgagataatgttagaatgttcataaagcatttagcatattgcttcactcagagtaaacattcaagaaatgttaggaattattacaagcaataaaagttgatataatacagttaaccttcaaagcaaagttagttctgtttcctgctaccagggggtacatatagttctacaaatcttaatttatgagtgattactttttccaaacttcacctctagtattataccagatgttttagggcatgacttcccaaatacacaagtttaacaagaaaaatcaactatcttgaaaaccactagcctgtgtccccatttagtacaaaagaaaaaaaaaaccagctgtaattctaaagtatgcttgtatttttaaaaacacccaacttcccaccagggaggtaagtcatcatatgcaagaagacatatatatataaataatgaaacacaaaactattagcatgtaaccaggcaaactacggttctaattttgaagtaataagggatgtttacttttaggattgaaatgtaggactacgagattgccacggaatatcaacaggtaacacatggtgtttcttatggactttccctttaaacataaatttatttaaaactctgtgcatgatgtagtttaagtctttgtactagaggcttagatcccaaaccttagaatattctttatgttcagtaacataccaatattcttatgcagactaagctgatgaaaaacattatctcagaattcatatcttaaaaacactcacagaatactaaatcctttaataagcagcagtgtcttagactttaacaggcaattttagggggaagcagagaaaggcaaatggatgcattagttaccaaatgaattagtgttcttacgtctcttaggaaaaaaagtcacatttttattgtgtttcaataatttcaactaattcctccatccttcatgacttctctatttcaaccatgaattctccttgcctgggcttctttcttgaatttgatgctttcctaattgagtttttttgaggagaaggaaaggagaatggaggaagagaaaaattggaagctgcttttgcccatgattcccttattgtgaggaaaatgtggcctatttcagaactgcccaggcagaaaatgcatgctcagtatatgtccaatatagaatgttatttcttcctttgcctttacaccatgtataaaaagcacagatgtaaacacattgacatagtaagaaagtctgcactaggagttaggaagcctgaattttgttcctgaccttgctattaactttgtggccttcttgaagtcatttctctttctctctttctctctttctctctctctctctctctctctctctgtctctgtctctctctggctttttttttcactctctgcctctatttccacagggtgagataaaagagttctattggttgataactcagattctctacgactttaaaatttattggttctttcaatttaatacatatttgttcaagttgtggataatgttgattcattaggagcctgtgcttatgaaattatacgagagtgtgagacatagtttgatgagtcctggccataaaaagagggaacacataaaaaagatatgggaatattttaaagcaaacttctgtttctttattcaagaagtttaactatttaggtcatctcttaccaattatttggtggttgctattccaaatagggacacaaagaacagatcttatgtgaaaaccagatatctggtctgcctaggaaacaagaaagaagttaattaaaattgaatattaactattcatttttgatttacattttttccatttttcataacagatattcaaaaataactttttaaagctattttatacactgtaacctaattttgtaatgcataaactcactcacctgcctccttcatcacaatgaacatcctaaaggaatcaaacccaagccaaatatgaatcaaccaaataaatccaaaaccaacatgacctccttcaatccctgcagccatagagagctggacataaaactatcttgatcatgaccacaccactagacaagaattccagcaactgtttctcctctgggtatttaaagcattttaattaaaccagtgatcaatttttatctttgactgggtgcacttgttagtaaaacatgtttgtgcctataatgctgtcatatttacatttacttttaatactctatatttttactgttactatattattatgtatgttgtcaaatctagatacaaaaaaggtaagatagaggtagaggtttgaatattttccttctgtaccccaaatatgtcaggaggtgacatttaaaatacagaggtataattatcaacatcaaacattgagtaacaaactccatttaatattaaaaacagtggtccatatttgaatggttagagagaaaccactaagagtgaaagggtcttagggagttaatatgaccttgattttcagtgaggtcaatctattgttctaatacaataggagaaaacaataagatatgaaggttttggatcatggatatggagataaaaagatattttaaaatattctttgttgaaggcaagagccacatattttaaacacttgaaactaaaagttaatttacatacctaaattttatactggattttttctttttgacatttctctttgagaagttaattttccagatatcttctattcattgtaccaatatgttagtttctctttttcaatgttttttgaagattaacatgcatgtagaaaggccccaaaattgtaagtatacagcttaatggatttttacaaaatgaacagatctatgcaactaccaccaagatcaagacatagaatattatcactgccccagaagccacctccaaacccctaaattcttgtacatacttagtgcatatatgcatttctgataggcatatacttataataaaattgctgagttattcacctgttcagcttcaaaatatatattttaaagtttttgcaaagtacttgtaccaatttaccttctaaccagaagtgtatgagagttccagttgatttatatcatcaccaacatttgatgttgtcaggcttttaaaaaaaaattttgacaattctgatagatatgtggttatatctccttgtgaaagtaatttgattatctctgatgactagggtgaccataaatcctggtttaagtctgttttcctgacataattattaataatatgcctttcattctcaaaagtgtctaaatttggacaataaatttataattttcctacttatgattaatgaagttgagcaacttttcatatacttatcatctatttctactctcttccatgaagtgcctgttcagaactttggtcttttgtcctgttgggttgtctgatttttaaaaattggctcgtaaaagtatcttctatattctggataagagccctctgcaagatatatgtattacaaatatttttcttattccatggcttgtttttccactcttttaatggtgtcttttgattcagaggtccctaatatgatataggcaaatatttcaatttttaaatttatggtcagtatttttttggttttgttcaagagatctttctgtattccaacctcatgaagatattcttctgtgcttttcctagaatccttactgttttaactttcacatttaaatttataatccaactgaaaatgattttcatgtataatatgagctaggagtcaaaatttcttttttttttgaaatggatattcagttgatccagcactgttttgagggaaaaagcaatacctctccccatcactctactgtgccatcattttcattaatcaactgtccatatatatttggatctgtttctggactctctattctattccattgatctaggtatctatccttatgccaataccacactgtcttaaataatacagttgtatgataaggctcagtatctggtagtgcaaatcctccaactttttccttcttcaagattgtcttgactatttttgacctctggcatttacatataaattttagaatcaatttgcagtttatacacatacatatacattcctgggatttttatcggtattttttgaatctatctgtttgggggagaattgacacctttacaaaactgagtctttcaatccataaatatcccttaatttatttaaggctcttaaaatttctcttagcaaagtttggtagttttccatgtagtgttcttacacataatttgttttatttgtatcctgatgtttaaaaacttcatgttattgtaaataacagtagtattttattttctaatgcttgtaattggtacataaaaatacaatcgactttttaatattaaatttgtttccatcaatcttgctacattcaattattaactttaatgtcttacctgtaaagtgttttggattttcttgccacatgatcacgtcatcttatcctttaattcttataccttttagtcatgtaattttagattatgtgatttttccttttttattttgttaatagagtgaattagattgattgatatttgagaattccagatgcaaaaacaaaaacgtaagcataaatcattcgtccagtgtactcttccaaaaaatatttatttaccaccttctatgcaccagacacattgcttagtattgaggatagaaaaatggattcaaatagtcattacccttgagctactcacagtctaggaaagatagaaatattgagataaaataagtgtccaagtagaggatgttcaaacactattggaaagacaacaattcactctgtttagagaaatcaggagcagcccaagaccctttacaatgagtcttcaaagacaacagtgatgatgataagctcacatttgctagatgttcactctctgtctggcattccgctcagcactttcttatgcattattttatactttttacaaccaccccatgaagtaggtactgttatcatcctctcttatcagatgagacttagggagattaactgccttgaatgagagagactggctcaaaggagcacagccaatggcaaacacatccatcaaagttatcttccaaaaaaacaaactggttttcttcccctccctaaggataaaatctgaattaaggcaataccagtaagcatgaagagaagaaagccaattttagaaaggtataatctacagacttaggctagccacagcagcactaggatggctgggtctgctttgttttgctgtgggagcgacacatatcattgtacagaccattgggtttgaggcagcaccaagtagtaaacacaattgtctctgccaactctgggacaacagtagctcctgtctaacgtttcctacgaaatctgggcagctgaaggacaggtcacaatgggcaagaagaaaaggaacatgcagtaagaaagacaatttagaagctggtggtgagaaaaacaaaccttaggctgttcgccagttaaataaaagagaattttgtttacccatcacttttaaagtactacagttccccaaaagagtttttttttttcttctgggaaagtgggagtatgcactctcccatccccatggaggataacattgaggtttctggcttgagtaaaggtggaagagttcttgaagtggggaacacaggaaatttgagggaaatgatacgaactccaaatggacacacattacaagtgagaggggctggagataccaatcttggagtcaccagtcctctgggttaattgcatgggtaagatttaagttaattgcatagttattgcaagagagaacttgtccaacaaaaagactaaaaactgaactttggggaacacaatatttagtgctggaagaaaaaggtgacatcagtgacagggatggacaagaactccaaagctcatgctcttaacctgaaggctttactgcatccataatgtgtgtgaacagatttctacaacctttccggaaataggtttattgatgtgtatccagagcctaaaaagtataaatacatactctttgacctatcaatttcatatctaggaatttatcctgtggtaattatcaaagctatgcacaaagctttacatgtaaaagtgtgaaccacagcattatttatcttagtgatttattagaataacatgaatattcaactgaaggcagttggttaagtaaatcatagcacattcacataacagaatattatgcatctaattaaaatcatgctatagaagaatagttactcatatggaaaatatttaatatattaaatgataatagtgtacatgcctatgggtatacaaaagcatattatatacattgaaggatcctagaaaaattatgaccataatagtttcctttgaatttcttggctattagaattttaaaattattgctcctagtttgtaaattttagataataaacacagataatttgtccataagggaagaagttattttctaagtagaacttagggggagcagcagtgtccaatgctatagagaagtctaataagataaggactgaaaatggcttactgaatttagcaacatagtgggatcattgaaggcaaaaatggtcaagggaagaaaggatgtgatcaggaataaaagtcaagtggttagtcctggaagagaggaaggccataatgagaaagcagagctgcaactattcagagctggagtcttgtatgagctgagcacaggagaagaggtgaagcatcagagaatgcagagggtgtctttaaagtgtttccactgtgtttgagggaaggaggtgaggctaaggaatggtgatgatcaacatgcttgatgagcccaatcaggtgggagaggagaacaaggaaggatggcagagtgtgaggagagtgaatttttccattttaaaatcattaatgaaatcccctaattgcctatttgcggcagcagctattttttctggaaaactgtgctaatccaggttagttcatgtaaccatatgaaaaggcaaggcccaggagtccattttatcctctgcaggggctggaggaaaaggagaagggagatgaaagaagcacaggatgtctaacgaataaattccaaacagggagaaagagtaataagcaagtatgaaggaaagaatcattcctgttcaccagataaccccaactctccatatcaaatcagtcaatggagctcaaaaatgcccatcagccacaccaccccaacgaagtcacccaaagtttcaatgcctcaattttatcattaatatttatctcctgcacaccaaaatggtaacattggttatcttcatattttggcctcacagctgattctcatctttgtgctttttcttgttttccaagttgttttatgaaaatttgtgtgtgaaagggtttcaaaatttgtaaggagttttacaaatacaaatattgctaatattgaaaggaacaactgccaaaaaaatctgctttattgttccacatggtgccttggtcattcttggtttaacatttacaccattagagtctcaaaagttagacaacatgagacaaagcagcctttctagaaggcaacagttaaactaaatatatttctgcgagtgcttagttctttccaagcaaagatatgtctacttaaaaatgttaactagtttctgtcctcatggggcctttccaattaatggatctaattaaagatggtttagctcttggagccatcaacatgtacttgttatattttctagcctctcaaaggtggtcaaaggaaatgttaaataaattggtgataatataatactatttattaatgttcagtgtatttcctttctctagaaagatacgtacaactttaacaataatctaaagcaacactttctccccaaagataatctagtggtgagaaattctagtaaccagacaagctgagggagccaatgttcccagtcagtcccttgatttccatgaaataatagagagagaactgagtttggcctatcttacctgcacataggataaatcctaatggtttgtagaatagtgcctgtatatgattccttaaattcctgaaaaataaatgattgtgcttggagctgaggcattttctccactgcccatgcagcaaagtctgttggattcttagaactgtgggacttgtatttgttttcactacccactgcttccccattctatattttatttaagtcttagtaatccccctaacttctaacctctaaccttcctttcccttctgctcaactgtaattcttacgttcactgtccaatctacccttcttctcaggaaaggttctcaaactggttcacactaagtaacagaaactgagagaagattgacaagagcaaatgaatttcagctgatccacagagctttgtctcttaatgtttccaattttgcacatttccctttgcaacagaagcataactgatagaccagaaggtgttacagagaatagagaatgacctgtcctgccaggctagctctcagcagccactgtgggggtgcgggagtgctccaccacaaagatctggcaggcaaaatgggctttaatgctctaaatcagagaatctcagagcctggagccccattatccttaagtgctacatgacgaggataagtaatattgagttgtctataataggctttaaaaaaatcagaggaaaaactttacatggaagaattgcatgggactgaagagctacagagttcagatcacaccaccttagtgttaattgtgtaactctgggcattggccttccatggcagagaagatctaggtactgatggatttcccacgtctcctgaatttgtaacaaataaatggaccaccaaatccatccatgcataaggcctgccctactttttagttaatttctgacattccctttgctgaatgaaccttttctatttaaatgttgagtccaagtgttcattcttattgtaggcaaaaagcaaatactgcatgtgatggctctgaaaattctctccataactacacaaatggaaggaaatactgaattaaacaatggaatataataccttagactgactaaataatggcttgttttgcattagtgtatttattttaatgcattctttgaatctaataagaagagaagggcagaaagtgtcacagatgatatactaaagtgcaactaactacagaaaattgaattccgaggcacaatgccagttgaaagcaaggacagaatgattgtaatggtgaggatatttgtaaatagagtatgcattctaagaagtcacctaatacaagaggcggtcatctgcaaatgcagtttatgtacatgctattggggcaatctcagacaatgctcctagttggaataaatcccaagaaacagaggcaaaggcgaatagaaaataatccatctgaattccccaaagatacagcaaggcaagttgacttgtttagatattatattatttcaataatggttttagataattgtttataactttaagaagactcaaaataacctggtaaaacataatttcatataagatatagtctaagattttagaatatctttaaaatttttcatgattataaaaataatatgaacacatgaaaaatttaaagcacaaataaaatcaaaagctctaacctttccatctttagagatagcaattattaacaagttggtacaagtccttcctcaccttttcttataaatatgtattaagttcatgtcaatatataatatatttaatgacataaagcatattcataaattacacatagataatatatttgacaatattgaacaatattcaacaagaatgtctattatttactaaacatggttctaggtgttggggatacagcagtgaaaaacaacaacaaaatcctcaccttcatagagcttacattttagtgatagaagagagatggtaaacaatacaaagataaatgaataaattatatgttagaagatgttaagatgatagggaaaaaacagataagaggggtaaggagtaccaagggtatcaggccttactgtcaggtaacatttggacaatggtcttaaagaggagaggatatgagccatgcagatattgggggaagagtatttcagctgagggagtagccagtgcaaagcccctgaggtgggcgtgtaagtggcacattataggaacaaggagactagtgtggcttgcatagtatgagtaagggatgggggtggatgatagggtgccagatggtgtatggcattgtagatctctgaaagaattgcaaatttggcttttactgcagtgaaataaggagacactgaagagtgtgtgagcagagttgtaacataacttaaaatttaatagcctctgactattgtgttgagaaaagagtatagaggggcaaagtggaaggagagggacagtttaagaggatttgtacatgaaatagtacagggatgatagtaggctggatctcggtggtagcagctgagtggtaagaagtggtcagattctggataaattaagcaattggacttcctgatgaattcatgttcaacatcagagaaagggagaatcatgcctatactttttttgacataagcatcctgaaggattgtgttgcctcaatagagatatggaaacagagagaggagcaggcttggggggcaggagactgtggcctgtgctttagacatgttaagtttaaaatacctattaaaaatatgcatatactgtttatgtatatacccacatatattattctatacatacttctatacattattttaaacatacttctctgtttacttttttcttgtagacattttaaaatatcaggatatatagattgcttcatggggtagacattgtgcatggactatattttagtctttattagggtatgataggcaaaattcttttttttttaagatggggtctcatgctatagccaggctggaatgcagtggcatgatctcggctcactgcaacctccgcctcctgagttcaagcaattctcctgcctcagcctcctgagtagttgggactacaggcgtgtgccaccactcctggctaatttttttttttttttgtatttttagtagagacagggtttcaccacgttagccaggaaggtctcgatctcctgaccttgtgatccgcctgcctcggcctcctaaagtgctgggattacaggcatgagccactgtgcccagcctataataagcaaaattctaagatggcctctaagaatcccacctgccaccacccccaactctggcttcctacatatcttgaataatcctttcccttgagtgtggacagggcctgtgaatatgttagcacggtcacttccctggtgatgttacgttacatggcaaagacgatgggataatcactcctgagattatataagccactccggacatgaggtaagcttctgtcacagccaactggagtgagattctcccattggctttgaagaagtaagctgccatgtgatgagagggccacattctaggactcaagggcaatctctgggagctaagacagaccctgggccatggccggcagaaaaatgagagcctcaatctacaactgcaaggaactcaattctcccaacaatctgaatgatctttaaaaagaacgccaagatccaaatgagaattccacacggccaatatcttaatttcagccttgtgagaccctgagcagagaacccagcaatgccatgcccagacttctgacccacagaaactgtgagataataatcagtgttgttttggctgggcgcggtagctcacgcctgtaatcctagcactttgggaggccaaggtgggtggatcacttgaggtcaggagttcaagaccagcctggccaacatggtgaaaccctgtctctgctaaaaatacgaaaaattagccagccatggtggtgtgcacctgtaatcccagttactcgggaggctgaggcaggagaattgcttgaacccaggaggcggaggttgcagtgagccgagaatgagccactgcactccagcctgggagacagagaaagactccatctcaaataataataataataataataataataataataataataataataatcaggtgttgttttaagtgctgagtttgtggtgatctgttttgctgcaatagaaaattaatatacataataaccctgacaatgtcttcagaaacacacatggataccctgttcccatggagcagatgactgataaagctacaaaacctaagaacagatgacccataaacatgagggtttcttgtactactataaataaatataatattatattgagtaggtcttttctgtcttacattcttttcatagaatcttgtaacagaataaacagtgattttcataaggtcgcagaatttaaagctcacaaatgtagttctagctctgtgacatataatcttttgtcataatttttccacccataagccaaagagtctggccttaaaaccatgtatgctatcaagcccagcaggtgccacttttgagagccaactcaaacaggcattcagaaggcaaataatcactatggctcacctgctaagtctgctctgttcaccacaaggagggaactccattaaatatttaagacaatcactaagagaacacccagcaggcaaacaactatgattacttgccccatagccctctcagcaggcatctgacagcacttgggatggggtttacatcacattaaagacatccctttgtagctcctatcaaaaggaagaccaacagtttcaaaactgagatttcaaaataaggatcattctcttgctgcatatcttgggcagagtttctaaggacttccctgaattttatcaagataggaaagacacagaaattagaaatctagtttcccttcataccttaactgtatgcctaaagcaaagcttgatagagtaaattatctcttactaacagaaaatacccactggtgtcatgaattcccaaattggcaagcttcctatgctagtctgaattgaacaagaagctatcaaatgcacacaagtgggtgtattgggatcagcaccagcagttatcaatctgaagaattcacaatatggtccatggggcaagtcattcataagttgctgctgaaatatttcattcacataatagggaacacctccctatcccaccaacactgatcaggaaaacccatttgggcttaatatgaacaaaaactaagcctctattatattaaaccacagaaattttgaagtttatctattactttaactgatgcagggattgtaaatgtagtcatcagggctatgtttgaaatatacaagtgcaactggctttagctatgtcttaaggattggtgcggctttagctatatgtttcaaggattggtgggttgcataggcttgggcagtacaggtattacagtaggtatctagtcaggaaggagcacggcaggagaggccccccctgacccctccacgaatgtcaggtgaccatcaggtgatggtcaggtggttgttaaactgtctctctaaaataataattggccacagccagtgccaacaaaaggcagtctcctgatagatagaaaaaccctgaaactagtgatcagtagtgtgatggttaatactgagtgttaacttgattggattccaggatgcaaagtattgatcctaggtgtgtctgtaagggtgttaccaaaggagattaacatttgagtccgtggtctgggaaaggcagacccacccttaatctgggtaggcaacatcaaatcagctgccagcacagatagaatataaagcaggcataaaaatgtgaacaagtcagattggcttagcctttcagcctacgtctttctcttgtgctggatgcttcctgccctcgaacatcggtctccaagttcctcagctttgggattcggactggcttccttgctcctcagcttccagcctattgtaggaccttgtgatcatatgagttaatactccttaatactcacatccatctatctatctatctatctatctatctatctatctatctatctatctcctattagttctgtccttctaggtgactaatagaagtcgcttcctgataagatcttgggagttgggcaagcagactcaagcatgtgcattaagagacaaaatggaagagtttaactggtatatgaccttcgagaaacattccgctggtatgggaagaatgcctccagtaagcatgcagacaactccagtaaacacactatgtgtgctccccttccaagcgctagcaggccactatgcatgcagacagcacactccaagggaagagccagggagaaggaatgaaagatcctggaagtatgtcaatgcataaaattccaagtcaaagatcaaacagcgcacttgatttctcaagtcacctgcttggccctcctccaagtgtactttacttcctttcattcctgctctaaagctttttttaaaaaaactttcaatcctgctctaaaacttgccacagtctcttcttctgcctaacgcccctcagtcaaattctttcttctgaggaggcaagaattgaggttgctgcagacccacatggatttgccaccactaacacagccagcccccacatttaatcatctccaatgtgcctaggaaacctggtgcctggatgtctggccactcttatcatactgctgggtcctataagggaggacctggtgactatatctgcacagtttataagatatttatgtaggactttacatgttgcaaactaagtgatatgtccaagactcctcagctcttgagcacagcagataggacaaaaaagtaggtatgctggccatgagttcatgtacctgtgaggaaggagaaaggaagaatgtggtgactctgttgcctaggcagaccctcagcagctgatgctctccccaagaggatgctaaaggaaagagcactgaatcaggaaccagaaggcccagagtgttttctgtgatctgccttaagaaagctgtgtggtcttggcagaccaccagctccccaagtctccatttcctcccctgtaagctaaaaaatatccaatatttctatttactgaaagttgatgtatccatagtatgaaatcccagaatagggccaatccattttggggcattctatcccagtttctgatgaattggggtcagtaaaaagaattcattgccagaattagccactgagctattgagaaatttagaatagatattagtgatagaggcaggaggcagacaaaggcgtagacagatagagaaggatctctggagaatttccaacctgccccacaagtgttacaccagatgttttgtgcagataagggaacctgcacagggggcttacctgggcatgcccacggcagactagaggcccacatgcactgggggaatggtgtggagccaccagaaattcgggcctaatgcagaggaggagcctggcctcttcagctggtgtgtagtggccctggtattcaatttgggaggtggaaacctgcttgcaggaccccctctctttgctgagaggtttcttttcacttaatacattccaccctcctcacccttcaatgtgtctgcctgcctaattcttcctggtcatgagacaagaacccagattagctgacctaaggagcaaaaaaatcctgcatcattttggtggcctctacggggacttgtcagaagggtgagtaaaatgcagacccaaacatctctctcacttttgtttctgagctttcttgtcctcagactttttctgaaggcagaggaaactgcccccttccccaccccatcattctcaggcattggaaatgtcggcctcagtcaaacccagtcttttccatggattttccttcatttttgggggaatgtattggcacctatcttttcttttacaatattaggggtgtttcaccctcaccccaatggttgcaggcatgtgcacaggacagacaggtgagcagtggctccctgccccactcccctcctgtctggggcacacagcctgggcctggggtggctagctggccagtgttccccaccaggcacccacgcagtcttcccttcccctggccaaggggtccagctcagtgggagtcccaggaaggagacagcaatgaaaggtttctctccctgatgaagaaacccattgcataagaataagaggtttctcccccaggaatcttcccaggcttgcacctaagcttttttttcttccttttctccaccctgtaggcagttaatgcagccttgcagatatagggagcttttctatgcaagagttttttttttcattttggaaggcatcttgttaggccaggacccaaattcacaagacaccctttttctctcccttgttggaggagaacccagctcctcagctttaccttagcattcagcttatgataaggaggcagcagccagctgctggctgcagtctgtcaaggtctaaggaacgcaaaggttatgacaacagtggagacagggtgtatgtgggtgagtacgatattcccaccctctaggcccctgtgttaacgtgagtggaagctgcactgacacctatcgatagcaccctgtcaaggttgccaggacttgaagatacaaggacagaagaaagaaaagaaacacctcttctttctctgcctcatgtaccccatatttgctgggaagacaaaggaattagggacaccttatcctgtcttcctagctgggtaaccattcatctttagtctgtacctctctcaaatgcatcctgaggcaggggggctccttagagaaaatgccttctttttcctttttcctcctctgtcctctcttcacagaggggtaattgtgtccccctactacaggatactcccctcggatgcatcctccaaactgggaaaagttaatttcccagaccttaaactgcttggtctagaactgagctgagggtgagaggtgacagcgtgctggcagccctcgcttgctcttggcacctccttggccttggcgcccactctggccacactataggagctcttcagcctgctgctgcactgtgggagcccctctctgggctggccaaggctgaagccagctccctctgcttgtggggaggtgtggagggagaggtgcaagcgggaactggggctgcgcatggcactggcagcccaccacaagttctgggtgggcgtgggctccgcgggccctgcattcggagcggccagctggtgccgccggccctgggcagtgagggacttagcacccgggccagcagctgcagagggtgtgctgggtcccccagcagtgccggcccactggcgctgcgctcaaattctcgctgggcctcagctgcctccctgctgggcagagctcgggacctgcagcctgccatgcctgagcctccccactgccgtgggctcctgtgctgcccgagcctccccgacgagcgctgccccctgctctgcagcacccggtcctatcgaccacccaacagctgatgagtgtgggcacacagtgcaggactgatgggcagctctacctgtggccccagtgcgggatccactaggtgaagccagctgggctcctgagtctggtggggacttggagaacctttatgtctagctaaaggattgtaaatacaccaatcagcactctgtgtctagctcaaggtttgtaaatgcaccaatcagtgctctgggtctagctaatctagtggggacttggagaacctttatgtctagctaaaggattgtaaatacaccaatcagcactctgtatctagctcaaggtttgtaaacacaccaatcagcaccctgtgtctagctcaaggtttgtaaatgcaccaatcattgctgtgtctagctaatctgatgcggacttggagaacttttgtgtctatcttggggattgtaaatgcaccaatcagctccctgtaaaacagaccaatcagctctctgtaaaatggaccaatcagcaggatgtgggtggggccagataagggaataaaagcaggctgccggagccaacagtggcaacccgcttgggttccctaccccagtgtggaagctttgttcttttgctctttgcaataaatcttgctgctgctcactctttgggtctgcactgcctttatgagctgtaacactcacagcgaaggtctgcatcttcactcctgaggccagtgagaccacgaactcacctggaggaatgaacaactccggacgggaggaacaaacaactccagacgcgccacctgaagagctgtaacactcaccacgaaggtctgcagcttcactcctgaagccagcgagaccatgaacccaccagaaggaagaaactccaaacacatccgaacatcagaaggaacaaactccggacacaccatctttaagaactgtaacactcaccacaagggtccacagcttcattcttgaagtcaatgagaccaagaacccaccaattccagatacaaggggaagggaatccagaaacctgacgtgccagcaaaagggtaaaagtttcttttaccagttggacttttggcctctccctccgtgtgcaaaccggtaaaaggaatggtaaggatcactgtttatattctctgtaaagttttgattaatgaaaaaggatttatgagtttggtcttaagctgtagccaatctggtatgctttgcatgtctttctgtatggttctatcagaaagagaggtactttaggacaggatgtgggtgtaggaccccataagtccacttttcaagtcagcccagcaaactggtcagtaacaaactttgctgcaggcttgcatcttgtttacatcctggggagcatgacctgtaactacgtgggagtgctttgttttagtctgacattttacaatggtggctcaggttcaatcctggcttggagaatgggtactttctttctttctttttttttttttttgagatggagtctcgctctgtcgcccaggctggagtgcagtggcgcgatctcagctcactgcaagctctgcttcccgggtttacggagaatgagtactttcaagttaatagctgtgtgacttctaccatttgctgattttcttcccttccatgaacaacttctagattctcttcttaaatcttcccttctctgagctacccttaaagattctagatgttgtaaaaactgcttacctcctgctttgaaaatacttcgtacactggtagtaaagtcataaccttaattgaggcttgttggtttcacctgtgaggttacttttggtaaagttcaaaagccagaaatattggctgcttgacatggctaaagtcaggtaatacgggatttaaaaggactttcttaaggagtgctcagcttaattaaaagcagatacccaagtatgtttaaaggacctttatggtttttttcccttcttgaatcttgtttttctggaaaaaggtttcttctcagttgattgaattatttttctccattttgtcttgccactcttaaggcacacatgagaggccctaaaataatttctgatggcctgtgactccttggcaaaaacagaaaaggcaccacagatcccattttgtgagaaacctgttttcctcatggaacctcagaaattagaggcaggtagatccctctcaaaatctgtttttgtcttccagccatacctgtttgttaggccctagaaaatacaagctttcctagccttgctcttaaagggctccacccagaggccaataatccaattagattggcaaatgaaaaatcttacaactactagattttcttctgtctgtctacataatcatatatgtgttatgtgtgttatgtttataaagaaaagagctctaattaattggtttgaaggaaaataagcacttaaatgaaatatttttttaaaagaaagacaaaagctgtaatactttttagtatttagtctatcgttccttctccaaagaggtaattctaactgccattagaataggggcaaagacggatcttaactgcttcctgctgacagggggcactattttgggaagatggcagtcagatctcccccagaggcctagctaagtgtccccagtaaaagggagccatcgtctgtggttctggttgcatgaccgtttggagttcgatggcctacaggggagaagagactaacttctctgatataaaatcagtcctaactcaaccacaatggaaaagtatataaatgttgacatctgtaaatcattttcagtgctccagtcatataaccaagttagtagtgttctaccttaccagaggagaactgaagaactttgaactgtgaactttcccaaggaaaggtaagtcaaatttcaaatttagtgtataaaaactgaggagaactagagggtagtcagtgttaggatagccaagggagcagctggaaaggcacccaacgcagactaggacttcatttaaggatttaggagcctctaacctcaagaaggaatagaaaatacatggaaaatgtagcctggggaagagagttctaggcagctacagggaggtggtaagtttgggaatataaggttttcctgcagagatctgcaaagatgatctgactgaagttgtaaattagactttgaccccagcctccctgccatcaccatgtcctggccacagacaatggagacagcacagggcaggattaagattatgggctgtggagtttgagaggtagtaggactgaatttttgtctgcctccagagccatagagcagctctcaatttctgtaaaatgggaatgatgacatctacttctcagggttgaagtttaactgttcagttgttatcattactaacctatcccctgctttgtagccagtgtgatcattctaaaatataactcttgcttctcccccatttaaaactcaatggttccccattgcacagaacaaatactccaatttcttaacatgcctttcaaagttttttggtgatctggtccctgcttccctctccagtttcatggatcatggcccttcagccacattagatcatctcacttccccaactccccatgcctgctcagctttgcctggaacacacatctccttacccttcctcaccaaaaaaatgcctcctactcttcagacttcagctggacaatcttcaataggaaaccttgtatttaatgaatgtgtatattcaatatgtatatatgagtatatatatagagagtacacatatgtacatagagacattatcagttcatgtgaatttatctgtatgatactctacactaccttagaatgtaaacttcaaaattgttttaatatattctgtatatcaacacagtgtgcctagataattaacattaaacaataatgccaaccaatttactgtttcttgggagcaatttttataaatatggtagttgttttagggtctattgggaaataactttgttatatacacttttcattaaatagttcatagtttaatataaaatatacccaatcataaacgagcatcagactaaggataaccatcttgctacaaatcatggtagagtcagacaagtttttctaacttagagtcaacagtaggcaatgctaaaaataagatcacaggggaaggatgcaaaagaattgctggtaagtattcctttttgtgtttcaactgttttcaacagtgcgacaactgaaacttaggattgcaaccagaggggctcctcttacctctgcatcaaagcgcggatcctggtaggcatcactgatgttcactggaaggcctgttgaagcaaccagctcagcaatgctgttatttattagccagtcggagtatgatgatttctccatgctttctttgaaactatcagagcaccaaggtaggcaggaagaaaagagagaaacgtaagttttcttgaaaggaaaccctataaactacactaatatcaggataatctgtccttattaagaaaaaataagtgacattagtcacagaacaatagcaaggtaattatcagtagctacttcgaaatgacttacctgctataatgtataataattaaatccatgggcagaaaccatagattccctatgattcagagagactctaggctgtatttaggtcccaaagctggcaaacacatgtaaggaccaaaattaacaataagacaccaacaactaataaaattccatcaacttcccagcttgccctttttaattgaacagactagatgttttggcacaaggaagaatgaaacccaagtagggaaaaatcaggaagtaaattgggaatttaaaaaattacaaatgcagcaaaagaatgtatctagactatggtcttttaattagtaattatttgaaaaacaattttactatcttagtcattattttgataacattaatattttaataacttttagtatcttagttaactattttggtaattttagattatgtttcttaacaatagcccatataccacttacaaaatctcacttaaaaggctatttaatgcaacagacccttaacattaataattaaaactattttcatatttaatttgaacaaggaattttatgccaaatgattttttgaactttcccttgtatcattttcatgacagacactacataaacagaaatgctgtaagaattagttaatatccctcattcttctcctttccatcttttcttccacaagtatatattgagcactgccaggagccgtggagatacaaaattgagaactgttcaaattagtattggcaaggaaaattttcctggaggatgtctgatttgtcgcttggcaagtgataactgaaattatgtggatggatgcaagcatactagggcaaggttttcaagctgccttatgtggaaccctggatttcatgagatgttaaatgagtatactacagcaagaataatcatcactctattgactttttaatctaaactgcactatatgtaagaaaacactaaatgtgcacatcgtctttgttattatgcaataatgtccctgtgtaaaattatgccatgttgagaaggcaggaaactgcatggaaaggccattggatgcatgagtgagtgggacacatagacattatttaacatcattaatatatctcatctgtaatgattgctggcctgtgtctgataaattcagcatgtatttgtaatgttattcatcccttattgcatattaaacattaataatacataaactttattctctatggctctctggctgaaaaatggaagttttaataaaaagctgagtcttgtagttcttagatggcacctaaatcaaagaagtaaaaagactgagtacttcaaagagaagaagaagctttattttctaaaacaaatcaaaacaaaagaacaaaaaagtttttattttctttttgctgttttatatgcatctcatttcatgagatgaaattttatgttgtgctgcaatgaaagcaaaatctaggagaaacaagataatgcacctcacacaaagatctaaatgacttagtgaagtcatttctaagtttataaaagggtatgggctaaattctgacctttcagggattaattggcttgccagttcattctgcactgtgtactttattccacattttaatttttgaggtgttctgtgatcacaccgtttcgaagctgctgacctagagtgttctgtggagtgtgggaagcagcgctgcagcaggagctggggagaggtctgggcacagaagtaaaacggttgggtagggtggggctcaaggaaggagccagttttaccaataagtgtcaacaatcttcaagctgggtctttcaggatgagaaagagttcaacaaggagagattggaggagttagaaggaaacagcaggaacaaaagacacaaatgcagcagagtacgaagtgtgttcttggcacaatgagtaattgtatggtgggaataaaactgaaaaagaggccaaggctcaaaggtgaggccttgaccaagttgctgagaccttagttataggcaatggagaactgtttaagaatatggagcagggaagtgacgtggtttaagatgtgattttagaaagcttaatccaggtacaatgagcaagaagaactgggtaagagacactgaggatgggaagaggtcttgtaaaccacagaagtcatgcaggtgggaggtgatggtgctggtgactcaagaggtactgcagaagattccacaggctctgtggccagatagcagtggcttacattttgttcccgactgcctgtggccctattagcagaacacagttgttttaaggagtggggagataggggaaagatgacagatattctgtaagcctgggacatgttcatttttgaaagtccaggaacaaaatcctatcagtcctcaggactgaaaactctaatccagagttaggataattttcacggagaataaaatgcatgagatcactcagggacagaacacgtagggaaatctatatctagggaagggaaggaggagaaaagtggtaataaagggggaagggagaaagagaagaaattttaaggaagaaaaactgaaatttattgccatctactgtgggccaagggtcaggccagatactttacccaactaatttgttttgtcctcagataaatcctgtgagatggatatgcttctctatattttatagatcagaaaatggagacctaggatgctcaataactttcccaagtggagatagaattttcacctaaatctgaccccaacatcctaaattatagtatttttcctgttgcctttcagaaggagttaatggatagcgttatagcaagaatagtgggttgtcacctaagaacaaatagggaggggcagtccacatcagagagagtttaaggaagctgctaaagataataaacacttcactgtgagactttagtcacaggaacagggaggaaaaaccattggagttgataattaagagctttaggtccctacttacagaattcccaaagaagatacgatgacaaaaacacttactgagcaggggctcctgaaaaactcactctaaatctaaaacatgcttagaatgtggcttggttcagtatgcatactgaattgaaatcattgtaaaatcagtgaacagtgtagaaggaatattgactctgtgcaaggcagggttgaggccgtttctaaagtataagctatgatctctgctctcagggagtttgctacttaactggggagatgagaaataaacacactgacatataaacaatataaaaattaaatgcccacttcaaatttcaaatgaaaaatttttcacatagatgtgttgataagttaccaagtcaactgtaccaatcacgagtgctgaagacgtccatggagggagaaatgacttcaggtgttgtaatctagctaaggcttcagagaggaggtgagattcaaactgacctatataggtcagtgcaacagtgcaaacagattttctgaaaatcacctctgcatttcttcagtttaatgttgcacaggaacataaattaaggcctgagtgatcagatcctcagagagacagataggaaagttgatttgtcacttggtatttacatcactgtcttagtccattcaggctgctagagcaaaataccataagttgggtgacttataaacaacaaatatttatttatcacagttttgagactaggaagaccaagatcaaggcactggcagattcagtatctagtgccttcttgctttagttcagtgtctagtgccttcttgtcctcacatggtagaaagaatgagggatctctctggggcctcttttataaaggcactgattccattcataagagctccacccccatgacctaatcacctcctaaaggcccaccccttcataccctcacattagggactgggtttcaacgtatgaatttttgggcagacacaaacattcagaccagagtaatcacattctggcttacgcaccagctcaattttggaattccttttttttttttaattaattaattaatttatttattttttattgataattcttgggtgtttctcacagagggggatttggctgggtcataggacaatagtggagggaaggtcagcagataaacaagtgaacaaaggtctctggttttcctaggcagaggaccctgcggccttccgcagtatttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggcaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcagccgggcagaggcgctcctcacctcccggacggggcggctggccgggcggggggctgaccccccccacctccctcccggacggggtggctgccgggcggagacgctcctcacttcccagatggggtggctgccgggcggaggggctcctcacttctcagacggggcggttgccaggcagagggtctcctcacttctcagacggggcggccgggcagagtcgctcctcacctcccagatggggtctcggccgggcagaggcgctcctcacatcccagacggggcagcggggcagaggcgctccccacatctcagacgatgggcggccgggcagagacgctcctcacttcctagatgtgatggcggccgggaagaggtgctcctcacttcctagatgggatggcggccgggcggagacgctcctcactttccagactgggcagccaggcagaggggctcctcacatctcagacgatgggtggctgggcagagacgctcctcacttcccagacggggtggcggccgggcagaggctgcaatctcggcactttgggaggccaaggcaggcagctgggaggtggaggttgtagcaagccgagatcaagccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgcgtgcctgcaatcgcaggcactcggcaggctgaggcaggagaatcagacagggaggttgcagtgagctgagatggcagcagtacagtccagcttcggctcggcatgagagggagaccgtggaaagagagggagggggagaccgtggggagagggagagggagagggagagggagagggagaggctggaattcctaatggtctactataatgcagaatcgtaacactgagttagagctttcaaaagcttgcttctcttctttacaaacaaaaggtaattttatgttatgattaggatcatgagttttggcatacctcaatcaaatgtcccctttgctgatttctagcaaagtgatcttaggaaaacttccttggtaaaatgggtataatactactactgtagagattaaggtgataattcatgcaaagtgctcagcatattatttagcccatagcaaacattttctaaaagcatcacaacttttaaagcaaattctgcacatgacagtacccctttatacatttcagtgatgtggtgttgtgagtttaatcacaaaggaaagggcccaaattatttctgcttttggaaggacacatctaacttttagggtaagctctttcaaaaagttcctacagctcatcacctccccctgatttatgagggaacttttattcagtatggttttctcttttgcaattggttgctgttgggacagaacatggtaagatcacagacacagccacgtttagttgtgcaggttctgccttgcacacggatgccctataaaagggagaagtgggggtggaaattagtctaactgtgcttgtttgcttgaagttgcatccacctggagagggcaccttttcctaattctcacagagacatttgtatgggctttcaatggccctccttcaagcttttcttcaacacatctgaaaattgggcatgtaatctcaaatggagcaccatcagtgacaggaaactcactacctatcatatattacattatattttgtggcagctcagtttactttctaatagtcatcatccttggttccaagttccatggtttgtggccacagagcatggacctcattatctgacagccctcaaaatatttagcaatagttaacatgtcacccatgatcatccacctaacatcattcttctcccacctgtctccaattccttaagttactcctcttgtggcatgccttccttattcgtaccatgccagccctagatgtaaccccccttgttaatagtcctttggagtatgaaagccagtccagtccacagttctctccatggggtctgagtaggatgaagtgggtatgaccacctccttcattctagaacctatttctagcaacaaacatcaggagtgatagttcccaataggtcttatttttgataagtttttggaagtttaaattaatattaaccaactttcttgagtctaaattaaccaactttcttgagtctaaaaactcccaccagagatatcaaaggccaacaaatccaatactaagattttcagtttgggccagaaccaagatagagactcactgctgtttggaaacacaactacaccttgattacaaccaggcctccaaagcttatgggtgcaaatcagttcatgtcaactcagtggttcttagctgccatgtatataattgtaagacgacagacacctccaagtccttccctgacctccaacctttggggatacttattctttcattcaaggcccgttgttaaagcctactgcttagaaatcacttgagggagcctgacccgtagctcccagactgccaaagcttcatagaagaagggaagaatactgtctgccaagctctatgcagcatgttggtgcctgagccctaatgccatattgcttgtgcccacgttgtcactagtttcctatttaaacagctccttttgcctttgcccatacccctctctgtagacatagagggcagggctgggatgcccattcacattagacgagtactcatgtaccaactcattctttcagcaaaaagacaaagacccttatcaatctcctcatgcaagtgaatgtctagtgtgaatggtgtgtttgtgtgtgtgtgtgtgtgtgtagccaacacattaactgtacactggtgcataacaagaaaaaatggcatagaattcttagcaacatttatttgttgttgaagactaatggttgattgagaaaccattcaaatgtttctaaagtttttttttaaagcaagtcatttgtccatgtttaatttcacttgtccatatttaatagcttcatacatttaagtcacaacactattttgatccctacagtggggatattttaaaaaattctggcttaaaggaaaaaaacagcagacagtaaaaatatattgatataaatgtttgagaaaagtaaaagaaacatagttgacacctgaacttcagtgaaacttccttaaaaggtcatagttaaccacttaatagcttattttaactctctacaaagtagacctccctaagctcgattcacttcagcataacactctaattgtaaagaaatcctttatcttgttattttgctagaaaaaggggtataagaaaatgtaggtttttaagtgagtttcacgtaaagggctgtagtttagattcttctcagtggtatcttgcttccaaatgtgagactcaaactgacttcaaagagagcttcatgagctcaaatatattgactgtggagggataaaagagaattgccctattacagaaaacacgtaattcctgaaatgtggctgcccctgaagtgagggccggtgaggtatatataaacctcagggctgacaagttgcagagtcgtgtaggaggtaaatcaatacgagcaaagaaaaacaagacaaaataaaataccccagaacaagtgactcaacatctttaattgtctgaaagtcctggcttagctgaaggttcaaatacagagaactgtgtgaaaataaaaagactatcttcagcattacttttccaaaaaaaagagtctccacattagaagacaaaacatcttaataaaataatgctaatcattagactgtgcttgtgttcatgtttctcttctcaacataacagtttacttagatgtcttcattagaaactctcaagagtctttcaagaatgacaactagtttggcctctactaagtgctggacaggagtgagccaaatcttgcattaagcgaacaataaggatcttttccttgttgttgaaagaagctggcacatggaaacccatccttacacggatgtcagcccagcctagcccctacttatacagaaaggggtatgggcagaagccaaaggggtatactctcagggagctcacaatagtgatactgaattgtgataaatggcctaatggaaggatgtggaaggatgttggtctaagctggtctttagaggataagtaagagttcacctggaagagaaagaagataaaaacaattcagtcaaaactatagcatgagtaaagctttaaaaagtgtggggttttctccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaataccttttatttatttatttattattattattatttttagtagagatgaggtttcaccatgtagtcccagctactcaggaggctgaggcaggagaatggcgtgaacccgggaggtggagcttgcagtgagctgagatcgtgccactgcactccagcctgggcgacagagcgagactccatctcaaaaaaaaaacaaaaaaacctaggaatccaacttacaaggaatgtgaaggacctcttcaaggagaactaaaaccactgctcaatgaaataaaagaggatacaaagaaatggaagaacattccatgctcaaggataggaagaatcaatattgtgaaaatggccatactgcccaaggtaatttatagattcaatgccatccccatcaagctaccattgactttcttcacagaattggaaaaaactactttaaagttcatatggaaccaaaaaagagcccacattgccaagtcaatcctaagccaaaagaacaaagctggaggcatcatgctacctgacttcaaactttactacaagggtacagtaaccaaaacagcatggtactggtaccaaaacagagatatagaccagtggaacagaacagagccctcagaaatactaccacacatctacaactatctgatctttgacaaacctgagaaaaacaagaaatggggaaaggattccctatttaataaatggtgctgggaaaactggctagacatatgtagaaagctgaaactggatcccttccttacaccttatacaaaaattaattcaagatggattaaagacttaaatgttagacctaaaaccataaaaaccctagaagaaaacccaggcaataccattcaggacagaggcatgggcaaggacttcatgtctaaaacaccaaaagcaatggcgacagaagccaaaattgacaaatgggatctaattaaactaaagagcttctgcacagcaaaagaaacgaccatcagagtgaacaggcaacctacagaatgggagaaaatttttacaatctactcatctgacaaagggctaatatccagaatctacaaagaactcaaacaaatttacaagaaaaaaacaaacaaccccatcaaaaagtgggcgaaggatatgaacagacacttctcaaaggaagaaatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggagggactgtaaactagttcaaccattgtggaagacagtgtggcgactcctcaaggatctagaactagaaataccatttgacccagccatcccattactgggtatatacccaaaggattataaatcatggtgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaaggatgagttcatgtcctttgtagggacatggatgaagctggaaaccatcattctcagcaaactatctcaagaacaaaaaaccaaacaccgcatgttctcgctcataggtgggaattgaacaatgagaacacttggacacaggaaggggaacatcacacaccaggcctgtcgtggggtggggggatcggggagggatagcattaggagatatacctaatgctaaattacgagttaatgggtgcagcacaccaacatggcacatgtatacatatgtaacaaacctgcacgttgtgcacatgtaccctagaacttaaagtataataataataaaaataaaagaagtgtgggattttctgtattggtatagtaaataatagagctgacgcttaggatacacggtggaagtggtgaataaggctactgcggaagaggccaaccaatatattgtgtggtttcatgcacaagctttgtatcccaaactacatccatacagatgactctttctgtttttcgtttttaaaatgtctttttttttaacttttaagttcaggggtacatgttcagggcatgcaggtttgttacataggtaaacatgcgtcatgggggtttgttgtatggattatttcatcacccaggtattaagcccagtaaccattagttatttttcccattcctctccctcttcccaccctccaccctccagtaggccccagtgtgcactgttcccctctaggtgtccatgtgttctcatcatttagctcccacttataagggagagcatgccatatttggtttcccatacagatgactcttctctgtatcagcagcccctagagtccagagttccctatgtatatacctaagtactttctggggacttcctcctgagcacctcaaagttgccattttcaagatcgaactaacacactacccttgatgcactagtggtcattaatgaagagtgtgaccattaactaaaaatagaggattagggtgggactgaaagtttcaacataagcacaatctattttctcattaccaaggaatgattgtcagttgcccttctgacagcttgagtgttacccagtgaggggtaggagccagagaggcaaagagtcaggaactcaaataactatttgggacagatttctttttaatgctttgcaaaccaaatattgatttttgatctatatgatagtatttgacattttgtttcattgactagaggtcaatctgaggttgggttcacaaaaagaaactgcattccttacttttttccccctcagctcagcctgtctatccctggagcccttcctgaagcctccagctgtgcaatgctttttgaagttgtcttttaattaggagattagggaactaagtaaataccagtgggactcaaagctaggacctcagcaggaaagtctcgaacacccaggacttgggacattaaaaatcttttaatggcttaagtatatctttgaaggttattgaacaagtcttttagtcatataaagtaatgggagagagtgtaattaacaagcagagccagcctgtcagctcttaccctgtggtaggaaaagaagattctctaagttgcaggagttcctaaatttatcatgatctgttagtggagtcgcctttaatgtcttgcctgaggacacttcatcacacttttattcctctcattttaagcattctgtattaacagaaattaacacatggtgaccaaagaacacattttctatcttttatttcctcaacttctgcaattagaatgatgagatttatcagccggtgtcactgtgcagttgtgactatcagatgggtgtcagatgacattgctgtaagtgattggtatctaccatctagcatcatataatgacaattgcctgcttctgtcacagctgaataaatctgggtggtttttttgttgttgttgttaatcttggtccaacatttcctgtcagtgagattacagataattttattattatctctaatttttagtttccataatggaaaacatgggaaataaaactcactttgcagggctgtttggaggataaaataatagaatgttgaaggctgcatagcgcatagaaggctctcaataaataccggctctttatatcacaaagatttttctttaattaaaaacaccaaggtgagacatgctctgtttaactgcttaacttctaggacagtagagagatgttaaatgtttttgacggtggcatcattatcagatttggagaaatactgaggagaaaatgtgccagctggcaaaactgctgatactagagcagtcaggattctatcctgctggaggtttcaagtagccccacaatatctctctgtgagggtgctgtggatacctccatacatctctagattgagggcacaccttcccaacaagtcctgcatatatatatatatatatatatatatatatatatatatatatatatgtgtgtgtgtgtgtgtgtgtgtgtgtgtgtgtttgtgtgtgtgtgtgtgtatatctatatgtgtgtatatatatctatatatgtatatatatctatatatgtgtatagatatatatgtatatatgtgcatatatgtatatatatgtgtgtatatatatctatatatgtgtatatatatctatatatgtatatagatatctatatatgtgtatagatatatatgtatatatgtgcatatatatgtatatatatgtgtgtatatatatctatatatatgtgtatacacacacacacacacagcaagaaagggagcagattcaatttgttaaaatattaattaaagcatgttaaatgagagacctactaaagcaagacagtcaaacataaaaaccaactgctaaggtttctaaattgccataattctgtttactgcatagtattaatctgagggacagctgacctatataggctactttattatgcttgatctcagtacttattcacatggcttattatcatggaacatttttatagctttcattctcgtctgtgacagttttactagagtgacaagctcattggtctgaaataaataggggtaatgagagcatttgagtcttcatattcaatgccatgaaaaagaaaagatggaaattacatatgggtaagaggtaaagattagatgcttgaaaaatacatttccaaattcattaagatgaatttggaagatacacaacttcattaccaaggcttcctttccttcattgatgtttagctcttataattaatatcatgcaaatggggcacagacacatacttcactagtgccaaggagtatatttacaaaatagggttatttgtgggggaaaatatggaatcccagaagtatcaaagcaacatgattccctgagagatgtgcttaggtcaagcctatagtgtttcagtggatcaccccaacttcatacactccgcatattttttagcgaaaggcggcagagaatatctgggtaactttgtaacaatgaagcttcctggtaaatgaagtggctttgataccaagaggcagactcagaattcaacttctggcaccagtcttgtcttccattgagctaattcagacctgctcagccacctccttgccagaaagggaatagaaatgagcctctaaggttatctggatcacttgcttgtcaattgacaacattaaatattggcaaaatgaggttcagcaacccttaatatgctagagagtagtcaaaaagaaagtccttgtttaaaggaagttacatagcaacacaaatcttgcttacattccaagacgacaggtcgtggtagtgatggtgctgttttaattttttaatgttataaaggttttcttcatttccttgacattgaaatatgtagcatatttttgtttatacaaaacacctattacatccttcctagcagaggcacagtagaagaaagaagatccatgcagaagaaaacagaacaaatatgaaatattcattatatactgtggaaatattttgtctcatatcagtgtgtaagtttgacttacattccctattaccttggacatagagaaataaaagaaaaagtaaagagaagaggaaagaagttccagattggcagagtagatcactgaaaatttgcgcctccataaaagcagcgagaatactagcaaaaattgtcaaaatcaactttttcagaactctagaaattaaccaaagacttgcaataatccaatgagtatttattcaactgtagttgaatctcaggaaaaacagcaagatctatggctttttaatttaccttatttgcatctccctctatccatctctggggtagctgtgaaaatcagcagcctagcagccacttgcagaggaagaatgagtttggaactccccaaaagctctatccccagagaattgtcactatttgacctgtttggcagttccatggaaacctccattcacagaacttgtctttatttgacctgactcagggcttgtttattgagaacagcctttacccccagggatatttgtggggaaaagtcagcagtaattgtttaacatggcaattgcttcaggtggtgataacacttgcagctaacaagaagctgagcaaaaagcttaatgagataagcttgggaatgagatgctcccagaaggctttgaaaagcttgtacatattcatagacatctagaacgtatgcaacacacacacacacacacacacacacacacacacacacacacacacactactgtaagaatgtctgggaaagaactgagaaggctctcacctctagcagattttgaagctctgtgttaagtggaaaatgaaacctaagtaaaatccctgtcagaggattgaaggcatccctcatatgcacatagagctcctcagcaaaggctggaagacttattggttcaggcttttaaggaaatctctgtcccattagctgacaaccaagctaactgagcagtaccttcagttgccaaaccctcccaaaaatacagacttcaaagaattagttctggcaagtcactgaacagcaaatagcagtaacaacaataatagcaacaaacagaaatgacaacaaacattagatcgtggggtgaggggatagacttgatttccagagtttccacattacattatttaaaacattcagttttcaataaaaatttataagacgtgcaaagatacagtaaaggatactccatatatgaaaaaacagtcaattgaaactgtccctgagtaaaccaagatgttggacttactagacaaagtatttaaatgaactattgtacatacattcaaaatactaaaggaaatcatatctaaagactgaaaggaaaatatgagaaggctgtctcccaaataaataatatcaataaagagaaagaaattatttaaaagaaccaaacagaagttcaaaaattgaaaagtatagtaacagaaataaaaaattcactaggctacccaacagcatgtttgaaaaggcagaaaaaagcatcattgaacttgaagataggtcaattcaaacatctagtctgaggaacagaaagtaaaaagaatgaagaaaaatgaacaaagtctcagtaacatgtgggataccatcaagcatacaaacataagcataatgaggattctcagcaaaaaaggagacaaagggtcagaaagaatatttgaagaaataatggttgaaaacttcccatacttgattgaaataaacattaatctacacattaaaggagctcaataaactacaagtaggataaactgaaagagaaccacatctagacatattataatcaaactgtcctaagacaatgacaagaaaaaatcttgaaaacaacagcagagatgtaactcattatataaaagtaaccctcaataagattaatatctccatgatcagaaactataaggctagaaaacagctgaaaaatatatccacagtaccaaaaggaaaagactatgaaccaagaattctatatccactgaaactatacttcaaaaatgaaaaattaagacattctcaaataaacaaaaactgagaaaatttgtttccagtagacctgtcctgtaagaaatacaaaaagaaaagccttcaggctgaaatgaaaagatactagggagcaatctgaatccacatgaagaataaagagaaccgataaagaaaattttataagtaaatatgaaagatagtataaatgtatgtttgtaactcttttttctactatctcatttaaagacaatggcataatgcaaaaattataaaactgcattgataggcttatcgtatgaaaagatgtaattagtaggacaacagtaacacaaatgaaggggtagggaacaaagctatatggagcaaagtttttgtatactatggatacaaaagaaggcagtaaagaaggaataggggaatacaaaggacagaaggcatatagaaaacaaatacagaaaaggcaaatgtaaatcctactttatcactagttacattaaatgtaagtggactaaacactccaatcaaaaggcagagatcagtagaatggataaaataacatgatccaattttacactgtctacaagggacatactttagattcaaagacatgactgggttaaaataaaaaaatggaaaaagtatatatattataccatgcaaacagtagcaaaagagagctgaagtagctattcatatcagataaaacagttttttttaaaaaacggttactagagataaagaacaatattttataatggcaaagggtcaaaccaataagaaaatataacaattaaaggattccctatttaataaatggtgctgggaaaactggctagacatatgtagaaagctgaaactggatcccttccttacaccttataaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaatctactcatctgacaaggggctaatatccagaatctacaattaactcaaacaaatttacaagaaaaaaaaaaaaccacatcaaaaagtgggtgaaggatatgaacagacacttctcaaaggaagaaatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttagtgggagtgtaaactagttcaaccattgcggaagtcagtgtggtgattcctcagggatctagaactagaaataccatttgacccagccatcccattactgggtatatacccaaaggattataaaacatgctgctataaagacacatgcacacatatgtttactgcagcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctcagcaaactatctcaagaacaaaaaaccaaacaccgcatgttctcgctcataggtgggaattgaacaatgagaacacttggacacaggaaggggaacatcacacaccagggcctgtcgtggggtggggggatcggggagggatagcattaggagatatacctaatgctaaatgacgagttaatgggtgcagcacaccaacatggcacatgtatacatatgtaacaaacctgcatgttgtgcacatgtaccctaaaagtataataaaaaaataaaataaaataaataaactttaaaaaaatccttgtacaacaaatattcatagcagcatttttataaaagccaaaaaggggaaaaaaacaaaatatccatcaattggttaatggataacaaaatgtgatatatctatacaataaaatattatttgatattaaaaaaagaaaaataacaattataaataagcatacacctaataacacatccctaaaacatatgaagcaaaggttgagagaactgaaaggacaaatagataattcaacaataataatagtggagccttcaacatctcactttctataatagagcaactagacagaagattaacaagaaagtagaagacttgaacaacactataaaacaactagacctaacagacatctatagagcactccacctaatggcagaatatatatatattttaagagcacaagaagcattccctaggatagcccatactttaggtcaaaaaacaagtctcaataagtttaagagggctcatatgataaaaaaaaaaattctccaaacacaatgtgatagaattagaaagaataaccaaaaagtttgggaaattcacaaatattggttagtaaaacaatacttctaacaaagtaagagttaaagaagaaatcaaagggaaattagaaaatactttgaatgaaaacaaaataaaacataccaaaatacactggatgcagcaaaatcagtacttagaaagaaatgtatggctataaatgcttacattaaaaaggaaaaataaggaataaggtctcaaatcaataacctcaccctccaccttaagatactagaaaaaggagagcaaactacacctaaagcaaacagaaaggacataataaagactagagggagaataaacaaactagagaacagaaaacaatagagaaaatcaacaaaacaaaaatttgttttttgaaaaggtaaaattggtaatcctttagctagttttgccaaaaaaaaaaagagagaagtctcaaatcactaagataagaaacgaaagaggggctttaactactaactttgtagaaataagattataaaggaatattatgaataatggtatgccaaaaaattaggtaacaattatagaccatatgttaggtcataaagcaagtatcaaaacaactcaaggagaattttaaaattagaataaacttataataattagagaggttaaattaataattaaaaatatttccacaaagaaaagctcaggaagagatggcttcactggtgaaattcaccaaatgtttaaagaagactcttttttaaaatgtcagtccttaacaaactcttaaaaataaaaaaagtggagactgcttcccagctcattctatgagggtagcattgccctgacaccaaaaccaattatatcacaagaaagctatagacccttataaatatagatgcaaaaattctcaaaaatactagtaaactaaatccagcaatatttaaaaaggtatgcacaccatgactgaatggcatttatcccaataatgtaagattggattatcatccaaaaatcaatatatataatatactattttaatagaataaaagacaaaaatcacatgattatctcaataggcaaaaagcatttgacaaaatccaacatgctttcatgccacttaacaaacattcaacaaactagaaatagaagggaacttcctcaaactaataaaaggacacttaacaaaaaatgcacagctaacacagtaatggtaaaagactgaatgttttacttttaacaccaggaatcagacaaggatattggctatttaaccacttctatttaacaatgtactggaggttctagacatgcaatcaggcaagagaaagaaataaaaaggcattcagactgtaaagaaaaaagtaaaattatccctatttgcaggtgataaaatctcatatacagataattttaaggaattcagaaaaaactattataataaacaagttcaacaaggttacaggacataagatcaatatacaaaactcagctgtatttctacacactaacattgaacaaatcaaatttaagaaaataatttcatttacaataatatcaaaaagaaaaaaacaggaataaatgtatcaaaataagtgtaagtcttttacacttaaaactacaaaacattgctgaaagaaattaaagaagatacaaataaaggaaagacaacttatatacaggagttggaatataatcttgttaagattgcaatactctccaaattgattgacagagtcaatgcaatccctaaaataaactcagctactaattttggagagattgacaagttgattctaaaattaatatggacatacaagagacctaaaatagtcaaaatgatcttcaagatgaaaaacaaaaagtcaaaggactcacacttttagattttaaaacttacttcaaagatacagtaaccaagacaatgtgatactggcatgaagacatacagattaatggagtagagttgagagtctcataaacctatatatctatggtcaattgactttccacatgggtggcaagacaaataaattgggaaggaatagtcttttcaacaaatggtgctggaatactggatgtccctgtacaaatgaatgatattggaccccttatctcacaccatgtacaaaaatttaacttaaagtggatcaagggcctagatgcaaaagctaaaataatcagctcttagaagaacacatgggcatatgtattcatgcgcttagattaaacaatcacttcttagatataataccaaaagcacaagtaacaaaaaaattataaattgaatatcaaaatctaaaacttttgtgcttcaatagacaccatcaagaaagtgagaagacaactcagaatgaaggcaaatatacataaatcataaatctgataagggacctgtatacaaagtataccaaaaactccaagactcagcaataaaaagaccattaacacaattgaaaatgataaaggacctgaatagacgtttcctaaataagacatacaaatggccaataatcacatgaaaagatgcataacattgttagccattaggaaaatgcaaatcaaaactacaatgagatgcctctccaaggaactgtaaagtatacttactgcaatgaagaagtacaattatctctatttgcagatgacataattctggaatctcctaagattccaccaaaaaactgttagacctaatatatgaattgagtaaaattgcaggatacaaaatcaacatacaaaaatcagtagcatttttatatacaaataatgacctaactgaagaagacatccagcaaacagtcccatttactatagcataaaatgatactgagaaataactttaaccatggaggtgaaagatctgtacactgaaaactataaatcactgatgaaagaaactgaagaaaatacaaataaatggaaagatatcctatgctcctggattggaagaagtaatattgttaaaatgtccatactacctaaagcatatccagattcagtacaatacctatcaaaattccactggcattcttacagaaacagaaaaaaccatcctaatatttgtataaaaccataaaagaccccaaatagccaaaacaatactgagaaagacaaacaaaattggaggcatcacacttcctgatttcaaattatattacaaagctatagtaataaaacagtaagatattgacataaaaactgacacacaagccagtggaacagaatatagagcccagaaataaatccaaaccatgtatggtcaactaatttatgatgaaagcaccaacaggacacaacaggaaaataatggtctcttaaattaatggttctgggaaaactggatttccaaatgcaaaagaaggatattggaccattatcttacaccatacacaaaaatcaactcaaaatgaaaaagacctaaatataagaccaaaaactataaaattcctagaggataacatagggagaaaagtcctggacaatgccttggtcatgattttttgaatatcacaccaaaagctcagtccacaaaagcaaaagtaaataaatgggactacatcaaatgaaaaagcttctgtacaccaaaggaaacaaccaacaaaatgaaatagcaaactatgtattgggaacaaatatttgcaaactatatatctgacaaggggttaaccattcaaaatttataaagaactcatacaactcaaaagtggaaaaacaaacagcccaatccaaaaatgggcaaaaaatcagaatagacatttctccaatgaagacattaaaatggccaacaggtacatcaaaaggtgctcaacattatcaacatcattaatcatcagggaaatgcaaattaaatccattgtgagatacacctcatacccattagggtggctactatcaaaaagtcaaaagatgacaaatgttggtgaggttgtggagaaaagagaactctttacactgttggtgggaatatagattggtacaactattatagaaaatagtatggggtttctaaaggggttaaaaatacaactaccctatgacccagcaacccctcttctggatacatacttacaagaaatgaaatcaccaccttataaagatatctactttctcatattcattgcagcattattcacaagagcaaacatatggaaacaagtaagtgtctattgattaatgaagggataaagatattgaatattatcaagtggtacatatatataatggaatgttattcattcctaaaaaagaatcagatgttgccatttgccatgacatggataagcctggaggacattacactaggtgctacaggacagacacagaaagaaaaatattgcataatctcatttatatgtggaatctgaaaaaaattcaaatatacagagagaacaaaacagtagttactaggggtagtagtcagtgggaagaaaatagggagatgtaggtcggaggatacaaagtagcagatatgtaggatgaacaagtctagagaaataatgtacatgaggaccctaggtaacacaattgtattgtatgtggaattcatgctaaaggagtacaatttagctgctcttgcaacaaaaacaaagaaatgggcaactgtgagatgacggctatgttaatttgcttcactaaagtaacatttttactatctatatgtattccataacatgttgtataccttaaatatacataataaaacttatttaaaaaagaatttagcaagtagaaaaagtggtagaggagagaaaaatgatggtccaaatatagaagtatttgatgtgaattgtggcagagtttcaaagaaaataaaattacataatacgtgaaaaacaaagagacaaattgcccagcaaggatatggacacatcatgtacttcagaaatggcataaagggagataatcaattatgagatagcactcttcaaaggataaatttttagatccaaaatgatcttaagtaacatgaactatgttttggggtgactaatggatgggataacctatagtgttcttttattatatgcttgttttgtacacacgagggatgccataaacaaaatgagttcccttttgcattactacttaaaagtaatcatacgggtcattttccagtggtcattcacttcttgctactacacaatgcttaggcttagaattctgagcctgaatagcaccctaattgcaaaaagcatggtcattaaaaacaaacaaatcggccaggcacagtagctcacacctgtaattcagcattttgggaggccaaggtgggtggaacacctgaggttaagagttcaagaccagcctggccaacatggcaaaacccaatctctactaaaagtacaaaaattagccaggcttggtggcaggcaccttaattccagctactcaggagggtgaggcaggagaaccacttgaacccaatagacagaggttgccgtgagccgagactgtgccactgtactctagcctgggcaacagagtgagactccatcccctgcatcccccaaaaaaacaaaaaccacaatgaaatgctgtgtcacatccactaaaatggctataactaaaagaaagaaataaaaataaggattgataagcatcaaaatggaaccctcattctttgctggtgcgaatgtaaaatggtatagctactgtagaaaacagtctgacagttggtccaaaagttagacacagagttaccacatgacctagcaaatccacttctaggcctatacccaaaagaaccgaaaatctatgtgtactcaaaaatttgtacatgaatgttctcagcagcattattcttaatagccaaaaaagtagaaacaacatcatcaactgatgaataagaaacatatgatatatccaaacaatggaatattattcatccataaaaaagaatgaaggaataaagtgcatgtacacatgaatgaatagtgaaaacattatgttaagtaaaagaaaccaaacacaaatggtcacatattatataattccatttataagaaatgtccaaaatagacaaatccattgaggcagaaagtagattagcagttgctagggccttggaggagggaagagaggggagtggctgctaatgggtagagtttcttttttggagtgatgaaaatgttctggaagcagacagcaatggtatggttgaacaaccttgtgaatatattaaaaaccactgaattgaacaccttaaaatgttgattttgtggtatatgaattacatctcaagaaaaaaaaacttaaagataagaataattagcataaatatgataattacgctgccaagtaagattaataaaaattgttttggatagttgaacaaatcaagtgatacttattgagtagcctaccaagtgctgtggccatggagatgccctattcacatctccctttaggagaacctcatcaggaagtatagctgattgacacctccatctccacgcctctgggtccaagcctcccctggagctgttccccgtcaatgactgagcgtgatgagggcaggaactgggtcactcccgtgaaagcatgatttctccaactggcaaattctgctcgggacttcccattggccaggcagtgattttttccaaaccacactgtgaccaaagactctttatattcactccttacttgtctctcttcttccacagagcactgtggtcaaatgctctccccatctactgctgatcctgctctctttagctttcacatttgtttctcctgaaaaaccttttgctcatctaatattggcatgtgttctttggagagcagaagtgactcatgaatgtatgtctaagaaggaatatagtacaagacttgaggaatgtagctgaaaggccttagtaggactgaatgtgtctgcatgtgtctctgggattccagggatatattgtattcgcttgtactaaacagatgtataaaagacttacataaacaaactactctccaaggtgcctaattcgaaggataatatatgtatttgagtgaagtagttcttgaaatgcttgggaaataccagtttcatacaatcatggtacttaataataaccaatataggtactgactgaggccacaaacactgcatgggcaaatcagacaaggcctgtaagtctaaagcagtgtttttcacactttgggacactgcaaagtgtaaatcatgaaatcagttttgtgggtcatgacagcagatgttttagttttgtttttctttccttaaaagaatagataagaatataggtgcatagtaaaggtaagtatagtttcataaaatatttgtcttagatgtgtgtgtgtatacttgtgtgtgtatttatatacactacctaggtttggatatttttgtcacggattgcattagaaaagatttgaaagtcatgatctaagggacacacaataaagttggcacagtcagaatttacataaagacatttagtaacattctttaaagtaggaacagaatttctgattcccaaaagcttcaccagggttgcatgcttttgagtgataatgtccaagtggagtgagtcacataaaaccttctggtgcatagaggtgctcctccaggcccagaatcatattcataatctgattaggtactggagatcacctcatgtaacccaggtacatctcagagttataaaatgtgcaatatgggctgggtgaggtggctgacgcctgtaattccagcactttgggaggccaaggtgggcgcatcacgaggtcaagagattgagaccatcctggccaaaatggtgaaaccccatctctactaaaaatacaaaaattagctgggtgtggtggcgggcctgtagtcctagctactcggcaggctgaggcaggagaatcacttaaactcaggaggcagaggttgcagtgagccgagatcaccccactgcactccagcctgggtgacagagcgagactccgtctcaaaaaaaagaaaaacaattgcaatatgattgcagggtacaatcatagtacactccggaataaacaaaatcctcactcatcatacttcgtctctccaggctaatacagtctcttccaagtttattcctgactgtatcattgctgctggacaaagacaaagggtggtaacccagacatctctcgagtcttgctaagagctccttggactaactatagagctcatccagtggtttgcctcactagagctacgtctcatgggagtcaattctccttaaaagaatgataggatttgggccatggtggctggaaatctaaaggaagagtcacagagaagtcaggaatggttgcaaaccattgctagaaggggtaatctgttttgcaaaactagattccacacagatgtgtaaaggaaaagaaaataaaagtcaataaggcattgaaacagaagattcactcttctaacctaaaaaatgcaatgcacaaaactaatgttgagaaaagtcacagggctgtctcatcttaaaatttaaagaaactctaaactctcgtaggtgcttctcaaagttgaggtatatgtactctctgggggaaatcatagatgagctaagggatggaaaagccacaggaaaaacaaagcggctctagggtcatattatgtcattgaatctatgagagcatcgattgtaagatggactgttgttgtcagcccactaaaagaaaaaaatgctatgaggcaatgcattatcacttaaaatattttaatcttattttaaaagatatttcagattcaatataaattctatcatataccattcttgaaggaaaatgtaaaactatacaagttgattatacacaagggaaaataaagaatgtcactcttctgaatcaattctcaattcagagtcgtcagtgttcacagatcttatcctctaagccatcaggatattaatgatgcagcatgtatctttaaaagtgctctgctatcatctccagaaatttcttccaagctgctgacactctcttgtaagttttgaggccgtcacttattgaacttagtagaagataccattggagggtttttagataaaaccaaactcatattccttcctaaagtgatctttccttggtttgttggctgcaattttaagggttgctaatgtccagtcttgccactagaaattttttcactgtgcagatacatgtctaaaaatgcaccaacagctaacatcactttgaaggttaagtaagactcctggccatctttccacatggctgtacaccactcattcatcagctcacctgtcattcatctctatgtgtgtgtatgtgcatgcatgcatgagtgcacacacaaaagataacagcattgagttcaatctcattttcatctgagaatgggttcaaactcacacactaaaattgcattcatttcccatttctgcataacaaattactatacatatagcagcttaaaacaacacctatttattatctcagagggctggaagtcacaagttcatcatgacgtgctggatttgctgctcaggctcttataagaccaaaatcaaggaattgacagagctatattcctctctgaaggctctggggaagaatggagctcattcaggttgttggcagaattcaactccttgcagttgtatgactgaggtccaggtttccttgacatttggccctgtctatatttaaaccagcaacatttgttgaatcctgctcgtgcataacatgtctccgacttttcccttctgttgagccttttcagcttccttttgtgtcctcaactgggagaaggctctgttttaagggttcacatgattacatcagactcacctagacaatccagaataatctccctattttaacatcaattgattagttatcttaattatctctgtaatctctttggcttgtaatgtaacgtgaatatatgacaagtggtgaggatcttgggggtcaacattctgcctcccacacttagtttgatattgttcaaaatgaaatatggtgacaagttttgaccacctgacaccatgcatgacatcacattgaaatgctgtacattttgtcatctatgttctcagtgttaattgttttagcactcttggcattggcaggtatgtcaaaggacacaggttttctcagcatttcctatttgactaaattcctagtttttcctaaatgaattacatgtcactggatgttaagcagtttccaatcagttgaaaatttttgacaaattgatgttccacaccttaataacagtcctgcatcatgcacgagtttagttatatcagcctcttgttttgaaatttatttcacttattataagagctttggcaatttctcctgccttcagttgcataacttgacatgtgttaggtgacccgtgtagatgtatttcagtaaccaaatatagcaccacttcatcttcttgagagtttcttccttcattgttgctttgaaagaacatacagaaatgggaccagttttccaaaaacaaatattttcatcactaatatcaaatttacactccacttcttatttctacgtttttctgcaaaacaataacttttcatttcaatgccagaccacactgtaatctcattggacacacatattaaccagcatttaagtccaatctatgtagtaccaacaacgtacaatacacaattgaacagataacacaaacagctctgaccaagtttgtacatgcacaggcaatagctgtgtcaccaactgtcactaagacatcactggtagtaagataccattctgactttcaacatgttaagtgtgagaaaaagtgccttaaaatcattgagcaactactatgtgccaggcattgtgctctttcagcaattctactgaattttcctggtaatctacttgcaagtaataaacgtaatggctgagaagattagtgccagggccaggctaactgggtttcaaatattgcctctgtaacttactgtgttaccctggacatatttcttaattcttatctgtaatataggaaaaaaacgggataattcatgtgcagtacttagcacatagtaaaactcaaaaatagtgtcatgttgtttctgttgtttttaactgagcttaagagctggctccttttcttcccatatgctcatgaagcaaatacctgtattctcccagttagtgaaaaagtattcattctggaaatagaacctcttttagttctaattccttattgttctaaaatataccagattatctcatcctgccttgagtgtactggttcactaaaggacaggagccatcaatactcatgaccagggaactcggagaaaatacggtgtttaaaaaaggaaaaatgtccacataaaaggtttaacattcaggctacttaacactctgtcctccaccttttcttttgtgcatccctttccctatatgcacttggatctctgtgggttaacatctaacaaaggtttaggaattaaaaggtctgtaaaaaatggggtacactcggggttgtttaggggctaggcaacagactatgacacctgggggagaaagtgagccttcttcccatttctgcacaaatgacccagcctgtcccaggttcgtgaaggtcaccagtgcacctaaggtagtgctggggagctgtggcacagcactggtgaggagtgcagttatgcccgtgggaattccggagtgggcaaggaagcccacatcatagaacgctgctctgtcatggccagagggagaggatttatgggtggtcacttggaagaaatgatgagtcagtagtaaattattattattattattattattattattattattattattattattttaaatcttaggcttggcatggtggttcacgccagcacttttgggaggccaaagcaggaggatcccttgaggccaggaatttgagaccagcctgggcaacacagtgagactcctgtctctacaaaataattttaaaattagccaggtgtggtggcatgcacttgcagtcctagctaattgggaggttgagatgggaggattgcttaagcccaggagttcaaggattacagtgaactatgattgcaccactgcactcttgcctgggcaacagagtgagaccctgtctctaaaaaaagaaatcttagaaactccaggaatacttcaaggatggcttttacaagggactagggttcttatgttacactacataggagaaatgcttaagcagccaaatatataaattataactattaatgtgactctatttatttaaagccatagtctggaggcctggtgaaatctggttatgtttgtattatatttttaacccactcccaccactgttcattgcccttgagatccttgaggacagagactgcttttaatttttaaaaaatctctgtagccctatcacctagcagagaactcagcacagagtaggtactcaatatatgactgttgaaggaaggaataactgcctccaaacaacaaatttagaataaacagatagaagttataggaatataattcaacataaaatgcctttctaactactagaatcccttataaatgcaagaagtctatcatgacatagtgagaatcctgtcactagaggtgttgccagtgataccctggaagaggagcacacttcatggagggagatggattgaatcatttccagctcttgaattgattggtactcattgcatggagaccaacaggagactagctatgacaaagcagtgaaagacactaagcagaagtgatgagtcagcaaaactggttattatttaaaaatggcttcaaggactatctataaaaatcagcaagcctcaaaccagagttcatcagaattgaaataataccctgaaacattgttacaaggagccatagaaattgtcttctaaaaactacactattataactctgactgatgttcagaggactaaagtatctaatagacatcatctatagtgatgatgttaaatgatgaaaggttaaaggaaagatcagactgtgagatcaagctgtgatttttagactcatagcccatttcaatgtcccttccatgtcactggtgaagtaaattctggagtcacttgtcttggttcctttaacttccaataaatgactgaaggaactcagatctacacgaggagaattactggacaatgatggaaaggtcttctgagataaatgaacattctacattaatttaaaagccataaatagaatgatgaataggactatctcataatgtcaaagttcaaaggcacttttcaaatgtctctttaaagaaaacctgacctttctttctgtcttttattatcagaaagtttgccaagagcagtctaggtcttgggtcatttcattttgacatggaagttctctcaggattaaaaataataaaaaaacagaagtatttaactctgaagtgaccatgagaacatgttcagcagtataaaaaataacaatattgaagcattaggacttcaaaagttgtgttttaataactacataaagcttcccctctcatatatgagagatataacttatatgaggtcatgaatagctaaagatatcagcatgaatagagatttttctatcgtatttcatgttgttttataacattctatttaggaaaattgctgagtatactactagtaactttctatgctaaatatcttggttaggtatagattagctggcattaaatatagatgtgaatataaatacatttttatgaatataaaacctcttaccaaagacctctttttcccatttcaatttccattttaaggtattattaacagtcagtaaaattcacccttttttaggtaaatttctccaagttttgacaaatacagttgtataatcaccactgcaagcaagacacagcgtggttccatcacaaccctctacccctttgaagtcaacccctctctccatctcctgtccctggaaatgaactgatttactttctcttcctataattttgatgttttaagaatgtcctgtaaatgaagttatatagtatgtagcaaaggccccttttaaacttcatgcatttgataaaaaataatttactttttatttttacttactggtttctatttcctgaatttaaaggcaataatggatataaaaatcaaattactcttgagtattacatcttgaaataggtaattacccagagggcctttagaacatatagacctttaggacttcacttctgcagtactgaatcagaatctctcagtgtatgttctgagaatttagtttctactaaactttctaagcctgattctgattgacccattagatttgggaaacattaacctgacaggtattcactagatgagatcaacaagcagattttaaatgacgtgtggttatggaatcaaagttcagaggttgggagagtcttatctaagtgaccttgtccttggtggctaccacttgctggttgcagggcctcaaacaagttacttaaacttgatgaaccttggctttctcctttataacatggggggaatgcctacttcaaaagattgtttgggggattaaatgcttataaatcatttagcatactacatggaacacataacagtcaaataatggaggttgctcatattttagtatcaatatcttcatcattgtcatcatcatcatactgccctgagtgctttacgattctttctccatgtctgcattttggttaatttcactattttttaacccttcctctagaggcaaccaaagagaatttttgtagcaacacagctattattcaaggcagtaaaaagctaagagaaattcactgattgcttgcaatcttcacttctaccctgttatagcctcaaagatgccaatgagaacaagaagtgaattactggaaactctctcagtcttttttccaagcggatgttattggccaattatggacaaacaagagggaggaagagaaacaaagagcaaaaataaagtaaaaaattaggctgtctgtacagctaagatacatctaaaattttactttttttattggaagatttagtcaaatatgtgatgtgaaaagaaactgaaactgttggcttaatgaaaacaggtttgctccagtactattccatattaacttacctaaataacttggattcaaagttcaggagtcagcagagtatcttaagatttatttcaaaacattacaaggtggccgggcacagtggttcgcacctgtaatgctagcactttgggaggccaagacgggcagatcacttgaggtcaggagttcgaaaccagcctggccaacatggtgaaacccagtctctactaaaaatacaaaaattagccaggtgtggtggcatgccctggtaatcccagctactcaggtggctgaggcaggagaatcgtttgaacctgggaggcagaggctgcagtgagccaagattgcagtgcttcactctagcctgggtgacagagcgagactccacgttaaaaaacaagacaaacaaacaaacaaaaatttacaaggttcagggaaaagaggaagctaaaggcaacattttaatcctattacaagtactaaaagttggccctaaaaactgattgcaagctagatgtatatgcatttatttatttatttatttatttttattttatttttttgaggcagagtctcgctctgtcacccaggctggagtgcagtggcacaatctcggctcactgcaagctccacctcccaggttcactccattctcctgcctcagcctcccaagtagctgggaccacaggcacccgccaccatgcccggctaatttttttttgtattttgtagtagagacggcatttcaccatgttagccaggatggtctcgatctcctgatctcatgattcgcccgcctcagcctcccaaagtgctgggattacaggctgagccaccgcgcctggccgtatatgcatttatttttaagatatagttttaatttaagccctgaaatacagaagagtcacgatatttggttgtgcttgctaatataaagaactactactatcttctaagaattatgcaatgctgctaacaccaaggacaaaagaacatcaaaagacccatgaaccccacaagccctacctgttctcagcatcagcactgcactttggggacatcaattcaaaggatttggtaaatttcaccacctgtcgcatagaaagataataaatccaggtcaattaaagctttattgccgtttaaaataatgtaataaacattttcatctttataatgattataatacttggagattatagagagatttttaagtggagaaatcccaagacagagtagaagaggagaatcccatcctacatcttgtatcttatttcttacaaagcatacattgtcaaagttttaatacatttcactaaacatgtacatatttttacaattaggtgtacaatgagctatggaggtcaggtaaaggaaaatctcatttgaatacttaaaaagaaaactgttcttttaacaacccaatcaacagcaataagagacccaggtagggacagaacacccctcaaagaagatgccctctgtcaaccccaggctcctgaagttagttcatctttaagcttggctcatcattgttctcaggtgagcttcgtggtaccaccacctaaagggtaaagaggaagccaccttattcaacaatcattcttgtgtggacacttcctctctcacctctccagtgaaagtagcataccagtgcgagagttgaccaaggcttatgttgagggggaatttatggaacagaaaatgtcaatgtagtttttcttattattagctaatattgagtttacactgtaaaccaggccctacagcagaagcttttttgattatttctttattataaatctaaagtagagaattttatactcagtctatagatgaggaaactaacccctaatttttaaaaagacttactcagtttcacacaattaaataaggcaactggcatgaaaggaattctctctgatgctagagtgctagctctttcaacactacaaatgttgagtgagaaatgcactatttctggcccttgtaggggtggacggaaacctttccttctaccctctgaaggtttgctgaaataaactgacaatagacagattaacaggagaacaagcatacaaatttactaatgtgcagaagcacagaagccatataaagtatgagactcaaaggagggccagatggttgaagcttaaatagcatcctctttataggggagacggacgggggatgtaggcaattttgaggggtagaaaaaaatttcagaggaattaaatgagcccaaagaacagacaatgaccagggacaaagtttctctgagctctggaggaggtggcagcaagttaggggtggaacttcactgcaaacaaaggttatctttttttttttttggacaggttctcactctgtcgcacaggctggagtgcagtggcccaatctcggctcattgcagcctccgcctcccgggttcaagtaattctcccacctcagcctcccaagtcgctgggattacaggggcgtgtcatcatgcccagctaatttttgcatttttagtagagacagggtttcaccatgttgaccagggtagtcttgaattcctcaccccagatgaggcacaagccttggcttcccaaagtgctgagattacaggcacgagccaccgcatctggccaaaggttatcttattatgcagataaagtctcccgggtaatctctcagagtgccctcagaagaacagatggaaagtctgtctgggcatggggacattcctcagtcttcctttctgtgatatgcgaataatattctctggttaataaaatttcagggaggggatggaagagagttccatcttgtacttgtgaggaggaacaagaaaaggttagaaagttcttggctctgaggggactcagttccaaggccttttaatttcctttagatcaacgtgctcagtatgccaaggcaccatgctttgaagtctccttttctgagccccaataccctcttttgacaagatataccacatgatagaaaaacaagcccctatagtgaaaggagtccatctgaatgtcatagaatgcttccaaggttgacatttagattttccttagccgtacgcagtcatgcttcaaaggccttttaaattaaccacttacaaggaattgatgagcacctgagaaaatgatttggaaaataggaatagattaaatatttaaaaaagctttatcagtgaggtaatgaactcaagctaggcaaatgcaacattagggaaaaaatagaaaagaagggctcatcacaaagaaaattctgtgtgaccagatgaatgtagggcaatgacaatagctcaactgcaaggaaatacccttgacaactatagaacatatttcatttcatattgtaatatgaattaagcctctacagaatcactcattgtggcaaattttattttccaaagatggtcacaacaatatcttctatcccatattcttctcttccatgtaaccctgccactttcctaccaagtggtaggatctacgtcctctctccttaaatccggtgggcttctgaaagcttcaacaaatagagcatatggaagacatgctacatgccttccaaggttgttgtaaaatgcaacacagcttctgccttgcctgatgaaatatgtgtgcttggagccctcggtcaccatgcaagaagtgcaactaccctcaggccactatgctgaaagggagccaaaccacatagagaggacattttcctgcaaatgagggatttttcacacattataaacaatcctttatgcatgtatcaatgcttacaacatcccagaaggtagattttatcctcattttattgacagcaaattaaggcttagggggttaagtggtttgctggaagccatgcaagcaggaaattgcagaaccgagatttgaaccatgttgttctgattccacagctccagtgatcccacttctcactgctttaataagcaagagcaagtgttattgcagcagcaaattatttggacatgactccttcaaaaccagaataaactctactttatttactaattctacaaatatttattgagtacctcctatatgcccaaatttgagtaaacacagactaaaaagtaacttgaagtaaaacacttggcttggtataagattaatcatattatcaataaactgttaattgtttctgcatttcaaaattgagcaggacatttttttaattcctgatctgataaatgagattaaattctccaatattaataagaatgcttcatttggcctacttcttactattgattagaataatttacagcgtggtaagagtagatgttaatttctgcaaatctgatagcaatacaaataaattttatccaagtaaagatgcaaatgatttctgtgcaggagaaaagaaaagctcaatggttacaattgtattatcctgactggtagtaaccattttaaaaagctaatctagcaatcttatgctggcattctttcagtgcctattttagaaccaactttgccactctgcggtttctctttttgatgagttaaacaaatctttgatacatgcttgctttagatttctgcaagagttaagtttttaactttttgaaaattatctttcaatacaacaaatacgtaccgtcttatgtgtcaggcagtgtagtgtacaatggaattacaaatgtgaaagtaaaagaaaataaaatctctgcagttatggagcttgctttatggtagggagcttaatttgccctggctcctcaaaactagtgctccctggaaaaaataagtgcacttctggtttcacatcttaagaaaacaaatgtgagaaatgtccagagaatgaaagaaaataaagatcttttaaaaatattttttccatctgaggaatagcaactgagggatataagaaatggaataggaaataatagcgtttcaaagccatagaacctgtagatctacagagaatggataagatatatacatctcttaatgaaatgacaggatgtttgaactcttgtaaaagaagttggagaaactactaaaaggaaaaaacacttttttctaaaatgttagaacatcttactccaacataaattacaagctgaaaagaaaaatagggacaaaacttttatttgttttgttttctaaattcatttttaatgtataaggggaaagtcaaggactatgtatcattcaacttcagcattccatagaatgcattagctgtgtcctccagtaaaatggcttatggtgccatgatcaaagtcagacactgtattcatgaaccacgattgaccttgtatgtaggaaagaactgaaccttccctaaagagaggtctggcctttgtccttggctcctgagagataatctctaaacccttgtaatgcctgattaatgtgcaaagagtaacagtgtgatttagaatgggggcttcaagccacaccaacaatatgatttgggtgggagctttgggacacatggtatcagttgaccactggaggaaaggagtcagaggtcagccgcatgggcaggtcaaccctatttttgtgatcaagccccaataaagactctagacactaaggctcaggccccggttggcaaaatttcatgcatcttgtcacacatgatagccaggagacattgacactatccatgactccatgagcagagtccacatgtggaattttcctagactctgccccatgctaatgttaatctgtatgatttcctgtagtaaactgtaactgtgagtgtaacagctttcaatgagttctttgagcccttctagcaaattactgaaacttagcatggtcttgggaactccaaaactcataaatggtgtcaggaatgaggaaagtattgtagactatgttccctaactttacacttatatcataattcttaggttcctgtgtctttagaagaaaaatgaagatactaatcttcattagtgtctttagaagaaaaatgaagatactgatgtttactgatctttggttaaatattgattatccagtgtgtataaagtactggatagcacagggagataccaaagaaataataaataaggtctctaaccttttaagacttaacatttgtgatggttaattggtatgtgtcaacttgactgggctaaggggtgcccagatagctggcaaaacattatttttgggtggtctgtgaagtgtttctggaagagattagcattcgaatcaataaattgagtaaagaagattgtcctgagcaatgtgggtgggcattgtccaatccactgagggctcagatagaaaggaagaggaagggcaaatgtggtctctttgtttgagctaggacatccatttttcccctgtcctcagacactgggactcctgattctctggtctttgaactcagactgaattacatcaccagctttcctggttctctagcttgcagacagtaaactgtgggacttcttagcttccataattatgtgagccaattcctagaataaatatctttatctctatctatctatcatctatctgtctatctatctatctatctatctatctatctatctatctatctatccatctatctatctagtctcctattggttctgtttctcaggagaaccacaactactgcaacattttaaagaagaaaaatttaaagtgcaaggtgagttgacctctgaggttagattcacagccaaattgaccctgagtcatcagattatttggcaaggcaatatacatgtggcattagtccgtgatgaggcagcaagatgaacagttgagaagtaacataattctggagatgtaaattcatctgccagcctctcagtcctcaaaagcaggagtgggcaaaggatggcccatgggccatatctggcctaccacctgtttttattaataaagtttcattgtaacaaagccatacttattaatttaagtattgtctgtgcctgctttctactataacagtagagtgaatagttgcaattgagatcgtgcaggccacaaagcctaaaatatttagtagacagacctttatttttaaaagtttgccaacttctctggtgtagagccatttctaggccagatcagttatttttgctaaattgttaatggctaatgataggttaatgtattaatattcccatgtaatatagctatattcagaaagaggattcttggagacataatcttttaatttgaaacagtattgcaatgatagaaattttaggcaccagggtaagtggtaagagatatactcgaggatatatccccagttggcaggggacagttccactccaattaagcctgttgtccagggacaattattaatagtgcccactttcacgctcacaagtgtctttgaatagcaaattctaggcaggcaggccattggctgctcctcaaagcatcagacaacttatatttttaaaaagaattgaaaatataatgcattcaaagagaaaattgtttatagtcagatacctgggttaaaaaataaaacagcaaaaacggcttaaatatttggatataatttaacgggatatatagaatgacattgcagaaattatgaccaataccaaataggtgaaggcataaataaaatagaatagaatttatgctttattcctgacttggaccaattatataattcttagttttattaattttaaaagtttactatctaaatccaactttgattttattatacatttactaaatgaacatggattaaataaattaatatacacacactaagtaaaaaagagaatcttataagggaaatatcagaagtggtttctaaatcaatgacacaaaacaactggtttcaagcttcctttgctgctgatcagccctgattattgcaccctggggaagggagtgtacctgccaagtgaagtaaacaaaacatctccctgcttgttctttggaaaagctccatggacagaagtctttttgatttggatatttatcaagtgctagttggtctggcttctctctgttcttttaacttaaaaacaagttaaaaaaataaaaactatactcaaatagatattccgggcaccaaaataaaaattatctactaagtaatcatgatttttgttttctaattttctgaatctctatttttctataagaggactactcaaaatggcaaaagaatgaattaaataggccaagtgtggtggctcacacctgtaatgccagcactttgggaagtcaaggtgggtagataactgagatcaggagttcgagaccagcatgaccaacatggtgaaaccccgtctctattaaaaatacaaaaattagccacgcatggtggcatgcacctgtaatcccagctactcagcaggctgaggcaggagaatcgtttgaatctgggaagtggaggctgcagtgagccgagatgcaccactgcactccagcctaagtgacacagcaagactctgtctcaaaaaaaaaaaaaagaaaaagaatgaattaaacaatcatctcttactatgcttcttaataaatctcttacttatgccaatttactctaatcatttattcatgcagtcagcatttatcaaatacttagtgcaccaagcactgctataggctctataaacaccaaggggcacaaaccatatcctatccttgagaaactcacaacacagtacagagaagcaaacagttcacaaatgtttcaccacaatgtatgtccaaaatgctaccagtgcacagaggaaggtgttaaggaagtcttcatgtgaactgtgtgacaagcaggaacgctctaggctgacaagtgggggaagtttcccaggctgagggaacaaatcagttcgttctgggagaaaatagagaactctcaaaagagtttaactgaacataattcaataaaggggcaagctatagaagtgtgggtagggtgaaaagaagcccataaggaatggtgaggcacccaggcactagcaactttggaaagcagttaatactcctaggtctgaggttacacaagagggagggaggggagaagggaagggtgattttgagatcctggaggtgattttgatatccatgtgaagagaagccatggaaagatctagccaccactagaactggtaaacaaggaatgaggaaaataactacacccaatgtctttcactcctctggcccttaaatcttctgctcataccttctatttgtcaaacccaactggcagccagaggacaagaaagcccaagtggtgtggtaagcaaagatcagccctcaagggcactgaggtaaagacagaaagaccaaccataggtagttggggagtggagaggttccagagagtagccagtagagttgacaatgttgaactttacctgagctctgtgctcccccaaaatagtaatgataaagaaatctccctatcactgttccagaattggctatcctcaacagaccactctgccctagcacatttcaaaataagacatttctccatccttcctcatgactcctgtaaggctcatgaatgatgtaggtaactcccttgtctatacgtttctgtgaaaccccatctttttctttgagatgttcaccattaatgagcattctccctattgcaatagccagatgaaatgatcttcattgtctggtgcattttgtctttcactgggactatttgcacaaagatatgcatcttttgtgttaataggctagtacatgcttaggctgaccatggggaggtggggtagaggtgaagtaaaggatagagcaaggctgaggaccagagaggagaaccgcaagttaagttagaagcagaagtgatgggccttgaatgttgggtagtgtgagcattattatacaagcaatagacaactaccaatgttttgaatcataggagaggccagtgcatgtttaaaaagaagcagtaattgaaaagaagagtgccctctttgcaagcaagaaatgagtcaggagaaaaatgtcctagtgagagatcagtaaagacacagtgaagaaggtggtagaaagagtgagaaggaagggctagaaatgatgtttcaaggtagaagcaacagatcatagacacaagtgaatgtagaatagtgagaacgacttagaaactactctacagtttttagcttgagttacttactaaatggtgatggttctattggctaaataggaaatatcagaggtggagaagatttgggatgggatgtaatggagatggacagtggggttaggggttcagtagttgaagattatataaatatatatatgcatacatatgtttatttaacatataaatgattaatgatgtgagttgatttactatattgatatacagttattaataaaatgagttaatatgtatgaacaagtaatatgatacattaatgatgtgagtgtgtgtgtgtgtgtgtgtgtatatatagtactatatatgcacattttttcagttaatataattggccctctttatccatgggttctgcatccacaaccaaatgcaggtcgaaaatacagcattcagggcaatgtgaaacctgcagatacagaaggctgacctttcatatctgtgggttctgcagggctgactgcaggacttgagtgtgcatagattttggtatccatgcgctgtcctggaaccaatacccaacagatactgagggatgactgtgtatataacaataatagtttgggtaatcatcagaggatttttttttaaatactctccactttgcacactagaaaaacacttggagcaaaaatcaaactgaatttaagtgggcttctttatagggagaaggaaaatcaaagaaggaaaggtagggaaatggaaagtaagtgatatagaaagcaaaggctgaggcaatttttgcaactcacttgagaaggagggcactgaattacggactgccccagaacaatcggaggatgctcgccccatctcttccccttgagtgtaggattcaggaagactgtctagttcattggcttaactgtatgtacatttacataaggaccaaggagctaaggaggatataagaaaacaagtgtgcctagctagcttatgcttcacagttttgtaaagaaactccagacactagccaggtatttataagcttagttagaaagtacttcgtagagttcttaacaacgaaatagctgccagccatcaagatgatacatgagaagagaacacttgtaaaaactaggacttgagacagtgccttaggacataagattaaaatgtctacattcactttccttgactacacacaaaaataaatagaaataatagtaaatgcatgagctggaaagaactaagagaagtgataggaattgcttagacaggttcataggatggaataacagtaagcagggaatattcagttcaaggagctaaatagttcctaatgttaacagcagcagccagctatggagcaatctttccttcttcccagtctaatggaaaatgccattgacaaaatcacttaaaatcaatggactgaaacacttaagagaagcaaaagggtgcaaaatattaattttgtcaggagaaagggctagaacagcattcctcatttctatttttggcatccattcagtaaactgaacagtttacacctgagtgcctagcttaaagaccacaaatgcagtttctaaacacagagttaagatcttggtgaatcaaagcttctacaaccagaattaattttttctcccttattcccttcaaatataaaggccataaaacataaatttgcaataagcagtttttttaagtattagaatcacaaaatacaaatagaacttttgttttcaggaattattctaataaaatagaaataaaacttacttttggagggagaaacttttattttcctgaatgatactgttttgttttctaattataaaagtagtgtacagaatgccagtagagatggtgctataagttcatgcttttacacatctgatcttttccaaaaacagagcaaagactgataaaacacagaggaaatcagaaagacatttagagattgaaaggaagagagaagaaaaggagagggaaagggaggagaagggaaaggagggaaaagatctctaaagtcacaagcctgaagacatgtaggcctgctgaactccaagtccagaaacaggctggcagtgatggtcggaatttcagctcctgctggggtgtgggaaacaggtgacccagcttcaccccaagaaactgaaccaagctgcctctagcttggtgtaatattactacatagcaggaaatctgagccaccagaataagtcttggtttttgattaggggtcaggaagctgggcaaactattagacaggtaggaaagagggcaagagagaaagaaagaaagcaatggcataagcaaacaaaaacactctcccatccaaatcagctgcaatcccaaattcaaaaacacataattaatacaaacaactaaatcaacaacctacataattggacaaaaaatactgaagaatctgttaagctaaaaatttgaacacacccataatcagagattgatagatgaagaatagaaaagtattaagaatatagatgacttggacaacatttcattcttgattaacggggtcttaggaaacgtcggctggacaagccgttaaaaaagaaaaaaaaaaaagattttcctcagctgggtgcggtggctcatgcttgtaatcccaacactttgggaggccaaagtggaaggattgcttgagcacagtggtttgagaccagcttgggcaactagtggaacctcatttccacaaaaattagctggatgtggtggtgtgcacctgaagtcctagctacttgagaggctgaggtgggaggatcacttgagcctgggacgtcaaggctgcagtgagctgtgatggtgccactgcactccagcgtaggtgacagagtgaaaccctgtctcaaacaaacaagcaaacaaacaaaaaggattttgctccctgagagaaaagagagggatgtgaaaagaagtttctctttcttctcctggacacagttatgtgtggacgtgctgcctagtgcactataaagggaaaagccagctggtgatggccaaccactgagacaaacagagggcaatggacagagcctgggtccctgatcacatcatctggctgctgcgtcatccccagaaccacctcctggagacttctagtcatgtaagttaataaatgttctcagtgtgaaagccacttgcccttgaatattctgttacctgcaggagtcacccaaattgatccataaattagatacatttcaatcaaaatctatacagagttttcatggaatttgctaagctgctattaaaattttatggaagaatgacaggtcaagaataagcaagccagttttaaaggggaacaacactgaggacttggcctatcagatatcaaaatgcattacaaaattacagaaattcagatagatactggtgcagaaataaacaaatagaccagcaggacaaaattgtgagctcagaaacagacccaggtatatatggaaactataattttgaagtgccactacaaagtggaggcaaaacagttctaagacaattggttatacacatactgctttataccccacacaaaaacattctagatggataaaaaagaccatgcataccaaatggatgtaaaaagatatacaataatgccattatagctaaaggtagataaagatttttataacaaaacccttaaagcaaaaatcaaaaaaggaggttaataaatttgacacattaaaattaaaatattccacaaatatacctgttgagagaggcaatccacaaaaccaagccatgcatgtcaggactttaaggccctagttcagttctcaggattgtatttgcagtgagcaaacctgggagatgaagtaacatctttccacagacaaacatcaggcttgataccactccacagaaaagggatatatttcccaagcacagtgttgtaatacgacctcttctgtaatatgacccagtgcatgtgcatgcccatacccacctgttgcacctgtggaacttggagaacatggggaaccagcaccattgttatggtttacaatataaggtttacatttgtatctacaagtatatgctccactgtttttagccttacttcgatatttaaatacattcaatactcaatacccatcttacttatcccaacttccccactcatcacctgcttggctagatttcaaactctcatacttttcaggaagggcttcttagaactacatttgctgtgctcttctttgtatatttgaaaatatctctctgcaacttgtgtaattgtctatgagtttggctttaaattttggatttaaaattatagggtcacattttctttccctgaggactttgtagatattgcccattgtcctccagcacaggagactgcaactaggtagtctaacatcagaatgaattttcctgcaatagatgctttgatttttttgtgtgtaaatgcccatatgcttttttcaacatctttgaagtctattaacaccaaatgtgtttcagtgctaagcagtcggtatcagttttgcctgaaatggtgtgttccttcagtctgtaaatccaagattgcctttatttcagtaaaatgtcctagtgttataattttgaatgttttttttttcctgttccatttgccatgttctctttagagttgcccagaatacttagtttggacctctgttattctgattccatttttatcattctccttttttaatgctttattattatccattttattttcaattttattatttgtgtgcctaaaagtattttagaagtattatttcttcttgtttttaatctagtattcctttctgtgcagctacatatttttcttctactttttttcaagttctaccaacccagtttcttatcttttatactgcttatcatttattccttaagcttttgtatctctttcttgaacaactttatttttcctgagagatcttattattttttatctcatttcatggaaaactttaagcatttttctggtgtgtgtttttcacttggcttttgttttcacatcccttcctacttctttttttggagtatctttgcatgagcccctgctagtggctctttgttgtgtgttagtgtttaaatgaataatggatggggagggtgaagtcaggggaatgatttagggtggctgcatttgaatttcagtttattgtctttgagtgtgttctcaccaacactgctctgagcagccatttcagcttctgcctggtgagaagtctcctgtgcttactgtaaagtccaatatgacatagatatttttgtgtaatgaattagccttcaaatatcttcatctggccaagataagcagctgcagggtgacttgccatttgtgttcctatttatcctgatacatcaacagccttgtttccaggatgacttgtctgcaactttccttgttccactcaccctggccacaccttctgccaatctatggcagcaaggaggactcaagaaacatccccgagcctgcccaggcacctgctcttactgtttcaagcaagtatacatgacttattttggtgaacattgtgctctacccaagatggctgaagggaagtaacctcactcagccttttattaaatacttcatcttatctaatttctactgaattaagtagccctcccaaccttatatggggtggaagtggagtgatgacttgtggcatggggttatgagaacttcttttgtggattatggagtctgcatgtcttgtcctgggtccagattggtctttaattgctaaaagataaatccatttagcaaatcctctctcctgacaccctgacttttaagtttgttctcttgctaagaggttgactacctgccctttccttccatgagatgataaactcatgactccttctggaagagaagatacaagaaaatatgactcaaaaggagaaaattcaaagctctgtcaatttaatagttgtgaaaatgtaatctcatttatgtacccatgttctgataaaaacagcttctttttatatatgttgtttctcccctttattattcacctaaaattatatcaaagacattgtttctatgaatatagtcatatatcattgttttaaaacactacatagaatttcattaaataaacttctattgatatttgaattatttacattttcactactataggaatgcagtaagtatccttatatactcattttggtctcatctccatccatttccttattctaaattttaagaggaggagttgctgggtgcaaaggttacccctttttcaagttaaaatatattttcagctattcgggaggctggggcaagagaattgcttgaacccgggaggcggaggttgcagtgagccgagatcatgccactgcactccaccctgggcctccagcctgggtgacagagcaagactccatctccaaatatattttaccaaacttatgaccataaaagttatcccaacttaagttcccatatcagtaatgagaaagtcaattttctaatgcccatactcacactggttattataattattttcaagctttaccaatctgatggctgaaaaaatcatagagctgtttgaaagtgcttattctcatcagaattgaatgattgttctaaagagcctttacctacctagtgaataaaacatattaaccagtatttttgcatttgattttttaacattgaatctttgattcttctgaagtttacattggcattacagaaataaggcaaaaagctgggtactcatttttcaatgttataagacggcaaaggattatctagaacagtggtctgtaaacccttgtctgctagtcaaatctgatctactacctatttttgtcaataaagttttattgcaacacagccatgctcattctttatatgtattgtctatgactgcttttgtgttataatgggccaagttgagtagctgcaatagagactgtgtgacttgcaaaccctaaaatatttactctctgggcatttacagaaaaaattgccaatttctgatctaagaaatgtacttagttccttcctctcactggttaatacagataaaagactccagatttagtgaaattacatgttaacttgtacctttctctggtagagatacaagtcattctctccaaaagaaaagataatcttgaagattatagtttatggcttagttttgtctttaaccagtattgtttttaaccttgaaattgtatcttaacattgcccataaacacctaacttttcaagtgctctttggactggttttaacgtcatattggctccctcatacattaatgagtttaaaaaatcttcaacttgcatttattttatatttatatgaatcataattttgccttttataaaattatatttttataggtatgaactagaaatccagcttcttacggtttttttccaaattgccagccatttgcttccaaaacattcatagaataatacatcattctccccatctatctaattgttatatatgtggattgaatacaagataactaattagagaatataatttgcatattgattatagatttaaaagttcacagatacagctatacaaaaaagtaacatattctttttctataactcaactaaatttatctgcttaagcctcaagtctgcttattggcagaagacaaaagagattactccagttaaactcagccacttcaggttttctcagtcatttcagatttagactcatttaatactgaaattttcaccaaggagacatgcacctttctgggtgcttggaggagacatggctggcctgcagtcacctgctcacccagactggcctctgttctgagataagaaggccttgctggccctcagcacagtcattcctaacactggatatgcataaatatccacagcccctccaggactaggtcacaaccctgtcccttcctcatcctgacagccaggcttcttcaggccccagccctcatctgttaatgtctgccaggaaatgggaaaagttgcatttgcctctcatgctcctttgggactctagaaaagctgtcaggctctcactgcctcttactgcctctgacattgtcacctcttttttcctgccatgatgcctgggggaagtttcaactccccccacctgctctccaatgcccaccaccaccactatacggagaattgagtctgggagcaaggttaggaagactgacaacctcacatttattattctcctctccacctctcctcccttagtccaggcaatccaagaatgggatagtctagggcttcatctattctcttttcattctactgttttgttcataattttaggttctgattcattcaagcctttaggaaaaagttttggttttccagaataaccctgctataaattttatattatttatttattcatctatttattgattgattgattttcggaggtgttgtttcactattttgcccaggctgtccttgaactcctgggctcaagcaatcctcctgcctcagcctcctgagtagctgggactgtaggtgcatgctactgtgcaaagccctgctataaattttaaaagcccgttttggaacctaaaaacccatttagctgttcctgtattatgagtaattcctcccctgaagtaacataccacatgcttactgtcaagttggggaggggtgtggacagggggacttcccttaaccccttgatatcaatctttttttcctgaaatttttgttttatgttatgtagataactattggttataacacatctaaaaatggaactagcactttgcataaggaaaagctctttggtgtttatcataaataccaggggcatcagaggtgatgaagactgtctaagaagcatcctgctagtgatatgttcattgataataataaggaaagaaaggtcataagtaatatggaaaaggtataattgtggatttgcttggtaatattgagatcttatatggattcccttattattataaaaatatacctattattgaaatatttccagtaaaaataactttgtcaagtttgaaaatcttctaatacagtagattagaagggtggtcattcttgctaatcttctaacttggactagtttttatggtgtggtctaactctttggcagatgaccaaaaatgtacagatgatggaagttgatattgaatgtgggggcagagataaacagtttcctgtttatcctggcttcttctcctgaatgtggtgggactgtttctagtatcctttctataatttctactgtacaacttgggtggtgcacagaactgtgacacctacaagcctaaaggtttgagaagcctttggtgagaagtgtattaaaggaatgcctagtgttggtaagttttctgctggggatgccacataaatagatacctttaccccaaacttctcccaccacctccacaggcagcagacttgccaaaaagtcttcactgcttctggaataatactgagcagattaatattttttttcacctggttcacttttaacctttagagttcatccgtatggtgttacaggagctcattctcactataaactaaaaataaaatcctactctaactgaacagaccccctcttggccaaggggacccaagaaaaaccttaaaaactgaattcctggccataaatggaaggaaagtcgaatagcctcctcattattcaccctccgttttggagttcatacacagctgagcagcattaatgttcaaatagagatcataagactcacgaaacagactctttgtggcaataatataccaaattataaacaagacctaacaccatgtaaggcaagggttaagtcattcctgcaggccaccaatcttgctacatagcatccttatcttaatttaaaacattcctttctgctgactctaagttctagatagagccttactcctttaatcaactgcaaattaaacaatctccaaacctacctgtaacctgtaagtccctgcttcaagatatcctgcccttcggaccaaaccaatatacaccttccatgtattgatttatgtctttgcctgtaactcctgcctccctaaaatgtataaaaccaaactgtgatccaactaccttgggaccacttattcaaggcttcttctgtttgtattttccctgggccactgtcactcatattggctcagaataagcctgtttacctatataacaaacttgcacatgtatacttgaacttaaaattaaaaaaaaaaaggagtgagtttcatatttcaagagatgcttttttggaggtgctctgagggacttgatgacagagaaaactttcaataataagtctacaaaatacacaaggtaacagaaacaattatccatttaaaaaatgctattctgggccgggtgctgtggctcacacctgcaatactagtactttgggaggccgaggtgggtggatcaactgaggtcaggagttcgagaccagcctggccaacatggcgaaactctgactctactaaaaataacaaaaattagctgggtatcgtggtgggtgcctgttatcccagcaactcaggagactgaggcaggagaattgcttgaacccaggaggtggaggtttcagtgagctgagatcgcgccattgcactccagcctgggggacagggcgagactccacctcaaaaaaaaaaaaaagctattctgcctttaaaaagaataacattttgtaatttcaaacaacatgaattagcttgaaggatgttaagtgaaataagccaggtacagaaagacaaatactggatgatctcacttatttctagaatttaaaaagttgaactcatagaagaaaaaagtagaatggtagttgccagaggctaaaagtaaaagtgagtagacagttgttggtcacagtgtacaagtttcgttagatagaaggactatgtttttgattatacatatacattacaaattatacattaataattatcccacaatatatacatgtatcaaaacatcacactgtataccagaaatacataaaattattatttatcaattaaaatttagaaaattagaatttaaaaaatcaaaaagccaaaacaaaacaaaaataaaatattttatggagtttggtttttccatcaatatcactttggagggggatgggtaagaaaagagaagaaatgatgaggagtggttcagaattttctgccccaacattagtcttagaatgttcagcagtgatagcaaagaggccttttgaactttcagtagaataccagccagcgctgttatcgtttgtaccatctactctatctagatggtgtattttgatcactcctcttcctactttataccatgaagatactgctgtttctactgctccctccagctctgccccaacattctatatcaacttccatcatctatatttttttggtcatttgccaaagagttagaccacaccataaaaattagtcgaagttagaagattagcaagaatgaccacgcttaactggtttaagttgtttttatatctgtttacaagtgagctagcaaacagtgagtttgcctgtgtccagattccagcctgcataccccagaccctcacccccagccacttgctcccacagggaccttggggtggttcaggttatcctggcagccaaagccccaacagttgccccttcctgcctttgtttaatgggggcttctctgtggccctgaaatctgccaggtattaatgagcacccctaccacttcccgttcctttaaggggctttagagtcaggcagtggaggtgactggcaagtcacacaaccttctgagccttatttcctcatctataaaattattataggatgatagtaacacctaccttataagataaggattaaaagaatgcaaatgtttcacaacgtttctggaaacactccataagtatggcctattggagtgtgtgtgtgtgtgcatgttctcccaaggttcagctgagatttatacaatcacaggatactttccaggctattgtttgtgtaaaccgcactgactgaaacagaaataaccccaatctctgctaaaatctggggaaacactcctaaacattttagacatatacagattttaaaagatactcaatattgtaagtcttacaatacttattaaatgtccaaaatttaccctaaggttcctattctttgaggaaaacaaacccaaaggcaaagggaataatcttttctaagtaaagtgtggcaaaataacattctgtcaggtattaaagcaaataattgctacacaattcccgatctttgaagcaagttctcagcaaaaatattaaattgctgccaagggtttagacatttaactttcaagaatttagattgatgatgattattatttcaatattgttgcttatctacccagcagatttccccctgaaagccaaagggcttaacaaaaccagaaagctggccacaaattgccacggtgaggcagccctaaggctctgaacgagatgtttccctatggagcagcaggaacccctgcagggaagtgaacagcagcccccttcacctggtaaggctactttgtgccagaattcgcaggttaacagcagctgtgaaagaacctggaagcctccacaggacaaatctgctgcagggaagggcccagcttcggttggccattccattctgctcgagtccagtttgtctgggctccaagagctaagggtactgaatctccactcatttgtttgcttcctccttgccttaagaagaccatggagcattctctggactgaaatccaccccccgaaatgctgagggccttacccttcataggtaaataaaatgtgagacagacacttgagtttatcttctaatggagctgtgtgaggttgggcaaatcactgaaccccttagttccttcatctgcaattacaaaggcctgggttagatctctaaagtccctgttagcttaaaagtctatgtttctaagttgactgcaaaaagagaatgaaatacacataaagaaaataaaaaacttgtttgatgaaaagttgccccatggttgaagagtcacgaagagtgaatcaagtcacaatttcacaagtttaattataaataaactcaactttattccattcacacagtcttcaactttaaaagataaaagataacttactggtgattcgatgtcctctaggagtaaaacagaacagcgttcacatttcagcagagtttgggcccgatgcattattttcttgacaattttctccaggtcagtctgttcttcaaagaggtcattaaccacctctagcaaagcctagaaaagatgaaatagatgtatataagtggatgtaaaactgaaaaaaagttgcttttcttcttaaaatttaatctttgcttcaataaaatatagtaaatctttttgtgtagctaattttaaaaaattttatgattgttttgacatatttttatctctcaattttagaacacatgcttaaactgcaaaatacaacttgagaatagagctagttcttgtaacaggtgtgaagataagtaattcaaaacctaagctattggaactctagattattttgagtcttaaaggatgctgattataggggtcacttgagaggcaggtgtaaccaaggcagctataacccttgtttctcttgactatagattagccttcttccttaccaaaattgtttggtaaaatgttgaaaattactaatgagcaccagagaataccccttccctcttcactgttgatcttcattacagattaacttccctcttactcttctcacacaaggactccatagccataacattgccttaagatggaatgttaaatatactcttttaaattggaaagaaaatgaaaaccagctatgaagaaaacaagctgtatagaaaagaaaacaaactgtaactaattatattgctataactcatacaccggccttgtatagaaaatgctgaaaccctattaaatttctttactttgtgcctgtagaagcaggagcttaacttttaactttggaacatttaccccatttctctggagtctgtatctcccgaattggccattcccagcttttcacttgaataaactctttaaaactagattctgattattaatatttcagtttgacacagggatcatataaccattagctacaggcatttccacttttctgtagtgatttttctgcaatgcaactaggtacaaacccaatattttggccgggcgcagtggctcatgcctataatcccagcactttgggaggccaaggaaggtggatcacaaagtcaggagtttgagaccagcctggctaatacggtgaaaccccgactctactaaaaatacaaaaaaaatttagccaggcatggtggcatgttcccgtagtcccagctactctggaggctgaggcagaattgcttgaacccagggagcagaggttgcagtgagctgagatcgcgccactgcactccagtctggacaacagagtgagactctttctaaaaaacaaacaaacaaacaataacaacaaaaaaacaaaaccaaaaaacattttataaataatgaatacctccaaagcacatggatttcagaaacttacaaagcagcttttcctcactatcaggaagaaacaggttcttggtcaaacttgagacattttcactaatacacatcccttacataactctgaaagaattagagaggtgaatgctaattaagtttcagattcttaaatatatatatatatatatgtaatttacatttagtctttgctaaatataaatacataaattacatatataatataaatatatataatatatacatacccttcatatatataaaatatatataccctccatatacaaaaatatacatatatacacacatacatatgtaccctccttaattcctctacccaagaggaaatactgctttatcccaaactgtccagaagaacatttagatatttatatatcaggaaagaaaacacattaatttttttttaaaacagcagaatgaaaagcagacaacttagaaaaaaatcttaagctctaacttgaaaactgtgtacttatttaaaaattaaattgtagtaacccgtggttttctctagctaagaaattagctgcaatttttttgcattgaaataatgtttgtttgctcaggtcaggtatggatttgtgaaaaataaaaaataaataataaataatatttgtttggaatttttaatggcatggatgtttccagagatttaagattagtaggttatgtacaggtggtagacattatgcttctctcagagagcaatcagaaaattacatagtcagtgaattgcccagagggcacttgattcaacagaatgtagaaagaggtgcaatctcaagtctgacctctcacaaaaggaattcatgaattgtcaaattcacatctattcatcatggtgctgatcatcatctcagggacatgactaattttcaacttcaataatgaatttgatttgtcctgaaattatttgaaatgtgacaatttcttctctgaatctattcaggtaaaaaagcatttgagtagctgggtgtggtggctcatgccaataatcccagcactttgggaggccaaggcaggcagatcacatgaggccatgagttctagagcagcctgggcaacatggtgaaaccctgtctctactaaaaatacaaaaaaattagccaggtgtggtagtgcatgcctgtagtcccagctactcaggaggctgaggcaggagaatcacttgaacctcggaggcggaagttgcagtgagctgagatcacgccactgcactacagcctggatgacagagtgagactccatctcaaaaaaaaagaaagaaaagaaaagaaaaaaacatgtgaatgagttaagaaatccatgaaatgagtccagttcaatgagcaattgaaagaggaccaaatatcctgggtagggttattgaaaccaccattgcaaaattataactgggctgacctaaccagctccatcttgcttctaatctccaaactgtccttgttcatttctgggcataggctgaactaactttgggaggaacacagtttatagtttattgtttaaaacaaagatgacaatagccctttcccaaacaaacctccttcttccctggggactagaatgccttcgaaggactaacaaattagccacaagatcagaaattatggcttaggagtcatacagctgactcttcctaaactgcttctcagatcagtgcttgagatattttgcagaccccgtacctgatggatcagctggcaccacccagatcgataaattggctcatctgatcttgtgaccccccccatccatgagctaactcagggcaagaggacagtttcaattccctatgatttcatctccaacccaaccaatcagcattccctactcactggccttcccccacccaccaaattatccttaaaaactctgatccagggagactgatttgagtaataataaaactccggtgtctggcacagctgaccctgtgtgaattactctttctcttttgcaattcccctgtcttgagaaatcagctttgtctaggcagcaggcaaagtgaacccactgggtggttacattatctctaaagaaagactgaacagagctaaggaccatattgctccatgatcccaaagcaaacaggaacatcaaaaggtgaaaaaacttttaagtgaatcttgatatttggcatttggacagcaaatctctgtaaggggtcaatgaacaataatttcatgtttagacattaaaaatgagacaattgtctcagtaattacaagcaaaaagccctgttattaatggggaaaacattatttctttaatcatctagactatttcttcagatggatcatattaactgaacaattatttaacttttcaatttgttgtgattgcatggagagagcctctgggatccatatacaagaatatttatctcagaggaaaaattaattgtgccttgagtcttgcactgacaaatcacattacagtaattttattgtttctaatttaaaattgctttattaatgagtgatggaagttttacaaataacaatgcagactagctccaggataggagaaaaagagaagaaaatctaggataatatctgttaggcctctgagcccaagctaagccatgatatcccctgtgacttgcaagtatacatccagatggtctgaagcaactgaagatccacaaaagaagtgaaaatagccttaactgatgacattccaccattgtgatttgttcctgccccaccctaactgatacgatatattctcccccgcccttaagaaggtactttgtaatattctcccccgcccttaagaatgtactttgtatgcctatcccaaacctataagaaacaatgataatcccaccaccctttgctgactcctttttcagactcagcctgcctgcacccaggtgaaataaacagccttgttgctcacacaaagcctgttggtagactctcttcacacggatgtgtgtgacaatatccaattcaacagataatggaagtattttacacagttgaataggccctgcttcttgatgtcacttgccttccaggaaatgagtatctgcattttgtccctccttctagtgaccttcttttgctcctggatgtgtccttggagctttccattctcttatctacatattcttccctaaattaacccagctagattcctggctttaaatagcctttatatgctgctggttcccaaatcttaatctccagtcctgacatcttcccagagctttagactcctgtatccaactgtttacttgccagctgtgccagccaagagtctctttcactcatttcccatatcagcaagcccccacagatttcaccactgattttggaggaaatctgtcacttctcactgccctagtcccagccatattattttttgacttcaatacagttctttcctaagtcctctcactgctccagccttctccctccctccccagccagtttattatctccagggaggccagagtgaactctattaaaagtaagtcagactcagctcaaaatcatctaatggctttccattgcactcagaatgaaagccaaagcccttgccatgcccacaggcttttctaccatctggcctgcctccacgtcctcattttattttttttccctttcactcttcccctttctctctgctctctaaacacactgaccaagctttctcctgccccaggtcctttgtgtttggtattccatggccagaaatgctctccgcagacctttatgtggctttgctccttcttttcattcaagtttctgcttatagatcatgtccttatacagacctttttgataaccctctaaaataaacatcctcccaactcagccttcctcaaccctttatccctttatctcactttatttttccttgcagtatttattgctacctatactatgcaatttaaaaaaattgttttcttatctaatatgtattgttctcatgaatagtaagctccgtaagggtagggatttggatagacagcatgtgaagggaactacataatcaatacttgttgaatgaataaattaattgtgccatacacaagaatgcaaagattaatcatatatgaagcttcacttaaggagttcaaaatgtagttggagaggcgggccctcctcaaatatcataatacagtgtgataagtattcataatagaatagtggcagtagatacaaggcaaaaccataagtgaagaagggaagattaatcagaaagctgagctgggtcctgaagaatgtgtgaggcacatgatgtggttggaaggagttggattgacatgaggcattgaaggccgagggaggaatacggctaaaggtatgatcaaatgaaacagattgtttgctggaaattggggactatattgctggagttccagatgaaagcaggagcacggtaagacatggggctaaagatgaaaagaagatcaaaacagagaaaagatgtggtatgtcatgctaaagaccatggctatattagtcaactatgttcatctgtttactgataaaaatatccataaatcataataattagcaaatgaaattttaatcaacttgatggccagattaattagggtttcaaacctttttgaacatcgttttgttaaatatatttctaagttgttacagtaatcttcctatatttaaaattagaatgagtataatataatttaatctctatttgataatgtagcattttttgagtactagactttgccttttttgcaacttagatctatagctcctgaaggtataaaagagctctctaagtgtttctttataatactgtaaaacagtctttgcattattgttccaagtatctagtgaagggcactttcagaaaccctttcaatccaaaaatggtttcaatccaaaaattgtttcaattcaaaaataaaatctgggaagtgggggtaagatcatgtttgtaacataacttgcttcttaaaggaacttagttgtaaaagcatcaccaaattgtgttattgcttcaaagccataagtaagcaaggatatatctgctgccttatagtatagatgtgatattaatctcctttttttttttttttttgagatggagtctagtctgtcacctaggctggagtgcagtggtgcgatctccactcactgtgacctccgcctcctgggttcaagcaattctcctgcctcagcctcccgagtagctgggactacaggcaccaccaccacgcccggctaatttttgtatttttagtagcgacaaggtttcaccatgttggccaggctggtcttgaactcctgacctcaggtgattcactcaccttggcctcccaaagtgctaggattacaggcttaagccatcgtgcccagccaatttcatttttaaaagaagcttgtaccccttcccccaaataacaacagataatgtgtatccacttccatttgggcttattgcttaaagtgtatcttcaaccacagccttgcagaattatacaaataaaaaagattcctgtactattcaaagatcattcattggctgtttttaaaagacataatgacttacagaaaccagaaagagagttttgaggagtgtcaacaatgtttttatttactcactctgcttctttcatattctttccttgaggcagcaaagagctgagcgttagatatggcgattccacaaaatggaagatacatctgcataacctgggacaaagagagtagtaagaacattaaaacataagaacattgatacatcccttgtagactaaattgcacacttcttctatatgcctgattgtaatactttatttgcatctatagagattgaatacagagagttgttgatactagtattttaacttcattatgaatatttttcaaagttaactaaaatatgttgtaaatcaagctttaactagagaattcacatctatgaagacataaagtgaagcaacagattatgagggctgtgacataggaactgtgtctaaagcagcttgtattatttcttggataaaagaaggataaataagtaaatgaactgtgatatacctggaatttaaggcatgtgcccatactcacatttggaggtaggcaggatataagtcaattctttcgttggcatatggcatataccatatgtatatggcatacaattcacatctgtagcagggatttcagcttgattctagacctatctgctaccagttttaaacatgcctgtcaggatgggcccagtgggaactaggggtcagcaggcctggcagccttctgcgacagagttctaattgtgtctgccactgtgtagacataactggacacaaatcatactggtgggatgcttctgcagaagcctgatgaggaaaggctgggagcctgtaatggagaagtcctcctatgggcagaaacacccagccgtgatgggcctacccctaacaaagactttctcatcatggaggtttaggcatagggatttttactactgccttgcactctcaagaaattcatctccagaatctctgattccagagagatagaatgctccaagtaaaaactgaaagaactatttccctaaattcttcgcaatgtagatgaaacaagtgacatacttgggacttctctaaagcaagagggaaaaaagcatgtttatatcatagactctatgtctctctgtctctctctcacacacacacacacgcacgcacgcacgcacgcacgcacacaatggtgccctaggaagaggtaacaagcgctggcaaaatagagcaattcctgctgtaaccagcagagggcagtgcagtgcccgctgtgggtgagggacgacagcagcctccaccaactcaggaagcacttgtgaagcacccaggacatccagaaaagaatcacctggagtgcaaggcaattatgcagaggacttgaggtacacaaaagatgaagggcaattcacattccctatcgctgaatttcctattaaaatctttccttggttacctgggcatgatcaactctgacctagggtcctggaaagaatttcagagccatataaaaactaaagctatgacctcatttttaaagaagatagagaaacaatgggatccgaattaagaagacatacaaaaatcaatgatttttgcagatgttttggggataaattccttccctggattttcacatgttgccttctggaactagatgttatttctgttaccccctactctcccctttcttgctactccccctcataccttagaaagtctgtccataagccaagataaagctgttggcataaagctgccagatattccattagaatttccctgcctttaggcagaatgggaccactttcaatatcacctacacatagagcaagcactttccttgtagttttctggaggttttgtttttggctcattgtttttttctgccatggagacaatgactataacggggataaaagcaaggaggagacttattttaactttccactacttatttgttttatttatttttgccttcaggggacaaatttaaggtggttggtaagtcaagcaagtaagaggagagtgatcaaatgaagatgtgaaatgttttctaatatatcataggcttgcttcacttcatttgtaattccaatatttactgagttccaggtattatgttaaattaaaaagaatctgaattttaaatcaaataatctttgttctttttacagttttgctgtgtgaagtgcaacaaatcatataagctcttgaacctattttcttatctgtaaatgccaggtttatggtcttttttagttctaatctttggtgattcaaataatgcaaaacatcattaagctgcaatattctatttactagagaaaacagaattcagtaaacatgcttgcaccttattcaagaaaaaataatttataatagtaattgccattggctaagcccttctgtcattgtgtcaggcatgatgctatgtgtcagggatgatgttaagcattgtatatgcattacatctgttttatattcacttatgttttaccattaatcccagtttgcagattagaaaactgaggctttaagaacttacccaaagttcttgggagataattctctatggatattttatgtttctgtacacgtggcagagagaggcactggctgtatctttctggaatgcttatacaatgaacagccttggaagatagagatactgtctcctttcagagcaaagaacagaagtgtttactatccagtataataaagacaatatctccctctagacagaggtcaggcaggctcaccgttcattataaaagatttgggttgcttacatttcaggttcctctgctgtcatgcaatctactatatgtgctattactggggtcagggaaccagcaaaaatgctgatgctcaaactattgctattgttgtgagtaataaactgtttttttgtcactgatccaggagtctcatgtcttctgtcagcatccatgagactgtggcagactaacttgctagcctgcatgtactgtatagtaaaatcagactctttacaaatcttaacaatgtcacctagatagcaaatggagaagcttaatttagaatccaagtggcctaaccctaagatctaccttcttaacttctacattctccagcttcccaaagtcatacatatctttcatacaattaatatgatagtctggttaactgcaatgcaagatagatgactaagactagcactccattattccagtgtatgagcagtcacaggagactgcagaagcaggaagcagttctggtagagcaggcaaaacccagtttccggagataacaaggcaaccattctcagggggcaatttgtctagcagatggtgtaagggaaatcctaggtagagagcagaccacactgataggcatcagagtgtggttatgaaggccagagtagaaagttggggcagaaaagaaactgagcctgtcagcaggtagcagggccctcgcctccaggtggagctttaaggatcagcttatactcttggtagtgaaagggagggaaatggcagaagaaaggaaggggcccatcaggtatgaaatgtgaggcactatgttttaatgagacacagaactgctcacagataggggctgtggcaaagctgggcccacaggtgagggtcctgtggtgtgcgtccagctatagcgtggaaaatgaatcagggaccaggaaccaggctgtgttccacacatggctagagaggttccagtcttagcccagtgggaacactgcagtgtccccggaagcctaggaacagcccaacatcaaactgtcagtcaatcacaaatctcttcatcctcatccaatcttgtttctgttaaacctagtttttaatctaaaaatttagaatttgcaaatactttttccaagtagtataagctattcttcatgaatagtacaatgtactatcaagaaagcatgcaaatcagatcggtattagttcttttcatctaccccactgtgtccgacaaagcacccctcaatttagtcctgacagatgaatggtatttacttgtcacaacctcaggaaaagcaacaccacaatcttcctccattttacacatctagcaaatgtcactttcatgaaattttctcatacaaatgtaacaaactccttatatcacaatatacttccaattcttatcctttagtggagatgaaaaacaacaaaaactctgccattttaagccaattacaaggcatttaacatggcattttgaatggcaaaagagactcctgctgtcttgttttgtgtactccaatttttcaagttaatgctcctataacagcatccaaacaaaagcaaatggcaaaatgaacacccaactcactgtactgggaatgcacagatcagctcaatttaacaagagccgcccgactgccttctcccgtcaggccctgggttaatatgcagcccgtacactaaattgcatgacaccattactattttcaagtttaccactagtttcagctacatccctgagaggattactagccagctcaaattccttcaatattttcacaaaaatacaggctaaagttcaaatttcaactccctgttaaggccttccaaatgttggccctattggacattactactattgttattattaatgtttgtttagatttacccacatgtgtaccagttttttcctcctcattccttccaacacctccttccttctttctgtgatatagttttattttttttccaaagacaatcctttagagtatcttttagcattggtgataaatgcttttagttttgtatgaatatgtttattttataatcaatcttaaaaggtaaggtagttgggtatgcaatcctaggcttacacttattttctctcagtacttaaaacatattattcccttatcaagtgcaactgatgctgctaaaaagccagctgccaatcaaaatcttggtagattatctgcctttgtctccggtttcttttaggtcttctttatgtcattggtagccaatttgtattttgtcagcctcaatcaaaggcttaattgaatcatggtaacctccaatgtatatattggccaaacattactgtggatggagacaatattataccttcatgactcattgcacactgagagagaatctttgttaatgtaggaaatgttctaccctgtgtcattcattggcatgacaattcagccctctggggtcagactcaattgcacaatgtatacgcatatgacagtatgatctatggagtttctaaagaaatgtgcaggagaagcaggcaaatacatttttgaaaagaggcagtaagaaaaactgaagcagtgtagaaatagaaaatgaaaaacaaaatattttaatcttttttttcagtcccagtgttacagatgtctctctctctctgtctctctctctctctctatatatatatatatatacacacacacacatatatatattgctctattctgctattctgctctttctgaagtccctcatttccaaaaaaaccaactaatttggccttcactatgtagtttcagaatgccaaaggtctaaaaagccttaatgactaagaagcaaatgagtctgtacacgcttgtgcagcacttttcggcttgaaagcactttatgaacattggctaattaatctttacaacatcccactcagaaagagagttaaactgaaaatcattaaacagtgtaaaaaagtcactttagccctggaaactcattaaactatcactaatatgcatagaatttgagcactgggccttctatcaatgtacacaaaaaaagacagtaggtagccagccttttcaaacttgcaagccacagagaaaggctattaaagccccattgtgtggtctggtccaattatacatcattgaagaatgccgggggtctacactggagaatcttagtgaagggggccatcccgttcgtggaccctacttgtagaaggcaaaacagcttgaagagccacatcactgtcagctaaatgaacaggtgaaaaaaaggttttcccacctacagataacacctcctccctttgtgtagattctgaaaacaggactcttaaagtcacttctgccctcaggcagtaactatatgataaagcttcactgatttggagcccactgatttggaactggggatgttttaagacagttgtgattcaaatgctgaataaactcttcaagtagagtaatttagaaaataacatatcaaaatatgaaagcagtcacattattttcatacgatgaaatactttcagagcatttttaggaatataatattaaaaataatttttaaatgagtttgcagttttccagagattccagaggaaagccctgcttccagaggtatagcttcattcactgcaattttgtttctacacaaattcaataaagatgaaagatggagcttttattttaagaatcagaatcataaatgacttttgttagttcataccaaaatatatgaccttggctaaggcatgcctttttccaccagtgttccgcccttttcaaagaaaacagtctccaaaagatacaaataaatataaaacattgttttaaaaattgtaatggggccaggcgcggtggcttatgcctgtaatcctagcactttgggaggccgaggcaggtggatcacttaaggtcaggagttccagactagcctgaccaacatggtgaaaccccgtctctaccaaaaatacaaaaattagctggccgtggtggtgtgcacctgtagtcccagctactcaggaggctgaggtaggagaatcacttgaagctgggaggtagaggttgcactgagctgagattgtgccactgcactccagcctgggtgaaagagtgagactccatctccaaaaaaaaaaaaaattgtaatggaatagatgattcaattacatgtcttttgaaattgtccactatgagaattgacattctgaagaatagggtgggggacttcattcacaaaagacaagggagaacaagagggcaaataaaaaagaaggagaagctttgttttttggagacagaaacaaggacaagataatggatcagagatgtggggagggaagcaaggaaagcaaacccaaggtgggctcctcactggtccaaatttggggcagaacacatcctaaagcgtgaatctttacaggctccccttctcctgtctaggcgtcctcatcactcttcttccatgttcccttcttaggacagggaaattgaggtgcttctacttctgtccctgagtattaaagctgggaccccagggaggttggaatgagctcccttccactactctagcccctctcctacaagctagtgttggctaaaatatccccaggaggctatccaggggcagagatgctgaattcagttcctggcaagtagcctagtagcatcaacatctattctctttgactttttagaagctctggtctactgagtgcttgaatcatgcaggtactactcatatcactcaataaccttatttctatttggtcctatgtccacccccacaactttagggaaataaccttctcatgtctgggggcagtttttaattcccaccctcttatttccagaccctcagggaaaaccctgaaggaatctattgcaggacccatgtcctttctaaaataatttttttttctgatcatagatttcaagagaaaaaaaatacccatatttctgccactcaagggtaaccattattaacattttggaatatattcaagttttcttctctctttttcctttcacataaagccaaataggctaatcctatacataatattttatcagcttttttcactttttataactagctattacctattatgaccagtttctatggatgcaaaatatcccattgtatggtgcagaaacataaaatttatagagaaggaaagtagattagtggttgcctgggttagcagcagtaacaggatttgctgtaaatgggcataggggatcttattggtagtgggttctaaaacggatttatggtgatggttgtacctctcataatgttactaaaagtcattgaattgctcacttgaaatgtgtgaattttatgatatataaaatatacctcaagaaagttttaaaaattaccataaatactctgttcatggtatggattaatgtagtttacttagtcaatcatagaacgttggacatttaggttgcttccaattttagattaataattctggggttaaacatcctagaaattaaatctctccgaatcccattattattttcttagagtaaagcgttgatattggaacttactttattcaacacacaacttatatagcgcttttctgtaccgggcaatattctaaatgctttactaatattaattaattgagggttgtgtaccctttaaaataatccttaacaatataaacacatttactttttgctaaaagaaaacagtagagaaatgcatagagtaaagtaatgacagttcccccttaatttcctgtcccactacccactcccttctcaaggtacaaccctgctagcatttgtagtgtgttcttctggatgttttatggctacagtcacacaatatctagttttagggttgtttgtaaacataagtgggatcacactatgttattttcgataccttctttttcacttggcaatatatcttggaaatctttacatgttaattcaaagagaacttacttcattcatcttaatgtctgcagaatattctagggggtggttgtatctgttactagacattgccattgtttctaatttttctttattacaaataatgctgctgtcaactttcttacaaataaatcttcatgcacctggacaatacttctgtttgacagtttcctaaaagtggaattttaaggttgaagaacatatgctcaaaaaatcttaattactactgccaaatcatcctccaaaaaggctctaccaatttatactcccactaacagtaatcagaggattcatttaccccaactcatacaacactgggtattaccattcttttaaaatcttgtctatccgacagataaaatcagtactcatttttgtattaactgacatttacttgattaatagattgaacacttttcataatttgttggttgtctgtattttaaaatatggcctcttttgcttattttgtttattttttagtggacattcatctattacttattgctcagtaagtaccctttatgtgctaagaatattaaacattttccattttcacaattcatgaatcttacttgataatcaaacagtaattgtcatctgtttgatataatccattaggcctacaagctatgagcgctttgtctaagatgaataatattatggctccataaacttggcctactctctctcacagtgtgaagatcttttacaaagatatctgcctatataactctgccaaggttatttttataagcaggttgacctacatatatcatcctgcccatttattccatctgcctttgtaactcacagcttctgcaaaaagttgttttgagctgctgtttgatccaagcattcttgagttttagttattaagatcattatgattccccacttacccagcacaggtataaatgcaggaagctacacaatagagtaacttagtcaaggtgtcaaggtatcaacaccctgaaatgctagaaaaatcttattatatcacaatgaacatacgaacataaaatttcctcttacactattttctgatgagaaatgcctaagtttttctttaaatttgaaatacattcacattatttcctcctattagtagcagaaggcttttcttcactgtctcgtttatcaaactccttcctttttataattcctggttcataaagtacaggacattacataaaggcagaatcatatagcatgtggccttttgtgtctggctgctttcactttgcatgctgttttaagggtccatttatattgaagatatatcagtactttattccttttaaaattttgttttaaagaagtagattttttttagggcagttttaggtttacagaaaagttaagtggaaagtacaaggatttcccatagaccctgcccaacacacagtttcccctattattaacatcttacattagagtggtacatttgttacaactgatgagtcaataccgacacattattaactaaagtctagtctacaaagtctacaataggttcactctttgtgtcacacattattcggattttgacaaatgtacatgttcaccattacagtatcatacagaatagtttattgccctaaaaattccctgtgcttcacctgctaatccctccctccttctccctcagtctctggcaaccactgatctttttattgactctgtagctttgccttttccagaatgtcacatagttggaaccacgcagtatatatccttttcagattggcttcttttacttagcaatatccatttaaggtacctctacataatttcatggcttaatagttcatttctttttatcactgattaacattccattaactggatatacccatgtttgtttatccattcacctattgaagagcatctcaattgctcccaagatttgacaattatgaaaaaagctgctataaacattcatgtgccagtttttgtgtagacataattttttgactcatttggataaatatccaggaatgcaattgctggattgcatggtaagcgtatcgttagctttgcaagaaactgctaagctgtcttccaaagtggctgtgccatcttgcattcccaccctttcctatgtctgggttctccctgtcccttcaaaggaggagtgtttcccttcatttggtattgcttccaccttcactgtgtaatctacatctgcttcgcttcatgtcctcactccctgtcattttgcttacagttttgcagtcttcagaaatggctggcttgtggcctgtctatgacatcccaattacccgaacatgaaatacacctataatacattcttattttctgcagcctttaacacttgatcaccagctagatatgaaactttggcttccatggactatacacccctatttaatctttttctacgtttctgacactcatgttcaagttatattcccgggttcagtctttggtcttctaactgtccctttctacattctccctctaagcatttatttatttctacaatataagaatattacaaaataaagtgggttggctatgcaggaattaacctttgagcaagagtcagaaaagacaacaaattcagtactgccatatatttaaggcagctgagaagtcttcctccttctgctcttgaactttggtctgtcacgaattccctctgcctctgatttcactttcctacatccctaaccccacttctaatcagccacatctgctacctttcagacccacgtttcagtctctaatccagacacagcttgagctctgaaaacatttgcttcctctatcttatagtctaattttagtattcctggtcctagactgaactgaactctgaattcaaccatagtgaccgaacaggcaccaaagtcccttccttctatctgtgtcttctgtagttacctctggaacgattctcaaagtgggctctctagtgctgacattttctctgtgctctggcttcacatcaccaggtgcctagaggacatttcaacttgaaggttctttttattttattttattttattattattttaattatttgtttatttatgagatggagtcttgctctgtcgccagggctggagtgcagtggcacaatctcagctcactgcaagctccgcctcccgggtccaccgccattctcctggctcagcctcccgagtagctgggactacaggtgtctgccaccacgcccggctaattttttttttttttttttttttgtatttttagtagagatggggtttcaccgtattagccaggatggtcttgatctcctgacttcgtgatccacccgcctcagcctcccaaagtgctgggattacaggcgtgagccaccatgcccggccaacttgaaggttcttatactaccacaaactcagcattctgaaaccaagtttatcatctcaattccccttgtccttccaaagaaagagggcttccgcctccaaaaccaccctatatgtgccaaaaaaaaaattaaagttcaaatcacccaattccaaatcctgggagccatcattgattgctatccagatgtaggcataagcaattcaggagcttttgaaacttctgttcccatggccttgatttcccctgctccagcactgccatcactcaccatctctggtaatagttcccagatctctcaccattgctgcaacagtagccaagatcctttcatccttgcaatgtgacaagaacccagtaacctttgtttcccatccaggaaagctataaatttaaacacactgactatccatcccaatgtgctccattgtcttaactttttaaaatgtaaggtataaatatgtcttacacatattaaatactagtctttttcaaactacatttgcgtgagcattttcataccacatacagtatttttaaaaatctcattagaagctcatcagaaagtatctccaatatttaagactgtggcttagcattttacagacactgtggaagatatgtaataatctcaggaaaaataataaggaaatataaaattgctatttagagaaacacatgagacccagaggggattattctacttatatatcttttttttaatttccaaaataattcatcatccaaatgcaacactaatgacatggataataaaccatactattttttaatttccagtaatattctccagtggagtttaaaacagagaaggctatgaaaatatgcttagagcattaatatttaattaatgtaatagtaccctaaaatgaatattataagtgtaaaagccttgatataattcgtaagttgtatctatgcaactaaaacacaaaagtggtacctagtaaattcagggcattcttaatggatagccttgaagacaaaaagagctttaaagtttggcctaacaacaaacaaaactttgtgaagggccaatcatttattaacaaactggggtatcaatccaaaatagcagaggggaaactgtctacatgagtcatcagtaattcagcaagatttctcatttggtatcctagaacagtctaacttacaaactaagatgctagcttcaaagccaaaatactttattgcccctattcacagtttctactttccacccatattcagtctatctgcaacagagtctcagcctgtcctttattgcttcctttctcttcatggttcagctatttattttgagggctcaattacatacaaagtaagcagaaagaataaatgataagcctaaagacagcagaaggaaagaattaattaaaataaaagcagaaaatagtaaatgagaaaacaaccattagaattgataaataaatccagaaatagctcatgtagggaaaagcaataaggcaaataaatcactagctagtttaatcataggggaaaaaccccgaaaatatactaaaacagaagtgatcaaggaaatagagtcacagctacagaagaaaatgaaaagaactataatagacattttttgccataatctcaaacttaaatatttgcaaatctgatgtaaacttgtatattttaagcaaaatataaattaacaaaactgaatcaagttcttcaagaagacctgagaatttctgagtaaaatagtcaccacagaaataataaagaaacttgtaaaagactcattctcagaaaaggggctagtccaaatggcttcataggcaaattctttcaaatcttcaagaacaagaaaattcctatgctattcaaacaattccagaatccagagaaggagactctcaaatattttttgaagacacattatttattactgatagcacatcatgataaaaataatgcaaaaatcaaacctacagaatagatcccttatgaaaacagataagaaacattctaaataaaaatattagaagatttaacatttttttttttttgagacagagtctcgctttgttgcccaggctggagtgcagtggcatgatcatggctcactgcaacctccgcctcccgggttcaagcgattcttctgcctcagcctcttgagtagctgggactataggcgcgcaccaccatgcctggctaattttttgtatttttaacagaggtggggtttcaccatattgaccaggctggtcttgaatttttgacctcgtgatccgcccacctcggcctcccaaagtgttgggattacatatgtgagccactgcgcctggccagaagatttgatatctatacatacctgtatattagaaagttgaatttagccaaatattgaaaaatggaacatgactaagaatttatatttagaataaactgattgttcaatgtttcaagatcaattattccaaactttcatattaacttttaaagcaaaaaaatgatcatcttaatattctaagaggtcatttgataaaatccaatacccaatggctataaaatttttaataagttataatgggtattaaagattttttaatggaaaaacgtgccatatttctcaataaaaagatattgaatcaatattaaaaagatatcaattacctgtccaaattaatctataaattttattctagtgaaacttagaatgatatttttggaatttaaaaaaaaaggtaattctaaaattcaaatgaagtgaaaaatgtttaacaatagtcaatattaaatgaaacgagaaataagaggaaccaattgtaaggttatgatgaccaaaacagaatagtactaaggacagaataatcatgcaacttaaaggaacagaagtccagaacaaaatacataaaataagctcatatgtaagaaaaggatggtttcatcaataaatcgtgttgggacatagttcatcatttggaaaaaagcctaaaaattagaaaatcctttttgaaaaagcccagggaaattaaagatagaataaaaatatataactataaaagccataggggaaatatggtaaacatttacatagttcttcattgtgaaaggcctttccaaccataccctatatgtggaaattatatgagagacttcacactcatttaaaattgaaaacatctatatctcaatatgtaaaataaattaaaaagcaaaacacactgggaaaattatttgcaatgtttatgataattatgaacctctaagtaggaaaaaatcagaaaaaaaaatacctcaaaaatggtcaaaagatataaacaggaagtttgccaaaaagaaacacaaatagctaaaagaagaacaaaaagtgttcaggacactaattatcaaagaaatataaattaaaataacaatgagctatcagatttctcctactatattgacaaatattatcattaaaattaatacccagggccaataataatatgggaaaacaagcattctcatataattattgagggagattcattggtgcaacaattctgaagaacagttttgcaaaatatataaaatgcctttaaaaagtacaggccctttgtctttacaattctattcttagaaatttatttattatttattatcaccattagtactatttattatacttaaaaatagtgaagatggtaaattatataagtatattttgcttcaattaaaaaattgttttgggccaggcgcggtcgctcatgcctgtaatcccagaactttgggaggccaagacaggcgaagcacgaggtcaggagatccagaccatcctggctaacacagtgaaaccctgtctctactaaaaatacaaaaaattagccgggcgtggtggtgggcgcctgtagtcccagctacttgggaggctgaggcaggagaatggtgtgaacccgggaggcagagcttgcagtgagccaagatcgtgccactgcactccagcctgggcgacagagcgagactccatctcaaaaaaaaaaaaaaattgtttcaaaaataactttttttttttttttagtattaggaaagaaatcataatgtacaaggttttttttaaattgacaatatcccaaacatcgcaagatccagaaacgtagcatatttgtattaatttttccaaatttttgacagcatgcttttttattgcctctgcatgtaactataaattttaatattattttcctatagatatacagaaaataattccattttcattagcatattgatacaaatgagctttatattatttatgatgggatgcataatacatacaactttacccagagacacatttcctatttgcactactagtactggtttgtgtcctacaaatgcaggaattccaataaataatattttgcataattctcatctaaaagcaaaaaaaaaaaaagaaaaaaaacatgtttatcatggcatatgctgcatttttgagtatgctcctgataggagagcataaaacttctatttgaataggcatctatgaaaaaccacattttacgagtctgattggaagattttttttccatagactagtttctgacttcgtacatttcaaaccttgtttctccttcactatacatattcttccagacccacatactatagaccaccttcatatcaaaatgcaaccactgaccttgtatatctgcatcaagatgttgagtgaactgggatggtgagcaaaagaatattcagaaaagccgttcctacagcataaagctagcaacaactttccacaaaagggattgggaaccataaaaattatcctactaaactcaaaagtatctacagctggacttcttccctagctacatcccaagaatgtctgtggcctgatgaatggggaaatctgacagacaggaagctggaagggaaaaagaattatctcaaatgaatatcattaaaatatcttacttttgttaactttacaaaactttcctccttctcacgttcctttgcagaatgacttttttcccatctgacttactttttagcattcctcgaggcttgattctgagacttcctatctcactctcctctctttctaaaaaatcttatctacaacactggattaaattgacctctgcatgcatgactctcaagtttatatttctaacccaggttacccccttgagcccaagatctgtgtgtatccaacagcttactcaatattttcacttagatgtctcaaaagcacctcaaatactttatgtccaagacagaactcataattaaacaccctcttgacgagttaatgggtgcagcacaccaacatggcacatgtatacatatgtaacaaacctgcacattgtgtacaggtaccctaaaacttaaagtataataataataaaattaaaaaaagaatatataacaacaacaaaaaataataataataattaaacaccctcaaccacttatttctcttccaagaggagtatatcttagtgaaggcaccatcttgccacaaagggctgaacccaaaaacctggagccatgtcccatacctgacatcactgagtccggctaattttacctgttagttatgtctcaacattgtctgcttcctttaatcatcacttcccactccctcacccccactccaatccaagctacctttctggctgttccatggcttcctattgcttacagggcctacactcaaagcccttcataatctattcccaacacacagtggacttttcttgactcatcttccagcactcttctccctctacatttcttg

SEQ ID NO: 1362 - DNA, 449506 bp, Homo sapiens
ttaaactctaagtattttattaaaaacaaagatattcaggtctcttaaagcgggcttccaaaactatggattagttgcttgtgaaatggccaacctgtctataatgtaatattcttacaatgaaacatcagtctgggaaatctacacaaagtgaatgatttcaaacaactcaattgaaaacgtatttcctttctttcgtgtaaaacaataataattaggaaggaagtcagtaggagatcctttttaggttattgtacatgaaaataaaatggcaaaagcaatttccccccaagggaatgagactcaacaaaacttagcctcctatttccaatgttatttttaaaatttcatctaaatatgtcttaatctaaactagagtaaaagaaaaattgagattcgaatacacacgcatatacacacagaaaatgaacacagatataaacggtggcacaaataatacatttttcacagcaaatacttcattacttaataaaaaaacacatttgtgtactagcgtatacaaaaatgacattggtgtagttatgttatacagataaacaatttatctttagcagtgaggagagaggtaccaaacatgcaagaacattcaaaattaaatttaaaaaagtacaaccccaaattactagctgaagacaaggtcatgacaaacagtgtcagcatgacattgggcattgctaaatctaaatgctcatcatgaaattctccagatacacctcattttatttctgccctctatatgttttattctattattcttcacttaggaagctggtgcaattttggccttcttgtagtcagacttaacctttacatttcctgatacatttgagttttgggagttctttacagcatgtagcagaataacaatttcagagactgttactctgaagcagataatgaaacttcattacagtggcattgccagagtttttagggtcccaaattaggttttgttctgttgctttaatgaatcctttttgtgttttggtggtttttttttttttcagccaaggcatttttctttatatttaaatctttccctagtatgtctaggtttctgtcccactggaaggaaattgtttcacactattactggagatgaaactggtttttgtctttctgcaatttctaagagtcagcaggaaaaatagattttaaaataattttactgcagaataaattgggcagattctgtttaattacctagtgttaagtggaaaaagttatgataaattttgatacacagaaaaagcaactggattctggcagcattaatattagataatattgttattacactaacacaaaatgttaaagatgatttctaacccaatgtatttgcaaatatacaatacctggaaatgcatagacatctcagattttagaaacaaaatgcatgtgcaattttaacttctcttaactttataaattcacttctaaattaatgactaccatttatgggatatgtgtgatatcagataatctaaaattgttttttatgaaataaaaggacatataaggtgggtgtggtggttcatatctctaaccctaacactttgggaggccaaggcaggaggattgcttgagcccaggagttcgagaccagtgtggtcagcatagtgaggcctcgtctttacaaacaatacaaaatttagctgggtgtggtggtgcacacctgtggtcccagctactcatgaggctgaggcaggaaagatcacttaagttggagaggtcaaggctgcagtggctgtgattgtgccactgccctccagcctgggtgacagagcaagaccctgtctcaaaaaaaggacatatctttttttaaattgtattgatgactacatctttcatcataattagagacaggctcaagatacatctgtagtatgattgtgcttacatctaccccatatatgtaagttttattatgtctttattaagaagatgactgctttaggtttgttgctattttatttgagaagaataaaaaagaaaattatctggaaaatttctttaaagctaaacacgtcttggtcctttggtgtggggactgaataaaagtcagtgcttttatgtaatagatggagattctaagacttggagagtcctaagattacaggttcagctggtggccaagctaggagggagttccagtctgctatgcactgaatggcaccctttgcagtatgtgaagctgtccctacccaccaggattgccactacattgtagattgtgcacataatagctacatagtgactagtaagaataaatatgtctgaaaaaaatacatctcatcgaaaaagtaggatgaagttatttcaacaattaatgccaagagacctgaggaagcaaacataatctggtcagtttgagtttttacaagaaggctcatatttcaaatgtctttctccaataggaaataaacattaataataaggactgggaaacttcctttctcttttttggaaaagcagattatatggataactgcatatgcctcacattcttgcaaaattataaattgtttagaaaagggattaaaaacgcctgaaacccgcaagagttcaacctctaacctctggggttgttggcaccaggaagctgctaccttcctgtccactgcttcatagtcatggagacacagacccatggcattagtcagcagtttctaaatcttgacccacaataggaaagatacctcaagacaggagaaatagatggaggcaattacaaacagctactagattgatggttgacattgtcagggctccactgtatggcagattgcaatggtgttgaactccccttgctaccagtggatgttgctattggcaaccatgcagtgaagccaataaaacggcaagaaaatgagaggaaaactcaaccttagtggaagcttgtagggtttatgctataaattatgttccccttagcaatatgtagcatcaatgttcaggatagctacagtgctcacggcagcctgcagtctctgtcagaccctgggtccagttttgtcataaagcacatgctttaaaatgttgctgtagatggactggcatccatttgtctgggctatttatttatttattgttggggaggataacagatgtgggctcatctctgcctcacacagactgattttcaattcccgttcgtgatataaacatgatgtggcacattacccagaaacacctgcagtgcttcggagctgcagacacgtcacgatctcgcagaccagactctgtccctgactccacccaccctttgttccccacctgaaggaggagagacagccctgcagaagctattttcctttatagcagagtgatacagaaaactggcttaataaaatccataaatctgaacaacctcctcttacctgctctgcagaggcagtttcttcctgcattcatttccccctctactttctccagtcttccctgcagagacagctgtaaagggtagctaggaacattattttttagggctctcactccttccttctcccctttctcaaacccctccctgctcaagtgtctctcttttctgagcaattgatgacagggttctacaccttcattttttttggttggaagtgccatttttctttgtttggattgactttcaccttttttttttttttttcatttcccttaaccacctgtctcggtccctgtctttcctttactggtgttcttacgtttctttttcttcttgcttttattcccctcttagtctggtttatactttttttttttttttttttttttttttttttttttgagacggagtctcgctggtcgcccaggctggagggcagtgacgtgatctcgactcactgcaagctccgcctcgcgggttcccgccattctcttgcctcagcctccccagtagctgggactacagacgcctgccaccgcgcctggctaatttgttttgtgttttttagtagagacagggtttcaccgtgttagccaggacggtctcgatctcctgacctcgtgatccgcccgcctcggccttccaaattgctgggattacaggcgtgagccaccgcgcccggtctatacatttcttttactttgtttcttgccataaagagtctttttctctacaattacctgctctcccctcaattccattttggtatcttaattttacccattccttcttcagacatttcctgaattgtctactgtgtgccaggaaaacaatgtcgcatgtagaacatggcccctatttctttaatatctgtaaagttaatgattgataatgattaataacaataacaagggccgggtacggtggctcacgcctgtaatcccagcactttcggaggcagaggtgggtggctcacctgaggtcaggagtttgagatcagcctggcaaacatggtgaaaccctgtgtctactaaaagtacaaaaattagccaggcgtggtggcaggcacctgtaatcccagcttctcaggaggttgaggctggagaattgcttgaacccaggaagcagaggttgcagtaagccgagatcacgccattgcactccagcctgggcaacaagagtgaaaactcagtctcaaaaaacaaacaaacaaagaaacaaaaacaataacaagaaaaatggtttgtaaatttcagatttttttaagagctagaatggctctcaggtttaatctaggccagggattttcaaactcttcagagtccctgtggacccccatgtacgtaatcaaagagatgaaggtttgtaggtgctctggatgtccaaaccctgcttataattcacataggaattcagctttttgacgttttatatgttggggattcattgaaagatttatttgaacaaagagttgtaaggttaaaacatgttcgagaatcgtttcctagtgtaatctaatttgacaaataaggaaacaagcttgtagaagttaagtgacttgttcaagtcaatccagtcaataatgccaaagctaaggatagaaatctatcttctagcccaatgttctttggataacacataccatgtccacaatttctcaatatagggagcaaagcagctttctagtcattacatctacttaatacagtttattcttacctattgtaaacctggcttcctatagaatatgcgttctttgcccagactgttatttcttaacatttgaagcattgtttcttacacttaaggaaaaatccaaaattagggacccctatagtttgctttaagttggttactggtagtaatcttaaattttataccagaactcctcactaggagaactcaaggtagtcaatgcttagtctccatggctctgctctgtcctgtgaactatagtttctagatgtcacttgtggtaaatccagctacagatttccttccacccttactttaatcaaaatctatcaatccattccttctgggagaaaactttgtctgtaatgaaggttgaattttaaaactctggaaaagggtaccatagtcccagtctagaattacccatcaaacacatttgctatagtcctactatgtattcatttttagggggagaactgggattgatcagtatttataaggatagtatagtttaccttttaggtaggcaattctaaaggatccatcaataagaagctctaggattaaaaataaaatacctctatggaatacaaattaggattcttgggacagtctggcacaaaaaggcattcagggacaggaagcaaagacaggcagtgtttggcttgtaacaaacagaaaagccctatacaaaacgaagcagcgctaatgacgcttttactgttcagtgttccctcagctcagagtaagtaggccgactgtccacaggtccttggatccaaaacagtcccctacccagagccttcatttcagcccatgcgtgttcattagggaaaagtgagggtcctggggtgtgctccctgccccacctctttctttgtccttcccgttgctctctctgctgctgaccatgcttcaaggtgaaagcccaggcatgcttcccagtgcatccttgagatgttaggtctttctgagctaaaagaacaaaaggatgacattgctggactgaaaatggcccttcaggctgtagtcattttgcagctgcagctgacctggaggtttagttcctgtcttccttggctaccataacactggcaggggaggatgaggcagttgaggccagcagtcgtttttggtgtagctcttcccacttacttctgtttgtagctactgaatctagcatcggcttcagtttcacgttgaccttcaccagtgcctaaaacaaaacaaaacaaaacacaggtggaggagagaggaaacagagtaactgacatgattttccacctttcacttatgaggagaatggaaactggctataggaaatgaaagtgatgattattttggtaaacaagagctatttacaagaagtaaatatgcatttaacaccaatatgttgtattaatagagcctacttagagaatgaaaaaataagacatcaccagcatagctgtgtacaactctaggggacaccagccatgtagactcaaatcctgttttacaactacatcaagcaagacaggaaacaaaatatccagctcacatatgcctacttacgtgtgcatctttgcctgccacagagggctccagatctcaattgactatgcacttaaatttttacaaaataatcctacaattgctttaccatagatgactctgggtggacttacttgaataggaaaggtcaggtaaaatcctgaaatgaggaggtgctcatttttaaagctaaagatctgggagttgtgctaaatatacaaagcatggaaacatgcatggaaatagacatggcagaaagggaagcagtgtggaagagagtgacagagggatgaaagggggatgagggaagaggaaatgtagggtgtggccaggggcagatggacgaccaggctgatgaaagtcaggcttcagcatcctcacttgtgccagacccttctaagtatattcttttgtgcttaattttgtgtgtgtgtgtttttaagagtcctcctgttcccaaatggtataagcttgtctcaccgctcctgggttgcccctggtagtggaatgagagccctaaaagtaagatggcttactttaatttaatgcaaatgagtccatcttcagctttcatatcagagggcttctccaagatagggggtaacatgggggcagggccgaggattttgtttctgaactgggactagaacaaattcaaggagctcagattaaagagcaataggtaaatattttacaggtcagaggagcatggaatttactctgcccaacaggaaaattccactattctctactttactgattattttctttcttttaaatgcatgaatatctacattttccttattttaatttttttttacttttcataatgaaaggcttctaacatattcaaccagtaaaatatgatcagcaaaaatctctattatgtatctatatgcctgtaaagatgaataataagtaaagccacccatgtaaaacatatgtaacaaaggatctaggagccttttaattttctggacagctcaatgaaaagggaaataagattttgatgacatttaacttttagaaacatggtctttgtccttttaaaccatgaggttttggggggttgttttaaaaataataccttttcttcccttcacagttattttatatattttaagtaacatgttagtgttagaaaatatagaaacaataggtttaaaaagtaggaaatggagataatttataatctcataactcaagagatagacactactaacttttgggttttgccttgaatggaatctttctattatgtttctaactggtgaaatgatcagaacatctaaaatatggctcatgcctgtaatcccagcactttaggaggctgaggtgagtggatcatttgaggtcaggagtttgagaccagcctggccaacatggtgaaacctcatctctactaaaaatgcaaaaaaaaaaaaaaaaaaacaaaaaaaaaaacaacctaggcgtggtggcacatgcctcacatgcctgtaatcctagctacttgggaggctgaggcaggagaatcgcttgaacccaggaggcagaagttgcagtgggctgagatcacaccactgcactccagcctgggcaacagagtgagactctatctcaaaaaaaaaaaaaaaaaaaaaaaaaaaaaaaaatatatatatatatatatatatatatatatatatacacatgtatatatatatatatacatgtatatatatatacacacacatatatatgtgtgtatatatatacatatatgtgtgtgtatatatatacatatatatgtgtgtgtatatatatacacatatatatatggtattttataatctcagtttaaaaatggacagaatcaatgagaatgtatggatttttaagcattcatacttcttgggcctgttttccatctccagggtctgaaagaagtataaaaagctggcatcccacgtggatgagggggagcttctgttaacacctaacacctcctatgtgttaaacacattgccagctgctctgcatacttcatctcagctattcctcacaatgactgtgcatcttacagatgataaaacatgtcccccacatgttaggatcataaatgatccttagcctttccatcacaggaggaaggtaagaatccatataggaagttagggcttccttttgtaatctttccatttgttttggaagctatggagaaaaccattgtttttctcaagtaaaagtcagggataggacactagcctgccatatagaatgaagatatagagaaatctgctgaggatgtaacataaaagggaagctcttaaagagtcaagaagaaaaaccaaggaataataagatacacgtcttgaaattgtatggcttcaacctttgtcaatgcacaattccaaccagctagtaattgtatcattcctgtttttagagactgtgatgatgatgaggagactgaagacatgaacttctgaggacacattgaatgtgattgctgttgtcatcaatttggggtaagggttgacaccaggacctttcttctgacttattcatacccatctctcctttcttctctcctcttatccattaattctatcacccatcatcttgcatatgtatacaactctcatgaattctgacattgttctttgaatgtaatcttatgtcacttgaggcctccccaaccctttagacttgagattagacctcaaatctatttcatgctctgggggacctttcagactcctgccagtgatttccaagtcttacttccttgtactctctgacttcttcttgagtctatttggccctcttgactccattctgcatcattcctaatgcagtatttcactttatttccccttttcacaggaaatcccatcaccctcaacattttggatgcctactaactgtaccgaactttagaggttgtcataggggaagtgacttacccactgacttactcttacatactccttttcatctcaaagggcacagtcttttaccccatggagagtaatccagttttctccccagccctagctcactgcttttatacagatctggactgccagccagccagttttttcccaggctccccagaattctgacaaattaaagtttccctttcttgttgcactaaggcctataaggtagtttttattttccttataaagaaataaaagaaagaacacagaagttgtgagattattagcctatggaaaggtgatttcccactttatgctttgggttagttagctattttttgttctgtggacagggttatatccctggtcccgtgtaaacaccttgcaggtgcatcccattcatcacaagggggacaaaaggtgaacatatcattaaaccactatgatttcagcacaccttgtgaaaagccttctccaagcatgactgtggttagggagtagtcaatagtaagtcctccaacaggaagaatagctctttttctgttagaatgccagagtgtatgactccaagcacaactgcaaaccacctgttagtaaacctaatttatctgctcaaataatcctctgctccagggagttatatgaatatgagtaaaatgtaactagatgtaagttaacggagtgggggtgggggttgaaagcccgatgtccttaagacagagtatgttctgtctctctcttaacagtgatatttatcacactaaacagaaacatctaattttaaatcaaatttactagttatttcatatgataataaaacaaagcaacattgtaactccagcagcgatcaaaatcccctttatttccatgagaaaaatacaggtgcttgttttccactcaatgcatagtgtttttatttagacaatagtgtgagggagccacaactgccatggttttatttagtatagcttggcaccagctcctctttactctgatcaagccttttaattaaactgactactataattcctatggaaattagtgtttatgttattttcctgctacaaaagcatttctccagaacttattttttttaatcccaggagcataaattagaatttttttctgcttgatatgtaattaaaaactcatttgattacaatatttctggctctgttttacttattaaattcctgtaatcagttttcttttatgaagctgctgggaaatgatcttaaaagcaacacatttttttcttccctggcaggtacccaagcatttactaaattacattcatagcacctgcccatgattcgaatcattccaccaatttattccttaagccatttaagtttatttggcatagccccaaacagctttcttccctttatccttgctctttgttctccttcttgcttcctttgtatggaataaagaaattggggagggaggaggaatacatatttctcagaattcctttctctttgttttatattctcctgaaacacagaattgccatactagaatatcgttttcctgtggccaggtgctggttctaggcaaaggtaacaaaactcctatcttgaaaacttactttttctctctctcttttttttttttttgtgagaaggagtctcgctctgacgcccaggctggagtgcagtggggcgatctcggctcactccaagctccgcctccctggttcaagcgattctcttgctcagcttcccgagcagctcggactacaggcgcccgccaccacgcctggctaatttttttgtatttttagtagggacggggtttcaccgtgttagccagggtggtctccgtctcctgacctcgtgatccccccgcctccgcctcccaaagtgctgggattacaggcgtgagccaccgcgcccggccgacttattcttacactcttaatttgttacagaaatgcagttagctgagagaatatggaactattaaaatactagtaaagcaagggtttatccacgaacctaaattccaaggcttatggtgattatgtgtagtgagtcatcagcaagagaattgcttctagtatttaaaagtttcttatcaagtgatacgggatgggttctgtgagaatgctattgtctagtttgacttgctcctcagtgaaagagaaggggggaaacttagcacccatctgatcactctccatatacacacggaggaactctaaaggttatgtatgcggctgcatcagcctcaagacacctgactctcctctgtggcatccctgctgcgtgaccacacagctaccgttgaaaccctttcagaggcagtgcgtgcacaacctcccaggggagtccatttagtttttgattgttctgtttttaaaatgttgttcctttatgttggactgaaatctatacccctgtaacttctacctaatggttctaatccttagggtgctctttctttaaaccagaattttctttagtagtgtaggactgataactcaggttttgtttcaagtgtaggttagagttgatgctgacctaaaaaccctatttgggatgcagtgcttctcccttggggcaacctttttgacatcactggggccccatgttccttccagttccctcctggcccatcgcagacaggacctcggatacttgccccactatgggacacagcctgggcatctggtcatctaggtggccaagggaccccacttatttcctgatttcattcacactccactgttgagttctcttgtgaccagcatatacagtttattccgtattttatttatgttttgaataaggaacacattcacatagttccatggatacaaaacggtacaaaggtgcaatataaaatctccgttctactatttcccagacactcagtttcctcccctagaggcaacagatgttttcagtgtcttgagtagataatcaagaaaaattttctgaatgtgtaagaacataaatatatttgcccctttttacaaatggtagtacaccatacagagggatctgcactttgccttttattcttaatatatcttgggaaaaactcatatcactacaaaattagatttcctcattttttatggctatctagtattccactgctgtcaaaatttgtttaaccagttcctttttgatggaacccaaacattgtttatatttggccattacaaataatgctgtaatggatatccctgtacatagcctctccataggtgtgaagtttatcagagagtcaaattctagaatgggtattgctgggtgaaagggaatgtgtatttgcgttttggtagatattactgaatcaacaaatataattttacttaagatatatagcaggatttttataatagccatactaacaaaagagagggaacagaaaccatagctactgtttagattaaggccttggaaagatagtgtgagggtgggtagagctaagaaggatacacaaatctagaatttgatccctctcttctctgtatactccagatgctaatttctacacagtacacttggtatcactgaagcatcataatcatgttgtccagaaggttttgattttactccctctctgaaagaaactccccaaatggtacttgaatctactgaaatctcttacagcatatcaatcatttttgaccagttacaggtgttttcagtgtgtttcatggactcttactgtcattagcaaacttttactgaatgcttagttggagtcagactgtaataagtgcttaacactgtcatataattttctcaggaactttatgaaatggttactattattatcctctttatatatatataattaagaaaaaccaaggcctggatgaagaactcactcgtggtcattcacttggtaagtgaagaactgaaactgcagggtttctctacctcagtactattgatgttttgggttagataattctttatggtgggggctgtcttttgcattatagaatgctctagaagccagtagcatccctccccaaagttgtgaccaccaaaaatgtctccagatattgccagatgtcctctggggagcagcatcttcccagttaagaaccactgctctgctgcctctaagcattatctcgtctccatcaggtcttcaatgaactcagcttcccctcaaatagaaggaggaataaaagtaactagctacagtctgaaccccagcagcatctctggtagcagagaaggaaagacttcttcttgggccaaatacatactcttcctcacctcctttttctgaagacatttaggaaggagaaataagaggagtttctatatattgaatgttcactgtgctgggctagggccggggcctaaaggccattatctcataaaatctccacagcagtcccacgaagtaggtacttttatcatcttcactttatagataaggaaattgaggttcacttaggttaagtgccttgtccatggtcatataatgagagatggagccaggatgtttacctaagtctttctgactctaatgcattgtgtaaaaaattccttccctagagaactaatccttcgccactcagctcacattctgtcttctctgtgaagtcttctctggtcttctggtatggaaccagaactctccttccttaggcatgcctgtagcacactctccatctctccaattctatctatcgcactgaaaaggtatttgcatttttttgcagttcttcaaagatcctgttctggattgtgtttttgtctctttgtacttgtcttttttcccccttctgggtccttttaagccaagttttaaaagtgctggttttcagcaatttgattctcatgtgcattgctgtagtgtccttcatgtgtcttctgcttggcttcattgagaatcttggttctgtacatttatttccaccatcctgtcttcagctatgttttacatctgtcttttccctctgggactctaatcatacatatttagccattggcattgtctcacagctcaaatgatgctctgctcatttctcttccatcttttctatatcattttggatagtttctgttgcgtcactgagtttttcttttgcagggcttaatctgctatggatctcatctactatacatatatatatatacatatatacatatatacacatacatatatacatatatacatatatacacatacatatatacgtatatatatacacgtgtatatatatatatatatattttttttttttttttttttgagatggagtctcgctctgtcacccaggctggagtgcagtggcgcgatctccgctcactgcaagctccgcctcccaggttcacgccattctcctgcctcagcctcctgagtagctggaactacaggtgcccgccaccgtgcccggctaattttttgtgtttttagtagagacagggtttcaccgtgttagccaggatggtctcgatctcctgaccttgtgatccacctgcctcgccctcccaaagtgctgggattataggcgtgagccaccgcgcccagcctactatattttttttacctcaaaaattagcgttttcttttctagaagtttgatttgggtctttttaatatcttccatgaccccttaatcatgctcaatctttcctctaccctctgaaatatctaagtataataactatcttaatgtctttttctaccaagtctatgatctatataatctctgaatttgtattgattgatttttctaattattatgggtcagatgtttttgcttctttgcatgcttgataattcttgatgaatatcagacattgtaaagtttatattgttgggtgatggattttttttcctttgctttaagccttcttcagttttgttctggaatatagtcaggttatttggaaataattcaatccctttgaggcttgcttttcagctgcgcaagctgggtccaaagcagcctttttttttgtggagggctaatttgctcccactactgatgcaatacccttctgagaactgcatccaatgcctcatgtatttcaaggcttttcttgggtactctagctggcaggagcatggactattttccccaggctgtgtgacctctgtggatcactttacttgctcctttttgcttcagcctcagtagtttcctcacatggatatgatgaacatcactaacctgaagactcaaagtggccctctgcagatctctgggctttttctgtgcagtcctctcttctctcttactcttccctgggaactgtaacctctttggcctccctagactcctagctctgcctccttaactcagcaagatcactgggctctgcctggattccccctgcctgtgccgtggcctagaaattctatccaggccacaagctggaacagttgtaggactcacttcattcattccccttactcaggaaccactgtattatgttgtctgttgcccattgtctgaaaagtgttgtttcatatatttttcaggttttggggttttgttgttgttgttgttttgttttgttttggcccgttactcaaccatggctagtagtagaggtcccttatcactggttttaaaaactctgtcttgcttagtatcccacaagctcagagagacagtggaaacaaggccttttatctttgtatcttcaacatctggcacagtgaccccaggaagcagcagcctctcctccattcttccccatagaacagtggcaggaagaagggttaaggctaggacagctgccagtggctgagagtggggttaggatgttctgacctgctacaaaatcctgctgtaaaaacacatctagaatgagccacttgggaaatggatatattttctcttattaccattattcctgggcctttgtttttatcagtttgccaacctgctaggagccagatcctggcctttgtgtttctctgccatcgtggtccacatctgttatcatctggctcagtttgtgcttattagttgaccacagttacctcttggaacccagctgctggatagatagggcagatgtgggacaagggaggagcagagagaagtcatgctcttagaaaatgtgagtactcctatactctgttgttggaaaggggcatagaggaaccccatcaaattaaaaccagattagtgtttgaacctgaaaatgtccaacggtgtcattaatatattttttaaaactttgaggaaattgtctgactattcatttattaagaaaaaaagacatttattaagaaaaaaaaggacaaagagagaagatggttttggccccctattgttgaaatctatttccagagttgctagtgacatcacttagtattttttgccttctctcacccccaccttacccaagagaatcagaaactaagtgacacaatataccatagaggagaaagaacttagagtattttttaatgttgatttttaaaactataaagttagacttggaacttatcttacgtatctgtttgaggcagcgtattcctgttatgaggtcatgatcactttactaccatgattattccctttctggaggaaaatatcaaaaaaatcattggaagttggtattttgaaatggaaaaccactgatgatatgaccaactgttatcatctctgctcagattcttcagcaggagggacaagagaacatgcaaatggtggcaggccctgaaattctcatgaattcgtgtgcctgtccagcagttacagatgcaaagagcatcttcaagaaacagcttcctgttcaaggtgtatgacttcagagacaggtagccaattgtgggagcagagcctaagttataaattagtgaattgttgaactgctaatccctcttaggtccaaaggttaagattattcatgatttaatctgagatactcccagattttacatgccacacctcagtgctgcagttggctggaaatcactttggctttccagccttctacttttttatgggttgtagaggccagaaactcagtggacggactgtttacaactgaattcctcaccttccctcaagccttcctcttacgtttactctgtcagggaactgggcattatcatctatctagctgtcctacccagaaatccatgggtcatccatgacatcttcctcttccccttacatccaatctgtcacaaaagtcctgtcaatcccacttccaaagtttctttgaacatgattctgttgccatttccacaaccctggtttaggctaccatcatccccctgactgttttaaatctgctgcagcctcctaaccagtctcccagccttcctctgccactgtccaatcggtactccatatggaagccaccatggagcagtcaatcagaaacagaaacctgagcttgccattcacttctctgagactttcagtggctcctatttgatatgaatatgctcatcatcgcaagtccaaatccctcaatgtggcctataagaccctatcagaaaagagtattgtggtagtaagagagaatgaaatccagaaacaaaacaaaacagaaacaaaaccataaagactgatggaaaacttgggttatggtacaaaaacagaactttgaaatgccaaaataatcccactaagttttctagaaatcctgaagtacacatctttatatgcattttcacgttttactgagtcaaaaaaaaaaaaaaagctagactccacatggtgcgtttggcaggagagagctaaaatgttagttactatatgtgagagcagatggagctggctgtggagtccagatgggaggcagcaaacagactcctcctaaacctcactccttccctccccagttcaatggcttttgaaactcaaggttgtgtaaaaattaatttgtattaaattgcttaagataatgtattaactaccatagaaggcttccagcagtttttaaaacttgctttgaaaaacaaataatcaacctataatggtgaacacagaaggaagcccagacttccttggctgtttttaagcattcacattaaagataccagccttaaaaacatatcttttttgtgttatttgcagaagttggaaaattaataataattatttatgtaggttacacatgtaactgtgtaagacactgtggtatatttgtgcttcatatagtttatctcattaaattctcaaaactaccaggtatgtgcattatcaacccgttttagagaggagaaaatcaggctcagaaaggctacataatttgcctggggccacagagccagggtttggtcccaggtctctgactccagagcccaagttagtaaccacctaccatatgtgtaatgctggcatgtgagtttgaataggtcagcctgctggttagaattatgaatgaaaagtgcatttctagataggaattgcctgtttatcttcaggaatatctcattagctaataaatgttttccttaacagactcaagtgctgctgtggtctcagacatgttcatatgacataggtctatggaggtcaagattggtcagaaggcaagtaagaggcagagtcaccctggaaaagagtgaacagggttcaaggttacctacatacaaggctgaagtttggcaacacgaccaagggtgaaataataagaaaagacttaggcagaggcaaggacttaaatagctgattcagtgggttcataacagctgagttcttctcagactagaaaacaatggagtttaaagggctctagctttataattcctgccctgtttaaggacatggtcatttattctgccagaactgtggtatccctagcagagtttgttagttgcctacccaatacacgttttaatttaccttgagcttaggagtggccagggagatgtaagcagaattcataaaggctcagagaaaactctttaaatggggcttattctgctgggaggtgcattctcttgctcttgtccctatctgtttcttgctgttggaatattgatatggtttggctgtctccccaaccaaatcacatcttggattgtaactcccacaattgtaacctccgcctaggttttagacgtgacatgtcatgggaggaacccagtgggaggcaattaaattatgggggcaggtctttcccatgctattctcgtgatagtgaataagtctcacgagatctgatagttttcaaaatgggagtttccctgtacaagctctctctctttgcctgctgccatccatgtaagatgtgacttcctcctccttgtcttccaccatgactgtgaggcctccccagccgcatggaactgtaagtcccttaaacctctctttcttttgtaaatcacccagtcttgggtatgtctttatcagcagtgtgaaaacggaccaatacagtaaattggtaccagtagagtggggcattgctgaaaagacacccgaatatgtggaagcaactttggaactgggtaacaggcagattttggaacaatttggagggctcagaagaagataggaaaatgtgggaaagtttggaactccctaaaggcttgttgagtggctctgaccaaaatgctgataatgatatggacaatgaaatccaggctgaggtggtctcagatggagatgaggaacttgttgggaagtggagcaatggtgactcttgttatgttttagcaaagagactggcagcattttgtccctgccctagagatttgtggaactttgaacttgagagagatgattaagggtacctggcggaagaaatttctaagcagcaaagcattctagaggtgacttggctgctgttaaagggcatatgaaacacagcataaaagtttggaaaatttgtaggctgacaatgcaatagaaaagaaaatatcattttctgaggagaaattcaagccagctgcagaaacttgcataagtaatgaggagctgaaagttaatccccaagacaatggggaaaatgtctccaggccatgtcagtggtcttcaaagcagcccctcccatcacaggcccagagtcctaggaagaaaaaatggcttcgtgggccaagcccagtgtccccctgctgtgtgcagtctaggacttggtgccctgcatcccagccactctagccatggctaaaaggggccaaggtacagcttggacagtggcttcagagggtgcaagccccaaaccttggcagctttcatgtggtattgagcttgcaagtccacagaagtcaagaattgaggtttgggaatctctgcctaggttttagaggatgtacggaaatgcctgtatatccagaaggaagtcttctgcaggggtggggccctcatggagaacctctgctagggcagtgtgggagggaatgtgggggggagcccccacacagagtccccacctgggcattgcctagtggagctgtgagaagatggccaccatcctccagaccccagaatggtagatccactgacagcttgcattgtgcacccggaaaagctgcagattctcaatgccagcccatgaaaatagctgggagggaggctgtaccctacaaagccacaggggcagagcttcccaagaccacaggaacctacctcttgcattagcataacctggatgctaaaactcttgttttaacacggagtcaaaggagataatttcggaacttgaagatttgactgccccactggatttcagacttgcatggggcctttagcccctttgttttggccaatttctcccatttggaatgggtgtatttatcaaatgcctatactcccattttatctaggaagtaactaacttgcttttgattttactggctcataggcagaagggatttgccttatctcagatgagactttggactgtgaacttttgagttaatgctgaaatgagctaaggctttgggggaccgttgggaaaacatgattggttttgaaatgtggggacatgagatttgggtggggccagtggtggaatgatacagtttgggtgtgtccccaccaaaatctcatcttgaattgtaactcccacaactcccacatgtcgtaggaggaacccagtgggaggtgattgaattatgtgggcaggtctttcccatgctgttctcataatattgaataagtcttagaaagtctgacagttttaaaaatgtgagtttccctgcacaagctctccctctttgcctgctgccatccatgtaaaatgtgatgctccaccttgccttccaccatgattgtgaggcttccccagcaacgtggaactgtaagtccattaaacctttctttcttttgtaaatcaaccagtcttgggtatgtctttattagcagtgtgaaaacggactaatacaaatatgcacatgatagttggaaccagagtggccatcttgtgactatgaggcaaacttgactacggcagccatgtgctaaggaaagataaaggagaactaggtttctttatctttttctttctttttttgtttttacatagagtctcactctgtcacccaggctggagtgcagtggcacaaacttggctcactgcaacctccacctcctgggttcaagtgattctcttgcctcagcctctctagtagctggaatttcaggtgtgtgtcaccaggcctggttagtttttgtatatatataatctttttagtagagacggggtttcaccacgttggccaggctggccatgaactcctgacctgaagtgatccaccactttggcttcccaaagtgctgggattacaggcatgagcaaccatgcctggccaagaactaggtttctgatggctatggaactgccatataatagcagtatagcattggcttttctagattatttttattttttactaggagctaaatataattcctaaatgagaaaattgatttcatattgtaggtctctattttctgactatctgtgcaggtggcacagtgttttgggcatcttgatactcaaagataatgcttagtatgaaggcatattagctcattagaatccaacacaagaataattcagatttgcagttggaatattaagggcatagtctacccaagttataacaaaagatgatgtttgtagcatcaatgtctaatatcctgtaagctaattatactattagtaataagttaggaagagaccattttttccccaagatttgaagcagattagtcgtgcatgtaaaagtgaaaatgcaacaatgcattacagcagttttatctccttctttcttttctctttccagttccttcctgacctctcaagttacttgttttgcttatttatatgcacaagagattcttttgtggaaaataatattcacaaatgacattaacattctgaattaatgaggcaggaatgttagtctttttggattaactgcattgttatttccataatatagggcaagagtctgaaactaaaatgtttacagggccaggccactaaagttaatgactgaaataggctgcatgatagagttgggagtggtggggactatggcaaactggacattttacaattttaaaaactgtattcaactgaatgaaacaagtctgtgagctgaatctattctgtgggccacctgtttgcttgctgtgatagaaagtaaagcacatcttgctaacatgaattaactactgagtattcatgtgccctatgttccaggagccatacttggagttcttcatatgtgacctgattacaactcagaatggtgctgtgagatagctattattggctctgttttggcagatatggaacctggaattggaaaaactaagttaaagagccaaagtttacatggttaagtacacagcagagctgaaatgtcagtccaggcttggctgagtaccaggctcatggtgtctttacatcaggggtctcaactggcacactagtaacaatgggtatctcacaccttactgcagtgttgaggacaatggtgcaactttttttgttctatgtctctgatgctggttcagaacagattcacaggaaagtggaggtcttgctgagtaaagaagaaacaccacttcccaaacgttagatgtagtctgtgcatcttttatctttgactcatctactctaccctgccctgggaaaataaaacaagagttctaagttgtaaaggacaggcaagcctaaagacagctcatgtaaatgggagcaagaacagtttcttgtgttataatgagcccctccagaatgctgtccttggttatcctgttagttggattttcagagcagactggtagctaatcaatcatgttcattgtgtaggcaacttctgacttggaaggaatggctgctgacccagaagccacagcctttgatgaatggggcttcttacaagaggtggttggaacatgtaactaaaaagcagtcacgtggtaataatccattttccatatactggaatgttttctgctaataccatcacctgaaatttcatagaaatatataaaactattattttttcaaagttcaatgtgtaaaaaggatcacttaaaacttttagtttgttgagctgcaaacattcattcactgtacattttttgtatatttcccacatgcctcaagttctaggatttcctaaaataatggatagggtgtctgtgtgggaatgggtttacaaatacagaattgccaatatctgtccttggtgtgaatggtgctcggtgtaagtcactataggacctcaaagaatgtattctagaatattctattagcattggttctaaatttttagcttatatttgagggtgccaaaagagtcccaaaagagagtcctaactatacacactactgaactgcttagtgtgcaccatgcaaatatgatgactactgagcatttcttgcaagagtttaaaggtggcttcctgcctagcaccagacatgcttagttctgagacggggaggaaccatcaagtccatgaatcccaatgtcccggatctacagaggaccagacccaaagcatcgaggagaaatgctttgtctttaggtaaagatccttgggggataaaaatcctttattatgttggtggtctctctccctatggcaagggaaacttctttttcttaattttacagcctgataaagacagtgggccaacctcagtagctcatgcctgatctttggggggctgaggtgggaggatcgcttgagaccaggagttcgagaccagcctggacaacacattgaaaccctgtctctacagaaaaatttaaaaattagcttggtgtggtggtgtgcacctgcaatcctagctactcaggaggctgaggcaggaggatttattgaactcaggagttcaaggtcacagtgagctatgatagcaccactgtactctagcctgggtgacagagtgagaccctgtctccaaaaaagagtgacaattttgagataataaaaagatagaaagggaatatgttacatataccactaggtatatgtctgaggaggatattgtatcattagctggccttctctttgtcctagaaaggggccagtctgtctactggaagacccggtagaaggtatgttattgtggctcttctttaactacattgctaactccccaaaagccaaagatatgggaaaagtttgtttgtgtaggcacagagggaccaatattttcagtagttttatttcatttttagagtgcagtttaagagggaatataataactttataaattaaacttcctaatgggcaacattttctatcttttaaatgttggaaagtttcatattaatttaactctcgaacattcaccatgtaaaattaaataagcagccagtaaaaagacaaaccagatttccttttgaactaaattttaaagcttatgtgaaaaaataagaatacctagaaaatattgaaaaagaataataaggaaggtgaaactaggattatgagacattaaaatatattataaagtgatattaattaaaatagtataactaggcagatagatcagtagaactgatagaaagactaaaaatagaaacaaagttaagggaatcagtatatgataacagtgaccattcaaataataaggaaagagttcagtcaaaaactgatgtgaagaaaactaggtaagataaataacaaacttggaaacatatttgtcacctttgcaaataataagggtttatttctttaatagatagtgagctcctatggatcagtaagaaaatagccctagttcaatagaaaaataggcaaaaatataaagcatttacagaagaaatacaaatggcttctaagtaaataaatctatactaaaaatatgatcatacttatttataatatggaaaatgctaattgaaactataatgagatagattttatagctatcgtattagcaaaattgaaatttggtaatacattgtgttggtaagggcatagagaaataggcatctcagacattactgataggaatgtaaattggttcaaactccacagagagaaatttggtgatatctatcacgatctcaaatgcttatatgccaaatgcccagttatcttatttcttggtatttctcctaaaaataaagtatgaaaattgtgtatttacaagaatatttattgcacattgtttacaacagcaaacaattagacacaacatcaatgtccataaataaataattaattgttgtttaaataatttatttttcatctttaaaatctaatactatgcagccatcaaaaagaatgagacatcttctgcatggagactgaaaaagaataatctaaaaaataaattaagtgtaaagaagcaagatatggagcaggatatacactatgctcatatatgttcatagatacatatgcacttacacatagatacatatgtgtgagcatagtatatatagatgcatgcatatgcactatatttacatagaaaacaatgtagaagcattatgtattaaaaacagtgtaaaaacacactgtatataaactatctttagaagcatacgcaggaattggttaacagtggttgccccagtgaaaggaactgggtgacttgcaaaaaggagtatgagggaggatctcttttctctgataatttgtgccttttgtactttgtgaattgtgttcactgagggtgtctaaactatttagcaataaaaaatttaaaagtctatcatgaacagataaaggaaatagcaatctttggtcatgtgttagaaatattaaatcacctgattggttaattgttaaaaaaggcttacaagtacaggggcacaaagtagaaatgcttatttccacaaagatcaaaaaaatttagtgctttaccaccataattcaaaaataattttaataccttaatgtatgttgcaataacatcgtatataaataaacacctccctcctcccactcccccatccatatcacaaataaaggctgactacctcattgctcctcagcatttcctctgaaaagcgatcgatgtctcctgcctggccattaaatagattttgaaaaactcttcaatccctatcagtctcatatccttatttagttcctcaaatttgccctcagctgggaattctgcaggcaactgtgattctgttgtgttcaccactcatttgaagggtcccatccatcatcatttctagtccttttctgatgcaatgtagcttgttatttgtctttcttataaactgaatggctgttaaattatccatttatcttccttcagattttctgttcagtttctcaggccctatcagggctgtcttttctaccttgtttgctgacttttcattccattgcccctgttcttggaggcatcttggttcaccatgctgcccttcaaaacaaactctctggttcagtctgctttttgcttgtttgaaagcaagcagaacttgctacttcagtagatttccttttaaaatttttttccttagaatagttttgaaaactttgaggtaatatatttcaaattttatacatagatagtaggatatattggaacaaaccttaaacaaaaagtccaaagtctagggttctaaacccagctctgccattatcaagtcaggtcacttaatagtgacctttcagggttttgctttcccctcctacagatggtctgcaggtatgcacctagttaattattctagtataaaaatagcatgtttcttctgttaaaggtgacccaataaatgatctgaggtttgtataatactaacacctgcacatacattatctcaggcagcactaggtcatactggttaggagtcacagatttgaaagcagaaagaatctatgccctgtcacttactatatattcttaggtaagttacagaagctctatagcttcagttttcacatctgaaataaaaagatcctcatagcatctaacttggtattgtgaagagaattaaatcagatcatgcttggaaagttagtcttgagcacatactaagtgctcaaaagtgttgttatggactcactacatctttgtgagacaggaagcttggctattattatccaaatttacagcagagatactgaggttgagagatgatattaatgataacaatagtgactcacatgctggagggctttaactataataggtgtactcttcccaaagcttttccacatacttcacctccctttgttcagactcttggaaaggttgatattgcctatcatcaattccatttgctccaagaagaaagtcactttgtgaggcccaaaacctttaaaaagtgcagagtgaagctgctttcagccaaacctacgagccagtggtgatcaccataaaaagaaagctgaggatggcgagtcctcagtttatgagtgtagagggcaggtttgaaagaggacagttagaaaaacactcagcccttactgcctcctcttaggccctcttcttaggtctttttttttctccctcctgctgtctctctttctgtatgtctctgtttctctatttctcttttcttctttagatttttcagctgttcagatcacctgtaacactaaaacctaaattcgatgatgatatattgaatcaaagacttggagaataatttgtccttttttgttattttatggttctgtagctcatccctctgcttgtaggagttattggttcagatgctgaaactcccctaattcactggggcgattgtgagcagcaagtataccctccctagtttctcatccgtgaaataaaggcaggaatgttaacaccgccacagggcaattcaagagtgataggttatttcagggcatcctgaaagcataagatgctgaggaaatgcaagcgcttactagtaacaatgtgataacccgatctttcccgttcctgtcactctcttgcgcttgctttgttgctgaggcagccctgtggggtctcccagtggctgataacaacacacacacactgctgctgcagcttggatgagggaagaggttggtagattcagctgtgctgggcatcctggctgagtaacagagacagtgaatgtaaacaattaagatgttctaataaaggaacccaaagagggtcccagaggctagaatatctacctcctgggggcaaacagaggtttcctaagaacatgtcatctgagcagagtcctcaagtaagactaggagttgcatggggagaggaggggaaggtaggcctgcagacggctaggtgagcacaggcacggggtgtggaacatttagcttatggcaagagcagagggtacaaaggaaggagagagaggaggtgggatgggaaggtcaattgtgccaactaagatttttttcctgtagtaagggggagggagggcctgaaggactttaaacaggtgagccatgcaatcagctgtgctttgggaggatagctctggtggtgacatggagccttgaggatgggactatacgcatgagactgggatcagagtggaggcagctggcaaggaggcagtcaggagaccctactaatatagggaatccaaatgaaggagaaaaatcatgatggcacagctagaaactaatagagaagaaaaaataccccaggcattttggccttgttttacaacatatttcttagctttttgatggcaatggaagcttttttgaagttgtcttttgtttcctgcctttactgtatgctctgaattcccttctctttcatgctttttggtttgcatctattctttcatattggaggctttgctcaaacattctgtggaccttatctgtttgcatatatttaaatgcaaggcactgaaagacaaaagacctattcaaggcagagtacaaagtggaccagggcaggtaagtgggagagctgtgattgtcaaatggtggctccattttaagggcatcctgcagggaattggttcatcgagagaatatgaagtgcaagtccatgcagatcttttctctgaggctgttctgtttccctagagaagattcccacttttctgcttctggggatatctggctgctggcactccaggtgcagagtcgtagggcatctgagagtccagcaaatcattccatgggctttagatttcagccatggattctctccatgagtgctctgagagaactctccagtctcctgacttggcagtggctacacaggctgttgacctggctgtgtgggttgtgggagattcctgagatcccatttaccaacttctaacctttctttccctcttgtttccaggctgatttctcaacctctctgtcgtgagttgactcgtgtactcccaaaagctatgttgaagttctaaccccggtacctgtgaatgtggccatgtttggaaatagggtctttgcagatgttagttatcaaggtaaggtgagatcatattggattagaatgggccctaaatccaatggtttgtgtctttataagaaggtcatgtgaaaacacagacacaaaagaacgttatgtgaaggcagaggcagaggatgtcaagaactgctagcagccatcagcaacgaggagagatgcatggaacggactctccctcagagccttcacaaggaaccacccctgctgacacctgaattctagcttctagaactgtgagcaaatacatttctgttattttaagccacccagtttgctgtactttgttacagcagccctcggaaactaacatatccacccttggctgttcctaactcctgagcctctcaggcattccttctgaaaggcagatcggctggctccctgttgctctccccttgtgcagacattctgggagattacttccttcttagcttccaatatttgaggatagcttatctccacttattttctgtttccttcagagtgtatatctttctttgaaaaaaagaaatgcaactttattatttctaatcatgcttaatactattaaataagtcaataaaatgaggcaccaaagtgctcatttcagaattatctctattaggaaaaaagtgtgggacaattaaataaattacaacaagtcaattgatcggaatactaggctgccatttcaaaggataatgtgaaagttggatgcggtggctcatgcctgtaatcccagcactttgggaggccaaggtgggcagatcactttagctcaggggttggagaccagcttgggcaatgtggtgaaaccttgtctctatgaaaatacagaaaaattagtcaggtgtggtggcgtgtgcctatagtcccagctactcaggaggctgaggtgggaggattgcttgtgcctgggaggcagaggttgcagtgggccgagattgcaccactgcacttcagcctgggtaacagtgagactctgtctcataaagaaagaaagaaaaaaggacaatgtaaaaattatgtagaaacatggaaacatattaagaactttatgttgtgaccaaagcagaatacactcatgtaccctggtaaaaatgtgtttggatgtggacagtagtatgaaggggtatcaggaataagagaatgtgaggttcttatttctcccaacagtcactcttgacaatttaggtattctctaaggtgatgtatattttctttactgttctcatttgcttttgatacctcaacagcagagtttttaacattcacatatatttctccttttttccttcctccctcctttcctcccacccttcctgcttctttcctacttcttccgaagagagacgaagaagagaggctcatgaagaaaaggcaaataagcttttaaaatatgctctctaaaaaaactataaagttacttaagggaagagaacattccaagccttgtaaggacttggggttaagacatttagcttcattattccaaagcagaaatcctttaaaaaagagttacgtatgttggtcagctggataagaagaatttaagataagaattaagatcttatcttaaatctgtcctcaaaaaccttattgtgggtatatcctatttttttccattggattccagcattttaatatggattcatggcactgtttgagctcataaaatacatatgaataggaatatattaatactaacatacaaagaatgggtatttttttcaaagttttatgaaataaaacaaattatagtccattttatttaccaaaaaatatgcatagagatggttgtttatcaggtcaaaagactttttggaggtgaaaaacatcaggtatgctggaagaactctgagatgtagcgaagggtatgagatgccttcacctgccaattatcatgcataatgttggaaggaacaggaactaatccattcttctattaatgagtcctcactgctactcagaacttcttcctgcccagcacgttcttttttacttttcctttctttcttttttttaaagagatggggtcttgctctgtcacccaggctggagtgcagtgttgcaatcatagctcacttcagcctcgaactcctgggctcaagcaatcctcccaccacagactcccaagtagctgagactacaggtacacaccaccatgcctggctaagaacagagcatattcttagttgatgtttgtactgattacttttagacactacaggatcctaaaagttttctaagtcaaagaaagattaaattttaatcatgataaatttagtgtattttattgtattataatttctcgaaatcatatgtatgcaatatacaatatacatttcttgaaatctatctgtgacatatgctagctccatctcttaacctgaatattaaaataactagaggactacattttctggcaatgctggataaaagaaaatttaatgtatttcctagctgaaaaagtcaaagctctgaattcatggctattaactggccctttacagtagaattcaactatgatgagaactaaaccactttataaaaagatatcataggccatatactccagattatgggcaggaatataacagtgcatactctgatgaaaggttttatacatagtcatgcaccttataatggcatttcagtccatgatggaccatatctacaaccatggccccataagattataatatcatatttctactgtaccttttctatatgtttagatgcacaaatatttaccattgtgatacaattgcttacagtattcagtgcagtaaaatgctgtacaggtttgtagcctgggagcaataggctatcccatatagcctaggtgtgtattaggctgtacaatataggtttgtgtaagtacactctacgatgtttgcatgacgaaattgtcaaagatgcatttctcagaatgtatccctgttgttaagcaacacatgactgtatttataggtgataactaaatgacattataagcttacttcatacattccactgcttatactgcatcccatcattcacttttctgtttcttcattcctttgttcaacaaacattggctgagcagctctaatgtgctagcactgtgctaggtgccaggaatatggtggctccaggaaacccgtctaatggggaagagacagaaagataatcacatacagagtgtgtggttataaagagatggagacagtgctgtggaatgttgtggggaagtagaggttttacagaagtcacagcttgggctggtgtcttccaggcacatatgagagcgaggaggcataggcagaggccagggaagatggaccaaagggctagtgagtcctgagcttgggcaaagggtgtctggtaaggaagtgggcagggtgaaaggagatgaggccaaggaatagatgtgagcttcagaatgaatgagggggtttccgaatgctataccgaggacttcggaaggtaccttatagatggtgatagtaacctgaggtctttaaagcagggagatgctgtgatcagatttctttttaaaaaaacatcattttgtcaaaaatttggaagatagactgtagtggaggggcctataaattacataaaaccaacacttttgaatattaatgtttctcttccattcatatttgactaataacacatagaatattttctgagataaacaggctttactatctatcagcactcagatttgggtacattattatgtaacaaggacaatattttgagaatggtaaaccagtgcattttccattctgtttgaatggtgatgcctggggctcctctcccgtcatctcagtaggcttccctccttcaggcaaatggcggttcccagctagaaacaagctgccatcattcagctttgaaaaagaatagccctacttgtagctttgcaaggtgaagtggctttctacatttcagaactctcctttctctattaagaaccaaacctggctaagttagatcttcaagttttactacaaagctctagcaggaagaacacagaggagaccatgtaaggatagttcccatcaggaaaagcaaagcaaatggaaatattaggggaagagggggagtggggagaggggcagggagagagaagagaggagaaagagagaggggagagaaagcagaaagaggcgggtgagagagagggagagtagtcctggcttcacattccttgggggtcaaacctttaaggggagggcttttatttcaaatttcagagcctaattcaggaaaataatagaatcttcctaaagcaagttggtatcgcccaggcagcatattagaaaagacttaggaagttatgtggacagcagggtgaagagaaagtagctgggagttcatgggtgccccagggggactgaggaaatgccaagagaaccaatcagctagaactggccaggaagctgctgggggtggtgaagggggcttgccaagaggctgccacaaggaccacagacttaagtagccagagctggtggccagggctggcacaaagtactcatcacacccacaccatagtcacacggggctggcacagcatcacagccagagttgcgaccagccacctctcagttaacccagaaagacccaacaggcaagatgtgtaccaggggtccttctcttgaaggtcacaaaatcatcacaaccataggtgagttccctggtacctagatgtcagctggggaggagaaagagctctgattaggagtactttaaccagaagagattgagatactttaatagtcaagtttaaataatagtccctgaatgcagccaccaccctactccccatcaccaggaaaaagtggagccagatagatcagttatagagaaaataagaagttgttttccttcctttcttccttccttgcttctgtctttccttctctcctccccttccctcctctgcctctcctcccttcccctctcctctcctcttcttttttccctccctctctctctccttccctacattcctcccttcctccctccttctttcttcctgtattttttgagttatgtatgatgccattccatatatataccccctttgtaaggacaagtaagaaactagacccaactatctcttcctttcatccacaagaatactaaaagtcatagagaaacacttataggaaactaactgatttgagtggtgtctttttttttttttttaatatctgatgaagttgtttttagggaacactggattgcttttaaagtactttcatcagtatccagagaaagtgtcctggagtagcaccttatatcctcttttctagtttgtcagtttctaactcccattctactatttcaactatattttaaagttttttctcccttttttccagagaacctattaatattgcatcatgtggaatgtatttttcaaaatgaccattaaaagtgaaggcagaggctgggcatggtggctcacacctataatcccagcactttgggaggctgaggcctgtggatcacttgaggtcaggagttcaagaccagcctggccaacatggtgaaaccccatctctacgaaaaatacaaaaaaattagccaggtgtggtggtgcatgcctgtaatctctgctactcaggaggctaaggcaggagaatcgcttgaacctgggaggtggaagttgcagtgaggcgagatcaagccattgcactccagcctgggcaacaagagcaaaattctatctcagggggaaaaaaaaaaaaaaaaaaaaagtgaaggcagagaaaaaaatcaaagtttactgtaaatcttaacattagcagccctgcctgcttcagaaacctcatgacattttaatagagaggcactacccttaccaaaattttcctactcttaatggaaagagaaaattattctggctagatgctggccaggtcacatccttttgcattatctgtgagaaaatatccactccaaaatcaaaagccagtttgggatgagctaaaaatcagattacattcataataaaaatggaatctctcagttcttaacaaacaaaagatttataatgactctgcaccactgacattctaggtacactgagatttggttaagttgagaatgaaaataaggagccagaacttagcttgctattgcagacaaaagctcaaaatgatactgtgacatgagggtttctgtttatccctaaggctggtgtggcaatttcaaagtttgattgtgtctttttttcttccttcttcttctttttttttttccccctccaaagacgttgagcagcagggctaatggatccccagcagggtgcaaagacagcagaaagtgcaggaatcagatgtcaatgtattccttcgagataccctgctaggacacagctaactaaccagggcttgagtcttctcttggggaatgtgctttgatggttccctgcccactcttggcttcctgattaaaaggctgtcacccataaatcacgacttcatcctgttacaatcattttctttctttctttctttctttctttctttctttctttctttctttctttctttctttctttctttctctctctctctctttctttctttctttctttcattccttctctctctttctttcttctctctctctctctccttctctgtctctctctctttaaggaaaagtctgaagattaaaaagagagcaagttccagagaactctatgctcacatataaacatatggatataagcctggcctacatccttattagatagctattcatcgatttgggactgttctgtgcatgtgtcctacccacctggcatgttgggagagctaaatcaataccacaatgacatgctgtctttctccacttgagatagaaccagtcagcctctctcgttgacaatatatatggtaaagagggcctgcacatcgtttttttctgttttatttaaatatttttatatattttctgtctgtcgctttctgtcaatctcaagattacttagataacttcctagtgaatagattttggaggaggaggagttcctcattgttttccctcaatgtagtaaaaaattgagtggaacttgaagctatcagagataagagtttcgattttaaatgcactgggcatccaaaatataccggtgcaggtgccaattaggcacataaataagtagcccttcaggcactgagagtagtgataatcttcccctttgcttggagaagagctaaactcagcaaacaggaacacaaacagaaagtgctttatctatttgatatttgacaagcacaacccttttaaaaccatgaagtaaaactgaactacccagtgaaagtcaatgaagtcaaaaagctgtaccaaaaccatatgcatatgtactgcccagcagcctggccacccgcccctgccaaactcgctgttctgtcccactgctgtactcaagagcctccagccgtggggtgccctgggtcaactcccaccctctgtagactccaactctccaacctcctccacctgcaggaagatcccagctctctctatgagagtgcttgccttgggctctacatgaaggttcttgccacccaaccttgccctaccttggggtcaggccttagctgttagaggggacatgctttgtctcatgtgtactcctcggtattcttttgccatatgcctagaccaacatggtaaagcaaagctgaattcttatgctgtatttcagaccaatcacatcagggattcctgccacctgcacacttcccacttgccttcgatcctctcagactccttatgattgcatttttatgttcaaaaccccaaacttgactttcactgagttatctcagtgaatggtgtcacatcagtgaccttcctggctcgtcacttcctcaaggtgttgtgtcttcctacaaatggtgattcctgcccactgactgattcaatttcatttcggaagcaccaacagttaatgtgagattatccagttaaatagtggagggaagggagaacactgcatgagatcaaataaaataaaataggaccctcagagaggatacttaaactcaccctacaaagtttcagttgagggctcttaaaatgattggtttcaaagccttgtataaaacttacaaatgaaataatgagatctttttttacttagtgatgacaaggaatcaaaaagagcaagattttcaccccctgttaaatgaaaagatacagcagcaagtatgaatatgagcttctgtaaatagctccttccatattccctttcagcatgacacatctctccccagttagttaaataataaaaaaatggtgcaagaaatttccatcagaggtgaagtagggcattagaaaggtcactacaccaaaacaaaggtcaggggtgagcaggacacaactctaatttggtgggagcatcacttaatctttctatatgttaatttcctgaagctgaaaatagcagatgtatctaaccgacagataagtagtaaagtaaaacagatgtgaaaaatcaggacgatatataatgtgaagggataatattactccctaaattctagaaactgctatttccacttaaattcaagtaacttcctttgtaacctaaagatttcaaagcatttaataggaagcataagataagccctaaaggattgtcaatcagtaataaaacaaattaacatggaaaaccatatgaggatcctttacagcctttcctataaccaacacataggaagagtgtgtagactttgagttcactccaaaatagctttgcaaactagtaccaaaacttaatcagcttcccaccccaatacatatcttcatcctcctaagctttacccaaagtaaaaggaatgtagtaattgcatgaataatttcttcatcccatttattgcctaagtgtgcacacaaaactgaataacattaaaaagtaattcaacatgtatagtcaaggtcagttttgcaaagcaagatacacctgacccaaaagttgttgagctttgcacatgggggactgcttattcggagacactgaggatgggaggagcagacaggaagaaaaaagagttgaggatccccttaaaataaagtatacatcattttctattttgtttgcccaatcttccattattaaataaaagaacattatgttccttttataactaaaataagcagttgtagattattttaaaactttacctgattttatggtatcatgtatttaatggctaatataaaacaaaaatgaatttatttttgttatagttatcaaaaattacatatccatcttcaagacagtattctaagtttgtttgttttcagagttctgtgacagggctcagcagttcctaaaagtgctgaaaacaaagtggtagatgatcttgaacttgatggttgtgaggtccttaaaaaacaatactgcgtttttaatggggttacatagggtgaggaactaaagagcttttgctttccctgcatgtttctcactttgaagttaggaaagcagctcagtctgactgagctaggttgtgggtaaagaacttgccaggtttttacaaatgaaagcaaatgcttagaagtagaattaaaagccaatgtacaataaactgttagtgttaactgatgccagccctgatccgcactcaaaaagtgcagtgtgaaccattcaaagcgacacttttctcctttcagaaggagaggcctacacaccaagtagcagagctggaaacattagcacatctcgctcagaattcactggttgggatttgtctcatgcatctcagagacaggcagattttgaagctggaaggtgcgtcacaaaaccccctgtatcagaccatggggtcagagccgaacaccatgtttcatggaatcctcattcccacattatattaataaagaaaatttgtaaaaaaaaaaaatttccatggtcaaatatgtttgagaaattgagctgatcaagtttaaacgtttcttgggcctgtgagctttttttgaacagatagctattagatgatggctggatgttcatgttctatgggacacagtttgagagatagtaaataaaatattagtatccctggtttacagatgagggagtagaggcccatggagattatatcctagaaagtggagaacgcaggtctgcagcctcctagaaccaactcttcccagccagggcacagtcagaaatccaagaaagacaaactgcagccagagctctccgcaatgtgcataccctggaaatgtctcctcaaatgagtgcttttgagaaatacacacttttccttttctgattcagtcagaacatgtaggccctcccaaatcaaagtacctgatacaaaggcatgcagatgctatcaatccactccagttgcaaccgaggcagttcatccttccggttccgatcaaaaattgcctagaatggggggcaggaagaacctcgctttattacaccaaagtattttacagggtgctttgtcaaacactttgctagaatgatccattttttttacaaactgaacccttcgcaaatcacaatcaatctttacacatactttcttttcctttatctatgatgagaaataaaatgtttttacctctttttatgagatttgtaagcaaatttacttgaactttctagcgtgcaacttcttggggcaaaaacctgtcttcaaatataagtaactgctactaaatcaagtcatcaggtcactgcgaattgggtacaggtcaaggggaaaggaatatgttttactgccacaaaaataatgcaggcttttatttctgcattatgagaggttgggatagaataggacaaatcggaaaatatccttaaaagcaattttattgtaaatagaaaccatttatactaatttttctgggtaggggttgatttggcaattgcatatgtttttcagtaaggttctgtcattaataaatttttaaatatttatttatcattgtatggatgatggtgggtggactcattatctcttcattcccagcccttaagctttatgatgatataatgtttgagataatttaggtatatttttgggaaaaataaatgacatttttctgttgggcagacttaagggaaacaatcaattggaattttagtgttaaaattaattcactgaacaaacactgccaattctgtgccagtgagactgtctctccctttgttcttaaggagtcaggcccagaccagagaagctcccttgtgcccttacttatctagaagactgggctatctagttataacttgccctcccttaatgttatatagtaagttttatctttcctttacataaaatgtggcattcacattattttggtgtccttataggccatgagggtggagccaagcaatccctttggtccagagatgtaggaaaatcctgcatcgttcagatgtatgaacaagagtgggagtgggtggggcagaaatcactagctgccaaatctgaggaaaatatctccaaattggggagaaggtcactgattccaccaggcttttctcatccttgtcttgcaatggaagatgggaaatagcaggaaagaagactggaatttggagaaaattgtgaaaatgtgctggagagagggatagttcttgtgaataatatgagtcttgatccaaaatgtttctttagagctggctgcggtggctcatgcatgtaatcctagcactttgagaggttggggcaggaggatcacttgagcccaagagttcaagaccagcctggacaacagagtgaagcccctgtccctacaaaaaaaaaaaaaaaaaaaaattagccaactgtggtggcacacacttgtcgtctcagctactcaggaggctgaggtgaaaggattgcttaagcccaagatgtcgaggctgtattgagctacaatcatgtcgttgcattccagcctaggtgacagagtgagactcagtctcaaaaaaaaaataataataataaataaataaaataaaataaaataaaaataaagaaataaatacacaaaatgtttctttaaaaaatattattctgggctgggtgtggtggcttatgtctgtaattccagcactttttgaagccaaggagggaggatcacttgagatcaggagtttgagaccagcctggccaacatggcgaaaccctgtttctactaaaaatgcaaaaaattagctgggtgtggtggtgggcacctgtaatctcagctacctgggaggctaaggcaggagaataacttgaacctgggaggcagaggttgcagtgagccaaaattgtgccactgcactccagcctcggcgacagagcaagactccatctcaaaaaaaaaaaaaaaaaaattatgttttcttttctctatagttctgtctaaaattttcatatttatttaattattccatttctagtggatattataaagttacttttttaaaaaatgcagtggtttttagtatatttacaaagttgagcaactatcactacaattatagaacattattatcatcctcaaagaaaccccatactattagcagtcattctcgctttttttccgcactcccagccttaggcaaccactaatctactttctctatctatggatttgcttatcttgcacatttcatataaatgcaatcttatgatatgtggtcttttgtgacttggcctctttcactgttttcaaggtttacccatgtagcatgcatcagcacttcattcatttttattgccaaataatatttcattgtatagatgtcttatttatttgttcatcagttgattgacatttgagttgcttccaggatattatgaataatagctgtgaacattcacatacagtttttatgtggatgtatgttttcatttctcttggggatatacctagaggtagaatttctaagtcatatggtaactctgtttaactttttgaggaattgacaaactgtttttcaaaacagctgcaccattttacattcctgctaacaatgtatgagcttccaatttttccacagcctcacccaacacttgttattgtctgtcttttttgctatagctatcttagtggctgtgaagtgatatctcattgtggtttcagtttgcatttccctgatgactaatgattttgagcatcttttcatgtgctttgtggccatttacatattttctttggagatatgtctgttcagatcctttgcctatcttttaaattgagttatctttctattgttcagttataatagttctttttatcttccagatacttggcccataaaagatatatgatttgcaaatattttcccataatatgggaaaatttactttcttgatagtgtcctttgatccatgaaagtttttaattttgataaagttcaatttatttatttatttatttatttatttattttgagagagtcttgctctgtcacctgggctggagtgcagtggcacaacctgggctcactgcaacctctgcctcctgggttcaaacggttttcctgcctcagcctcccaagtagctggggttacaggtgcttgccaccacacctaatttttgtatttttagtagagtagaagtttcaccatgttggccaggctggtctcgaactcctgacctcaagtgatcaggccgcctcagcatcccaaagcgctgggattaaaggcgtgagccaccactcctggctgttcaatttaattttaatgaagctcaattcaacatctctggaccaacatctctgggtcattttgtcttttgtctcctgtgcttttggtttcatatttaagacaccatggctaacccctatccagaagatttatacctatattttcttctaagaattttatagttttagcccttacatttaggtgtatgatccattttgagtttatttcagggtatgctgagaggtagggagccaacttcattcttttgcctgtggatatgcagttgtccttgaaccattgttgaaaagacattatcttggcacccatgctgcagattagttgaccataattttaggggatttattattgtactagtcacttcttaatcaatgcttgatgagaaaaaaaatgagtgtgaggccccacacagtcctgtgcttcacagcattttgcatctcataaaataagtattagtaatcatttatttcatgtctatatttcccaccagttgacaagatccttgagggcagggaagatggtgtcttactcattgctggaaacaaggtgccttgcttcatgcccgacacatggaggcactcaggcaggctttcctaactgactcactgcttccaatcctgaccctctggctgtgggccagattagcctttgtctccatgaagtgactcccatgactcctgggaccatgatacctgagggggctccaggacagttttcctcctaaatatcaagggataatgggcacagcagctgtcagctctgggtgcatgcatttacagatatttctggaaaagaactgagggctaaccctgccacatcagccaggcctcccctgaggagatggtcatcagtggtgctccgtagtctttgtgagaagacaggagcatttagagctatgtttctaccgcaaaattaatttcatttatgtctacagaaaatgccttacctgagcctacagataaaggctccttagtgctgcgctactgcacccaccagctcaccagtgctggcaatttactcatatttttttcatttaattaaatgacctgtggtattgctgcattgtaaacccttcagagtatgcctctgaaacagtttttaaagggggaaaagcttttatttgaaagtagatatgacagaatttgggtcatactaggttttatacattaactgtatgtatcccaagctaatatttttatttttataaccaaatttgatgacaccaccaaaaaagggatgttttgagaaactaagtcaatgttgctttgaaaactcaaataattgttgtgtgtgtttcaacctatgtagcctcctgatcttttgtacataagcaaccaattaagaatattcaaaattagcaagactgtgcgttctgacttcaagcagatgaaactattcaaactaggagctagttctcttgcttttccttgtttttaaatgtcagcaaagaaggatgtcttaaaacttgaagaccttataaatacctccaaatgttcaagctcagttaatttgggttctcataaacagacattcttgacaattgataccttccttgagtatcactaaatctactgtgctatgctaggctttaaaatgctttgcaccactctcagagtcattgggttatatgtttttagctaatcattggttagtaataaagaggctgcccctcttgaggtggtgactgacgcagttatgtcttctgcatccttatgcttaaaaacagcatcatcttgagcgtaaagtaaacattcttaagtaataactgagcagataagtccaatataaatagcgttcaaatcaccagaacctagttccccaggtgaaactttttcattttacagacaaaagaaacagagatttgaaatgatttgcttttgggattttgaaagttggaaattggaaaataaaatctagcttctcaaagctagaaagccttcctttaatttttgatgcacagtgtttctattctaaagtaggcatacatgaaatgccagcactgggctttgaattattcaaactccactttgctcatcctccctcgtgcctacttgtcccactgtgggtgcgcaggaaatgcttgttaagtagctcaccactcttaatcagaaacttgggaataagagtgtttagcatttgagtttaattaaggttttaaactttcaggagtgcttccttaaacccattttcagtctttcccatttccaacttgtaatttggagttctttttgaaaatgtcattcaaaagggtaaatacgttataattaaaggatgaactcactgaaggagtgagtttgagctctaatctctcccgatctccttgttcgaagaactcactggttacaagttctgccacctgaaacatataaatattttaatctgtgattatgtgtagtttatcacgagactcagaagttctttcttgcttatgtatttggtgatcctcatcaacacaatcatttaaaaagcttatgaggaagtaagtatattaacctttcatgtttgaaggtgttatagaacttaatgaaactgatttccttttaatcaggacaacttgtgcaatgtaattttagatgcatgccaacaggcaatctgccacagtacggcttccatatttgggatgaggcaacaggttgccagcttcaaagcaggaaaagttcttatacagaaaagtgaagcaaatattcatttaataataatgtgtaattattattatattatgtaatgatagtttagccactttttattatttctatgtagattatttattttgttgcatacttttatgttagcccagcttcaatttgccacatgaaaactcctcaactccctccctaccaatatttgtatgcactctgggagggataaccccagggcacatcctctgcttcctactgttgcaatcaatcaagaggcaggactaatgccagattcactgttcatagcagacttttacagtaggtcacggtatagtttgaagagcatgacttggtcttcaggctgtctggatctacgcactaaaagtgttaatttatggtaggctctacttggtacaaggacaatgggatgcttgttctacctgaaaccttaaatagagacttatatttttctacttttaatccattagcttggatggtcagcagctactgattattgccaagctaaacagatttttttttttcttttccacaccttcacttctcaggatagtgtgtgggaagcaaattgatatgacagattaaatgttgaatggctattttcaacgctactacagtgtgcatctaggacatttctgagatgaactagctggatttaaaaaaatattggaagagtagaataaatcccagacaacttcatggtaagagggcatggataccaaacaaatttttctctattccaagttcttatgaagataaggttcttaaatctggcaaagatgagacagtttaattttggtcaagtgcacagtatcaagataatttaactccgttgatctctcaagagatttgctcaatcacagattatagataaaactgaaacacaatgctaaactcacacacacacatctgagagtagcatgtgtgcagtcacatataaagaaatcaaatatccagtaagttcagatttctatatttctgttaagaaacatgggcccctttcaagatcaaccacaaaaaactagttggaactgactgaaaaatccccttcaccccagcctcttgtatatgtgcctgttttctaggactcaattcacttgtctcctctccagtctctcctgctaccctgcatttcagcacaccaggcttctctcttctttctctggccttcctttgaagaggaaatggtcccctaagggtatgacctcatttattcagttcccagaactctccctcagattgctctaagctaggtcttttgcattaaagaatgtaaatgtgcacatcaggcgcctcaaggtgggagtcctgcataggtctgtagcccctggaaagaaaagaaattaaaacaaaattctgtcgttgctctttctcaagtacttgttggtatctcccctgtgctcctttcacagcttaacttgcacaactgctttgttggtacttaaaaacccaatcaggaacattaagtggttactgattgaattttttattaaagaaggaaattgagatgctaatcaggccttgggggaatcactggggaaacccacatgcttagagtcttgttgcaggaagggaaagtggaatagaccccagcagaaaacattctgaaagggaattttaaaaaatcaacatccaggaagttagagaaatattttttaaagaagggcctattgttttctccaaatgtttcctaaaattttgaagtgagcattaaaaaaaaaaaaatttaacccatcaatttggagacaaacaagaatgagattgctagcttagaactgtgacaagctttccgatggaaacattaggaaaaacacggttttgtgttttatttccctgagctcttatgtttctgcacttttcaacagaaactcacatccagaaaataaaataatatttacactagtgaccgagaagaccacctacaagcagctactgggcctcccaagtcggcctaaaatatcaaggcagaaatttttttccttgcaagtactttgccctgtcactttcctgttccctggggctactgctccttgagtccttgacatgcgtttcactgtggtttctgaaggtgctggcacatcatacctcaccccattccctttctgctcttctctagttttctctcagtcctcctaacttcctcacactctccacctccttccatccctattacaggagcctcccccagtactacactttttcccaatacctggaagagcctcctacctcttccctgcagtctactcaccaactctcccagaagggaggccttcccacatgggaaaggggagggggtaagatgaacagtgggcagagatgtggaaagaagctagtcaaccacacaaattcttcacaattatcctgctttatgtgactttttgtaacttcaaatatgtcacactgaaatttaaaccaaagcacaattggtgaaatactctattggaaaactgcctgatgtacattggacagtgtgagcaagaaataaacctttatttgtgttgaacaactggaatttaagaatatacttgttactgaaccaaggcctagcctagccttgactaatacaaaaattggtacggaagtgaggtgctgctgttagaaaagaagagaaagacagaaaaagaccctaaaatatgtgtcatcagcttgggggccaggtatcaagatagtgaggaggctataaggatgagaatccatggcaaaataatttgtacaattataactaaaagctaacaatgttctgaataaacttacagtcttcggagatgagattagaaaacaaaatgttagtagcatgtgatgattgccattgactgttttgcgaggaattacaggaagtgagttagaaaaggaggaacaggcttataaccaggaatgaaaggaaatggaaatagtcgcaaattcagggacttgtagggatggaagataaaattgcttctcaattccaaactatgaaaatgaaaattgcgatacactttgacgaagtttgattaggactcagctttgtaacaagaatcaaataaaagacatctagagttagaatctgaatgaattaggtagtttgcagcatatccttctagctggacaaaaatggctcgattaaatgatttacctatatggttctctcactgaagcctgttaggcccaaggcactaggaattaagtcagaagagagaaagaaataaatatatttgccacatttctttattcctaaatgtaaagaagcaaataaatacagaaaatctaagatgtttgtatggaatgtggatgtggttatgggcaaatggaaaggacttgaatcaaaaacataaaaagctgactaaacgtacaagagagttttggtgccaaagaaacgctaagcccatgattacacaaaacaagtgttgggacttcaaccttctttaggtgagaagaaggcagtttgaccttcagataaagctaagaagggtgatgggaaaggaataatttcccagggaggattgaaaggtcaagggaaaaaggaaccagagaacatctcccagagaatcagggtcccctgcatggtagaacacctcacagtgagtacccagtgggattttggagttgccatggaccactcaccactccacattgctatgaatatcgctcatctcttccctttccgaatgggagtctttgggtgcatgttggactctgtattttgggtgtgtgtaggtctttaatctgcatccagatctgttgtagagactagcatgtatctcccagagatcctggacttaagagtttgatgccgtgactgatgggacatttgggttgtctttcttggaggaaggatgggtatattttgtctgctggagggagaatgaatcacatttttggtgatgagaagggtaaactctggtagtcatgcattcactatttctggctttctcctttctgagcaaatagaaggatggtacttcctggttgggtggggtcatgtgacaagttctggctgatgaattgttgcgggaagcatttaattgccagtgcaagaccttccagggcctctgtcagaatgatctaggtagtggctgttccttcagccccaatacagaataaggacaaagtggcgcctgccaaccctaggtgcccatgttcgtgagcaatttgttgtttaaagccactaagatcttgggtaaaatgataacatagcctattctgtggatacgcttgcatcatttaaaaatgctgactgatgcatcatgtgaaggaacccataacacactgctaagaatgaaagctttggagcctaatctgctagaatctatacctagctctgccacctacaagctgtttaaactcaggctgcttatcctttctaagcctcatttttcccatttgtgaaatggggataataaccatattagtttcctaaggctgctgtaaattaccataaagttagtggccaaaacgacaggagtgtattctgtcatagttctggaggccgggagttctacatcagttcactgggcagaaattgaggtgtcagcagggatgtgctccctctggaggctcttggacagaattcgttccttgcctcttccagttttcctttgctcacggctgcatcactgcaatctctgccttgtcttcacattgccttcttctgagtgtgtaatttccccctgctccctcttataaggacatttgttattggatttagggcacacctggataatctaggatcagtctgcagctgagatgcttaatcacatttgcaaagatactctttcctttcacggtaatgtttacaggttccagagattaggacctgatatctttgggtggccattattcagctgactacaattttaaggattaaatgagatagtatatataaagcagtcaataaatattagttatttattgatatggaaatgcatcttattttccctaaaacgtcaagtctttagatgccaagttactgttctggaccccacacagtaggtgcatcataaaacgcacataacgattaacctctaaataccatcagtaatccctggtcttcagttgggtagttacttaaattgaaaactattcttatagaactaatgctttatggcagagaaatcagataggtggtaaaggcatggtttgtttttctgcaagttaaattggatactgcatattttgaccacagaggtttctgatatctaaataatatttaaaaagaaaaatataatttcctttttgcctccttttattttcagatattaaaaaaaaagaaaacaagactttgtactgagatgtgattatcttgccaaaaatcctatctttgaaactcttgccttaatggtcaatgtattattcagatttcgcacattaaaaatatcttacagagtcagaaatactattgcttagtgaaagcacgataaaaaaaaaaaaaaagggctgtgcaataaactgtgtcgtgcctaagcctcctgctattttttacaccatgttaatactgatgcaaattgactagggtttcagtgcctggtagtcagggctctgggaatattgtgtcccccttacgccccccagtccctcctctgctgagccctgccattaatcaccacttgcctgtctggagatctcccacggtttggtcacggctccaaggtcacaggctgtcattaacattgatctgaaaaacagaaccaaacaaaacagcctgaataatcttttgttgcattcctaaacaaacccgtcctagatacataaataaataaaataaaatggaaacgaggccagctcacatcttcctttcctcaacaaggggcagcactgtttatagtccctgtgttcagcatctccatcatgtggccacgctgcttaggaagacaaagctctcacacatcctctggtggcccttttgttttgtctgcagcaaatcaaggaaagcaaagcactactttctgtacacctgagctaagcaagctctgcttaaaataatttataatggacaatgttgttgggtttttttaaactataagcaagagaatcagtatataacactatatacatggctgatgaaactacttaccaacttatcattgattgatgggaacaaaagaaaacccacaccaaagaggcaaggcacatgccacataaggggctccttcattttcatctgctctacagagctaagatttatgggcaagagctgtatcatttcactccagtttactacctggctccaacaatggtttataagcattatgaagaagaaacatactcagctccagctctcattaatttgggcacataagaaagcacaggaatggtctgaatcagagttttgaggggcagggttaaccataattcatacggaaccatggaaacactgggaacaattcaaattgtagatagctctggtgcttatatataatttaatgtggtgggaggaggaaaaataaggcacactctgtcccaaatctgctttctttgtgctgataaccagcagaatgtgatgaaaagtaacataggatttgagctggggaaccacatcttggctaactgcttttggaagaaaggggtatgcaaccaaaggtcagagggctgtcctgatgtcggtgttaacatttcataccctgccagatctaatgccttggaaacatgtctgctgcccagatggcagagcatgcttagatggcaggggggtccccccacaggaaacccctccagggaacaaggcagggtcacagataacaataggtcattcaaggcacaaccaggtggcaccggcatcagcagccctctcaactcgagcagcattgatgaaacctctaattccaaacatccctgtgttaagaactacgcaaagggagacacatcagtctattcatttttgaccttctgtatcaggcatttctacactgcttactgtgtgtctgcttctgtactaagtgctttactaaccaactgctaactaaactactaactaaatgaatcgtcatcaccaccccagaggtagttgctattatccttattttacagataagtaaacagaagcacacagagattaagtcattttcccttcccaaggtgagtaaatgattcaggattctgtgcctatcacaaagctaccagatgccctcttactacacatggatgctgacagtactggagggggacaagactggctaaagcattggatttctcagcatctctcctgcatagcaaataatctctatgaggttgcctatttgtatcataatgtggataattacttaggttctgtccagttgataatttgaaactttctcttcaaatgcatattgccattaatcagttgatcaacaagtttattgagtatctgctaggtcctcagatgataattctaatagctaccacttattgggaagtctccacagggtgactgactcagtctctatatgtggtagtgatactattattatctcttattaaagttaaaaaaataaggctcagaaacgttaggtaacttgcacaaggttgtacagttattaagtgtcaaagctgggattggaatcctttgtctgacagaagaatctctacttcaatgaatacagtggagcaagaagtccatgcagagaagggagacaggacaggctgagaggtaggacgggtagagtggctgcaacctttgtccatctggcactggggagtcaactaagcctggggactcaggagggacctggatagacctttagggaggaaactttaggtggtggatgtgaggatggtttgaagaaggagagggtggaaggaaggagactcattggagatgtaaattgataggagcctaaaacaaggaagggagagtgggaagggaggcacagggatggaagattgcaaaggaagaactgaagaaaacaaatgagcagttctatgttattttttagattaaggctcttcaagaagtgaaagatctttttgagagtaaaagaccagggagagagtttttactaactgttttagactgaggtccctataattctagttcagtttatagtgagttaacatacctctcctctatatgccaaaattatttcaataataatcttgtgacaatcattatcttcttgatttgttctgtagttgtaaaacaatttaaaatgaacaaattttaatgttaaagatatattcaaattgagtacaaagattttgtgtagactgaaatctgcacttgcctaacaaaaatatgacactttgcagtttgcacttatttcagttttaaattttaaccatgaataaaacccacgaatgatcacataaaatgacagaatgaaagtatctcaagttgtatgtcttcatctttaccatcaccgtgctatcattgtttgttctgaatatagtctttaaaagcaggaatatgagttctgcaaggttagaaacacaaacgacacccagagagtttgagaggttctaaatggttaggaacttactattgaaagtgtatagctgcatctacctatgtcaagagccagctgtatgcctgggcattcttagaattaacttacattacgtgtgcaaagaaaggataaataataaacatgtgcttatttgaagctttcatatcaattatttttatcttaacagtaacctcagcaattgtttggaatttataccaataaaagacatttcttaggaggtatatctcaccattgactatttagaattgctggcacatggtggtaataaaaagcagactgacttttagttggttttattactattttaaaattctctacagatggtgctcccttagagcaccacccttggtgcaaggtggtcagagtgtaaccatgaaatgggggagggagggcagatgaggggagaggggagaacccagagcacctccattttatgtaacatgcttccaaataagatatttcttccatatggggttccttgtcaaaacagtttgaaaatctctgtaggaaaatatctaggcagagaaactcagaaatggcatttcaggaaaagagctcagaagagaggcaagcccaagaaaagggctgggagtcatttgagaagagatagtagtgacactagaaggatgctgaggaaaaagagaagagaataaaaaatacatccttgggggacagttctgtttagtggatggtggggggaagaagggctagaaaagactaagaaggaaagagtcagaaataaaggagagaatccagaagcgtatatggctttgcagaatccaaggctgtagagggttttaagaaaagagaggccaacacaattaggggctataaagagatcaggaagctgaagagaacaaaggttgtagcttttaatacttggaaggtgactgtggttcaacagaagcagaaatcacatagtacagacttaattcctcagtaaggaatgggtaaatactctgtggtatatctgtattttggaatactgtgcaacgataaaagatgatgaggtaaaaacatgtaaagaattccaaagcatgtagttgagtggaaaaccatgttcacattggtatgtaaatatacaatttatgttaaaatagacaatcaaaatacacactaaacagtatttttcctaagggtgcatgtgtatgtaaatgctttggaaatggtctggaaaaacacaatacactaataacaaaatacagctgtgcaaccagtatgggaattgggggttgagctcaaaggagatctgggggcttattagcaatgtttgatttgttacagaaaatatatattcatataattactcatggcattaaaaattatacaaaaagaaagaaattgccttgcaagaaattaggaagtgtgggagtaaagggaaggagaaaactatgatggggtctggagaaaaggcagcctgtagggatgactttttgattggggaggcagaagtgtgtttttaggtctagaaaggtcatgattaataaaacagattttgaaaatggaagctgaaggagcatgattgatagagccaggttggggtaaggggcgaggaggtggaaggaatggaattagggcaccagtggaggggctggtcttgaagatgaaaaatgaagaaaaaggcctgtaaagataatacagaggaatattaaagcatagaggaaaaaaactagagccctctggggagagggctgcaggaaggtgacatgaggacagctacagagggtggggcaggcagtggcctgtgttcagaagatggtgccagagattttatatagcagatacggcaggactatgtcaaggtttccgcttggggtaatccagtagttgcctggttgtggagcagacccagtgtgccctaaccctggcctcacgagctctcccagcaaaacttagcaatgttagaacagggataagacagcagaaggtctggttgaggtggagagagtagaaggatggggtatgagagaaagaggaatagtgcccactctctggagtggctgcaagagaggctaaaatttgccccataaacagagtgggttgctactgtcctttctaaacaacttggaagacgtcccaggcaaaggctagaacagactccttatctccacctccaatattgttctgactggttttctatccgcaatgcctattgtctctaaagaaaagcaaaagttactccccacttcctttgtgctatgtaactctgatttctaggatgcaaaaatcccttctccacccaacttgcacccccacttccccaggaaacagaagaaatcatggcttgccaaaactgaactaatttgaacttcattttctaattttgatggcagatttttgagacaaaaataaattataagatgaaaagacattctcagtaatttctttaattattcaactgatctctgaatgttttgaatgtaagctaagatttgttactttaaaaatcacttctatgctcttagtactgtcagaaaatttatgtggactaaatgtccaaataatgaagaaacacataaacaagagctttttcttaccgaaatatatcacgatggtttttgatgttccaatcgtattctcctttactgacaagttcaaagaattcagttctcctcctgcaggaaaatcaaatgaagaaagaaagaaaaaaaaaactggaatgagatttcccagtctgtggggtgacataaacacatctatgggaaaaacataagaccacttgaaccaagtaacttaatatttgaaatcatgaggctaaagcactatcaaaataaatcactttctaaaaaatgttgaggcttcaaggaaaagccacaatcatttctgaatgtatttacaacagaggagattatagagccataaaacagaaaacaatgtggtgcggcatttaggattatgtgctgtgaagccctagtgatacttactgaaagtcagagaaaggaggcaaggacaaataaaaagtggggacaattctagaatgttcttttatcatccaacaaagaattgagctgcatgatgatccaagataagataaactccctggtagtaaattcaagataaatatatttttttccaggttagaaaataactatttcaccatttcagtgcttaaacgcataggctatgaagtctgaaagtaacggtgtttaaacactcgctcagcaactcgctttggaaagttaattaaatcctctgagtctcaatttcttaatctctaacacgggggtttcagttgctaactcacagagttactgtgaggattaaatgaatgacatgtggaaagcatgtagcatagtgtctcaacattttaagtgcttgacactataaaccaaaaataaaattctaagcccccaaccaaataaatggccttctgctcttggccaagggcattcctaaattaacctgaaatgctagtacaggccatgatgggaagtgggagttggacatgtctcattattccttcctcccttttggaattcaggtacagctgaccagcattaacattaaaacagagaccttaagactgacaaagcagacactttgtagcaataagatatcaacatgacagacagcaggccctaaaagaaatcaaagtattttatcccaaaatatatttatttgacatattttgaaatggccttgcaaagctgtctcttttggagaaaatctacattctgtagagaatccccttccctttccaggtccttttcctaatccaggggagaattaagtaagagcttggcaccttttaaagtctgataagaaacatttacaatttattctggaaggctgctacctggaggcttcatctgcataacaaaaacattggtctccacaaccccttatcttaacccagacactcccttctattgattccaggtctttagatagaccctttcaactaactgccaatcaggaaatctttgaatccacctatgacctggaagccactccccacttcaagatgttccgcctttcctgactgaaccagtacatcatacatgtattgattgatgtcttatgtctccctaaaacatataaaaccaagctgtagcccagccgccttgggcctatgttctcaggacttgctgagtctatgtcacaggcatgtccttaacctcagcaaaataaacttctaaattgattaagtcctgtcacagacactttttggtttacaactcacacatacacccatggaaatccatttggagatgcgtagatacggaaaagacaagcaaggaatattttagttagatgattttcagttttagtgagaaaaggaaaaaaagaggacatcaccattttgatttaagaatcacttcccaagttttcatcctcttggcacttgctaatgagagaatatttaagagatcctaacacaccatttcccaaaacgcatctctcaaaatgctagacttaagaggtgctccatgtgaagatgttcctgccaagtaggtttgagaaatgctgcccttaatatacctctcttggagacaccatctatattagcctttgaagtctctgagaaatatggacgtagaaaagcctgtttaaccttatttcatcacaaaattccacatagtactgatgtttcaaaaactacactttggaaaataccatcatgacatataatttatggtagaaatcagacatatttggaaaataccatcatgacatataatttatggtagaaatcagactaggatctcagaaacttagtgctgaccctctgtactgggggacaaaggacaagaggttgagaacaactggctcctctgtgtctggcctggggtgcttatcaccaactgaccaactgtgtggatttcttgccaatgggtcagactaactactaaaattacttgaaaggagacaggtcaggaagacaaatgtatagttcacttctgtattagagacacaaagacaggtcctggatctatcctttcaagatgatgcaggtcaaggccatactacatacagcatggaagaatctccaagacaaccttacggcaactggcgagatggcataacccaattacacagaagggcccaggaactccttctactttgggtgggcaggtgtatacagttcttttcttcatataactttcttatcttcttcacttgacccattcccttcttcatgaccaatggtcgtgcctttttcatattactgagatagccaagtaaaacgagctccccggagaatctccaacccgcctgcgcattgggaggatgggtgaggcctccggaagtttgcgctgtttgcagtagggaggagcctggccccttctgttcctgtgtgggaacctgggattcagtctgtgagatgggggcctgttaacaggaacctctcttgctttgctgagtctttttcctttttgcccaataaattccataacctctcacccttcaaagtgtctgcttgcctaatcttttctggtcgtgtgacaagaacccagtttattctacaacattacagtcactgactgtgaagtgaaatagaaagggaagtggtggagtggaaagagcccaggtttggacccacaccgacctggcttaatgctgactgtcacttattagctgtgtgatcttgggtgagtaatttcacattgctgagccttagtttccagctttgtagtgagaaattgagataaggtgcactaaacatttggccctgttagatactcaatacctgaagctatggttaatttgtaaacaatattaatactattactgccaacaataatacaaattggactaactggactaatggagatctaacagtttgcccagttttctcctctcactacatagaaattcatctttttttcaaattattatgaagtccaacaagtatttattgaacatctactctgtaacaagtctttattaggctttacggtcacatgataattgggtgttacttttaaatgtctctgagtttagccagggctaccaacaaataaataggtaattccctctttaaatgtaatattaatgagaataataatattgggactagagtgatgtgagagaggcactcacctggggcacaaaactgaagtgggtgccaaaaaacttagttatcaagataaatattttaatgtgatatttaacaaaataaaaataaatgtaaaacatccataatgaacacaacaacaaaattctaaataaagacaagatctgaacttgtacttgaaccactcacctcacttgcttcaccctagttccagccctgatgaggatgatattcactgggtctttactgtgttcctggcagacttaatggggtctggcactcactacttacatgactgaccttgagtaggttacttaaccttgctggacttcagttttcttattagtaaaagagttatagtaatgggatctgccttgtagggttgatgggaggatcaaaggaaatgatttatgtaaaacatttagcagattgcctggcaaaattaggttatcagtaaggattagttactgtgattaagctcagaagggtgagtacctggctcaaggtttcacagatggtgagtggcagagctgggatacaaacacagtaggttaaaataacagctgccccaagcagctaagatacatccagggtgtccttggagcacagaggaaggcactttgcttggctgggaggatcctggaggattgtgaaagactttctgaaagtttgtcagccatcctccttgtcatatgttcctgggtggccatttcaattctatgagttattccaagaaatcgctagaattaagcttcatgaggacaaaggcttggcccacttttgttcacttctgccccttaatacctacaacaatgcctgacatgtagtagaagctcaataaatatttgttgatgaatgaatgagaatgattatcttagaaagctaatcattaaacaaacaaactctttaaacactggtttcacctagatcctaatttttctaggggcttcacagttgccatttggagagagagattgaggtaagtaaacaacacaaaatctattcaggaaaagccctgtcagattcttgcagagtagattctaacatgaaccaaatgggcaacataacaagttgtagaaagtaagaacaccatttccatccaatatctgactcaccttccactaacgattgttatatctgcccatagtatgttcactatagggaacataacatctttgatgcagagtgaaagcatgttccctgtgtgactaactcattgcagaaaacaaatcctttttttctcttttttttgtttttttgagacggagtttcgctcttgttgagtaggctggagtgcaatgtcgcgatcttggctcactggttctgaggcgcaatctgcctcctgggttctcctgggttcaagcgattctctgcctcagcctcccaagtagctgggattacaggcatgcaccaccaggcctggctaattttgtatttttagtagagatggggtttctccatgttggtcaggccagtctcgaactccagacctcaggtcatccacctgcctcggcctcccatagtgctgggattacaggtgtgagccatcgtgctggcccaaattcctttctataaaaaatgcaaatctatgatatgaaaatcaaacagcatcataagaataaattccccaatgatagaaattttaacagctagagttgctggtgtgaaggtcttaaatcaacagaatcaaaatcagtcatagacttcacatcacattagcaacactaggacaaaagggaacatccagtattcctagggaacagtgagaggagccttttcattgggtatatcaaaacgtagcatgctaatttgattcttccttcacagacaaaaggatggctacttcgtgataagttctatttactctgtcgtcccaaggtttgattatgttcttaagagagattaggaatctttctggataataggaatcatgaggaactcatcaacttgtataattttgtcaagaaaaacatgagaggccaggtatagtgggtcacgcctgtaatcccagtgctttggggggccaagggaggaggattgctcaatcccagtagttggagaccagccttagcaacaaagtgggattccgtctctagaaaaaatacaaaaattagctacatgtggaggcacacgcctgtagtcccagctgctagggaggctgaggtgggaggatagattgagcctgggaagtcaaggctgcagtgagctgtgatcacaccactgcactccagcctgggcgacagagtgagacgttgtttcaaaaaagaaaaaaaaggaaaagaaaggtgtagtcactggtggaaccatgtataacacatctggtaatgtatttggtcacatataaaatagccaaagagatattttaaagtttaaaccaaagtacatgtaaattttttttttttttttttttttttttttggagatggagtttcattcttgttgcccaggctggaatgcaatggtgcgatcttggcttactgcaacctctgcctcctgggttcaagtgattctcctgcctcagcctcagcctcctgagtaattgggattacaggtgcctgccaccatgctcagctaatttttttaatttttagtagagatggtgttttgctatgttggccaggctgatcttgaactcctgacctcaggtaatccactcacctcggcctcccagagtgctgggattacaggcatgagccattgtgcctggccacatttaaatttttttaaagttcctgaaaaaaatccttcttgaaagctcaggagatagagttaatcattttcacaaggctacaaaaaggattttgaagtgatgatatggcaagatcatgtaataaatttattgtgcatatttaataaacgtaaaaggtataaaaattacacagtggacatacatagagtttccatctacctccctgcctagaagtaagtctctgccagtcctgttgaggccctgtgcacctcccaactgttgcttctgtcttcttcccactcaccatacaatgaccattttctaaattgtgtataaagcatcatcacatatatccttataattttactaggcaaattttgtataatattgctctatgtgttttaaaagtttatacaaatacggtcatcatagtgtatgtattctctggcaacttgctttttccattcaatgcttgcgagagttacccatgttgttatatataattctaggccattccttcatactgatgtatgctatttccatctattattataccactgtctatttacccatttcctggaagatgaaaatttatatttttctaatatttcttgctattacatacaatgcagctatgaaccaccttgtacatgtttccttgtgaatttgtgtgagttctctctctctgtgtatatgaatatgtacatgtatatgtaaaattgctgggtcatagaatgacttcttttctatgtttgaattttcattatagttatagactggtagggctgtatggaacttttgagaaaaatctcctattaattctctcattttataggtgaggaaactcaaggtgaaggaaggtgaagtgacttgttcaaggtcccagggcagttacagaaagatttattgttgccaataaaaattactaccgtggtatttgccagctgatgatttttccatttccacctttccatgtgtgttaattgaaatcttctataaggaagaacttttccttctgggtagattataagtccccagcctcccggttctgccctctgagataatctttgtaaactatgtgtagcataaacctttgggccagatagcttttcatgttgtaagtgtatggacagtggggccagcagccctcatgctatgtaacagcatcacaggctgctgtaccaaggcaataccaagtatcaaggcagacacagacagggttctttccatcatcaataagggggtgctccaaagaagagctgcagattgcttgtgccaggttggtggttcacagctccaggtgatgtatttctgaccttctccctagtaataatcattacaaagtaacaatgtgaaattcactgtgcttttgggaacaagtttgcctatacagctgttctgttagcatctaaatgtacatgtgtatatagattaaacagagtaaacagcatgaacatatgtgaaactgttagaaacaggggcatttttagaagcatgaggctgctaaaaagaatatttgaaaatccacaaaaatacccaatacccgctggatccagacttctttgtcatgaggaactgtatcattaacttctcacgcagatcatggggaaccttggttttcaaggacaatggcaagtacctcagctagtgaaaagcaacttactggaaaatctcatttataatcagatatgtttttattaggctttcatcctgctcgcctgacatatgtcccactcagaaaaatagcagtctttaaaaaagcatcatttgaacagaacggctaaaattaccttcaaaaataattctaaagattggttaccagtcacccatcaccacattgaaaaactttctggtttgtaatttatctgcaaggcatcttttatttgtaaagtgagaaatcaccatttctgtgaacattttaatcatgaaattttttgcaaatttatgtatctatacatgtacttaggaatatatattctttatctattcatctaactcctttgaatctactgaaagtccataaacattaggaaggttttactgctgaggtggcaaatcatcactgtaactctcctcaatttctttctttttgtttttttatttgagatggagtttcactcttgttgcccaggctggagtgcaatggcgtgatctcggctcaccgcaacctcctcctctcgggttcaagagattctcctgcctcagcctcctgagtagctgggattacaggcatgcaccaccacgcccagctaattttgtatttttagtagagacggggtttctccatgttggtcaggctagtctcgaactcctgacctcaggtgatccacctgccttgttctcccaaagtgctgggattacaggcgtgagccactgtccccggcctgtaactctcctcaattttaactccagagttgtcaggcaggggttgcagggtgcacagatgtgtggatgcggtgagtgggtgcttttggtcttcttacagcttgctcaacaggcaaatcatacatctgcaattaattgttacatgcagattctagagagatttctggactttctttgcatacaaacattgaagaggaatagaaaattaatatacagatgttaactccagttattatgactaaagaaaaaaagtgttctatttaattttgaagtgaactttctccctgcttcagactagcactgataatacaagggcctgccaagaacctgagtgaatgacttgtttgatgctgtgcttttgttgatggcacaaataaaaccggcaaaatgcaggaagtagagataagaattactctagatgttgaaaatggcagaagattagagaccacaaggccccagcagtcagttcattcaaaccacaatcaccaggcaaagaagctgtgtaagccatggctagaaggagcgcactccagctgctcctgcattcacttccacacagcccttcgctgctagatgttgctgccttctctcttccccactgggctctgagtccctgaaggtaagaaccgtgtcctatctgcttgtacattaccagcaactagcacagtgcctggcacaaagaaaccattaagaagtgctatttggctacatttctcattttttagtcagttttgatatcatatggatggggatatggaatgagtatatggaaaaattctttgaaatatgtcaagaattaccaaaatatttcctccatcaacctactacaggggctgctgacctaatgttataataatatataatttcaatgagttaagtcatcaggctctgttaaaatataataatgtttgggatagagtaatggcttaagttttgtcagtcattaacaccttattactaatcagtttactttcatcctttccagtatggggttggttgagcgcaggcaactgtggaagttgaggacactgaacatagctggcttttaataaacttttgttgaatgatgaatgaatgtttgcctagcagtagaaacatttgttgagttcccactgtaatttttttaaatgaattgtctagatattaatctaatttttaaaagaattggtcaaactatcacattgaacaatttaaaatagtttagtgcatttttctgtcatcatcagatgctttcgagaaatgctatttactgcatccctttcgagagacaaatacaaagaaaccatcagactgggcattttccataattgctgatgagtgtagatcacaaagagaggtggcaaattttcaatttgaagataagtctgattaatttaggaagccgatcttaaaagcattgagcacccaagtggatttatctgaattattggaaaattatttgcttaaatcatgctctgaggcattgtgtcatggagaactgatcacagacaacttagtgactttggacaaattactcaacctctataagcccagttttccctatttatcagatggggctaacaatatctaccttgcacattgatatgataattcagtatcaaaaagttattttgagaactcattatgtcaggcagtgtgtcaggttttgtgggttccaagagtgagctaaagagtaaggtgtctgcattcatagagcttccatttcagtgctgatacaggaagatactgtaatgcctagaatggtgctgggcatggagcaggcacctagaggatgagatatagcgttatgtaatcacaacctgttgaggatcagtgctaaactgtttattgctacccaatagcaacaacccctgtgactgtattaaagctacagaattttcaacccctggtgcaccaacttagctcaacttcacacaagaagcctctaattgcagtcttagccccaccagactgggtccgagtatcactgacttggagcctccacatccaccctgcactcccagtggtggggcctggcattagctgaattgctaacacttagcatgctaacacaaagtgtgtttggaactagctttagacatttgcatcctcaaatttctgctgtttctaatgcccaaatgtttcctggattggccccagtttccccttgagtactcttggactgctatataactgcagagtaactaagaacattttggagtccaactacttggttcaaattccagatatactatttaatattgtgagcaatttactgaatcactccaaacctcagtttcctcatgtgtactgtggggttaatgagaaaagaaaaaacagctcagagcagtctgagctccttgaaggcccagagagtaatgagtatgggacttcagtcacgctccccactcccctaacccatgcttgggggccactgttgaaagtcattttgtttctgactagctacctcacccactatcttcatgttcctagaatttgtgatacaagagacaatgtaacaaagccaatcaatagcttatgttatgttaatgtaaattcttggtaaacaatgtagaaaatacctttcctttccttttgaaaatccacttgtaactgctgctaattggactgtatatttaaggcaacttgaatccatgctccggggttgcagtcctcaatcttggctcaaataaactctctacttatattaattttgccacagtttctttcttttaggttgacattaataatagtacctattttaataggactgctttcactgttgaatggcataatgtatatataaaggtcctaagtaagcactcaaaaagtattagttgttgtttttattactaatagtggaaggtgcataggtcatctttgttgatttacatgcagataaatagtacagggcatttgtatcatccctttgaagttataacatttgtaattttagatctctctgcccactccaacaagcatcatcttttatggtgcatgttttattaagttttctggctgagtgattcctttttttataaggtactttacattgtcaaagctctttcataaaattaatctcttttcactgccacaaggatcctaggagattagaatgggtgatatgcctatacccctgttgctgacaaggaaactgaggcaaagagagatccgactctcaaagctggtgaaattactacttaattatcaaatccttattcactgcagggactcagaaacaggcacagaaatcatttcagaaagttgctcagcagtaactggaaaacgttttcagtgagttggaaaatcagagtgaatcattaacccccaggctcaggttgtgaaacttagaaattcacattaaggattttgtttgtttttgtattttaatcttgtgaattctgctttcatatgccatttgaatgacatagaatcccaaggacacacaaggtctttagaaattaaagtcataagtttttgtggatgttttgaaagcctttccacatttccatgaatctcatatatttttttccttttagagcatggcaagaaatcttgcctctaggaatgagtcagaaacctgtctccaaaaggcagggctctaccctgcccagcctggccctttcctagagtgactttctccctctaggggaggaaagcagtgagcttcctttttggtttcttcaactgtatcatgacttttaggttgagtagtcagggcagaagaaccaacaataatccagacttccagaaactaattgtacggggagcctaatatcctcttggctcacccacccctctcctgccattgctgctacacgcagtgcctcagcggtcctgcggatcacatactttctgccctggcacttcacacatgacttcatgtgtgagaacagggatgagacagctgcaggaatgcccagtcatcaggcacacacaacatggaagtacatgagagttaacatcccacagatcaacatttggttgatgaggatggtgggtggcggacaattttgaagtgcgatatatgagacttctcagatggtccctgcaggatcaagactggctgaccatagtggagaacaacaaagaaatgtgtccttcctttcactggcttccctccttccccatttcactgtcccagcccctcactcttattcttggtgtcatttccaaaactaaactacctgaatgcaagcctttatctccaactttgctttgggagaggacacaggggcctcaagctagtgtttaaactgattacagaacacctggaaagagtcaacattatcacataatatatccccaattaaaatgacaatgatttcttgattcttccattagagagggaagcatggtgattgaagaaaaagccctgaaagaggaggtgtgggttccagttttaccaataatgagttatgtgacctaagctacgctatttaaccatttggacctctgtgcctgatcagcaaaaaaggagatgaattggattgcatcatttctaagatccttccgattccacaattgcacatttattaaataaaaacatcggggcgacagtttgtagtagctgctttccctctcattataactctagggattgttctggctaaaaatatggcaatattttaatgcaactttagacaggcaagtgaatcaatcctctgaaagtctagattagagaatgggcagctattcagaacctcaaaaaacaataatgctgatgaaaagagaacaagccagcttctttgggagtcagcaaacattagcaggggctgcagcattaagataagaacagagtaatgagaaaacgagttgcaaccaacttcgttgactgcatgccagtggtcactcagtgattcgtcaaatccctaacagagcttgataaatggactctgagtgttgatatttttttttctctctttagaagttacttggaaagatggcttgggaaaattcttctactttgaggaaaataacacaagatcctgcaagtgtcagggacaggcaataaaacattaaaaggatacagactttccataaatcccaaatcaaggagcattaatccagaaaatagatgaaagatcatgatatttaagtcaaccaaagggccacaaaacatgcaaaataaataggttataaagcaaatgaggttgtagatgtcaccatttctaagacatgacataggtactgttatctccattttatacttgaaagaaaggctcagagaagtaaataatttatctgatgacacacagctaattagtggcagagctgggattttaatttttaagtatatattttaaactaattaaaattatatttatcaaagtaatacatgaacatagttaacaaatcaaatagtactaaaagagatacaatgaaatatagcagtgttttctattttgctggcttttgtccttggcctgtgtttcctaatgctttcatttgattttttttattttggctatcatgttcttaatttttgaaagtgccttctttttcatagttgctcctactactatttttaaaaagcatcctgttcttgtttcatggatgcaatatcttagctctctgagaattctaacaacagtttttagttttgttttcttcctctccctgttttctctgaatttcattttttttttctgtttgtttggcctctgtctttcctatcggatgctgaaaaaatgttctgtgattcttggttttctgcatgtaatagtaaggtattaaaaagctaaatgggagttgtgtgtggggggggaggggtataattgctagataaaataatttgtttccgttaaaaataattattttaaaaatattttattgatacataatatttatacatatttattgggtacatatgacattttgttacatgcacagaatgtgccatgatcaagtaagggtatttaggatatctgtcaccttgaatatttatcatttctatttgttaggaacatttcaagtcctctcttgtagctattctgaaatatacaaaaaataatttttagtataaatatgtcccaaatgtttcatgggacatctaactatctattctaaaaaagtatttattgtttatctgaaatttaaatgtaactggactttctgtacttctacttgctaaatctgacaaccctgggtgtatggcttatagactcctagcttctaagtgcttggctatggcctacaggttttcaatccagagactggttccacttaacttaatctcttcttctgagcactgtatctcattcccaccctgtgcctctcctcagttcagagctcttcattttatttctccagaggatacatttctggccttctaaaggtagaataaggggagtgacctggctgtgttagtagaggacttcctgggtgctaagcattctatatactgattttctagcaatctctttgagcttttcgtgtcttaagctttgaacatcccttacaattgaacctaattctaactgatgcaatgccacagtgcttttcaaagggagtcatttcaaagcgaatggcacaagacttcctagaaaaagtgacagaagagacagatcttaaaggatggtcagtcaggaagatggcgagtggaggaacaggattcgatgtgggaatggtgatacatcagggcacagggggcattacacagggtgttccaaagggtaatgcgtagactagtctggttgacgtagaccaatcatgtaggggagaagtggaaggtaagaatgaaaaaaggttgggggcagattatagagggccttgaaagtcaaaccaagtttagaacttcctttgaaagcaatgtggacactgaaggtttttgagatggaagctggaggtctacagtgtgaggaagtttggagtgaagaatttcagagtcttctacacacaggtcataacataaatataggtaacatagaaatgaggccaggggagtggtctgagtagagaaagaagaacatgtttcaagagcttatacacaggagcaaggagaaaagaaacctgccaaggatctagaaaagaagagagaaaggcagctggagattgggcaagcaaggagagtagaaattaataataactaactaaaccttcagatatctcagagaagatggaaactatcaaaaatgagtacaggccattgaatttgaggaaagaaatgtctctggtgacctctgagtgtacaattttgatagagtgcggagatggactctgctcttcacggtgtaaatgggtgttaggaaaatagaggtactaaatgtgctctgtttatttaaaaaggtagacagtaaaagaaaggtaaataaaaaagcaattaaagatctccatggggtcaaatgaaaaatttttttaagggagtgacaggctttggtctttaagataggagaaaattgtgcaaatgagtggtggaagaaatttccaggctgctaagagagatggcgcctgatagagcaggtcccactggaaatgggagggtgcaatttccagcttagagaaaggcctgaactttggtgaaaaggagagaaagcccttctaagaaagagatagaaaagaatcaaggaatgaactgttgcattgctagttaattttccatcactgaatatttttcatcttcgttatcaatgccattatacagctgaccagaagttaacagtcttaaatagcaatattagctaggatctaagataaaaatggccatcacttagtttcagagttgtgtgtcaaacaagctcataaaacagaagaaaaatagaaatcttgtgactgtagtcctgactctcttggcttatacacaccactttaatggacttcatttatatcagagagaaacaacaacaaaaaaagtttagctggtttacacattgatatcaatgctagaataacaggtaacctccagtgtagacctggagattagttacaggatggaacttccatttgtcaaacagatcaaatgccaatacctactcaaagtacagcgtgaggtctgttgccaatattgactgcttcaaaagctgcataaggtcactatattccttggaggacaggttagcaaagatattgtgaccctgtaatgagaaagtaaaaagtcacaaaagacattaaatctgtggttgttgattacatgtttttcctctatttaaaaaaaagtctgggaacattaaaaaaatcactttttaaaaagcatagtgaaattttgtataaatataaacagattctctggcaaacctagcaaagccagaatgcagtcatttttgacaaagtctaacaagggacactttgttacatgcttagtctcaaagggaaaatctgaaattgttggaacttatcttactatgaatatgttgtgcccacaattccatctgactacccatttcctatggaattacttagaggagaagtttgtgaaacatttgggaacatttctccccctaaaataaatgctattttcactaccagtgaaggtttaagctggcattttggaaacacttgctatggcaacaaatgactttaagaagaataaaaagccattagaacagtggttctcagctgggggccgttttgacaatggggaactttagcaaggtctagtgacatttttgattgtcacaaatggctaaggtgctactggcatctagcagtggaggccagggatgctgctacacatcccatgatgcacaggagacccccacaacaaagatttactggcccaacacgtcactgctgctgaagcggaggaaccgtgcctcccaccattaaggtgcactttgatgaagtgtgtggcaggctaaattcagtatggtgaatatgaataattctgaatagctaggatgcataagacatcgttcttggcacagtgggactctaaaatgacgtttacctaagtaaagttaggatgacatctttatcctcatacctttgacaggtacccttgttttcatcaaaatttgtgttagctacacttaggctaaaatatttgtctttagtaaagtgaaaaatccttctgtaaagtgaccaacaattcacttagtttgtttttaaagtcaggacttttcattttttaggttttcttagtgtgaaatatgaactcatgagcatctggcctgggaactggaccagttttaaatctcgtgttgagagccggaagatgctggagaaggaatgtggtggaatgactgcctgagaatgaaccattctccagtgagaggtaaattaattatttcagggaactaggatatcaactagcaaattacgtcttaccaggcaccagatgattatctgtttccccaagttaatttatttcattgggtgaacccgccactccttaaagactagagtatattggttctacctgggaccaggtccaatattaataataattttcaaatgagctcttcagacccttaattcagctgttaagaagaagacaaataacgaaaggaatgctgcaccataattctgcccaggtttttttgcctgtgcattacccaatgatcaatcacaggcaggtgttctggggccagagaaaaagtggtaggaagctatggaaaagcagtcacctgggtccagcgatgcacccagaatctcccaaagaaacacagcatttaagagcaagttacagtaaaagttaacattgagatatgaagaaatctggtctgaatttgaggatgtggattattttatgaggatgtgtgttttattacagtcatgcatcacataacaggagggtacattccaagaaatacattgttaggtgatctcctcattgtgtgaacatcacagaaagcacttacacaaaactagatgatacagcctactgcatacctaggctatatgggatagcctattgcttctaggctatacatccatacatcatattactgtctgtaacactgtgagcaactgtaacgcaatggttggtatttgtatatctaaacctatttaaacatagaaaaggtacagtaaaaatatggcattataatcttatgggaccaccgtcgcaccaatgtggtctcttgttgatcaaaacatgttgcatgtgactgtactttgaaggatatataatcactaatgctatttacagctaagagtgacagtgctagccagaaaaagttaatttgcaatcagtttattgtttatatgcaaattagtcttctattttcacgttatgtgccttaacgttttggtccctgaagtagatttgagtctccctgaaatactgcatctactctttgtttagggaggtggtgagtgtggtgttaatggaaagacatgcagatctggaggaagaaaggtctgggcaaacttcctcaagctatctaacttctctgcaccagagctcatttggaaagtggaacaataatagcacctgcatttctgcctttctgatgggcaggaccacaggggactggaggcagtgctgggacagtgcatggttccgtcattgatagtctctgttcttcatagggaaccccagagtgaaggacggccaatgtgttttgtttgcatgaacacaaattctgagtgagtggggtttgtttccctgaggaaacctgacatcctgtttataatacttgttattacaaaggtggtggtttgtcagaggtgtatactcatcacctttaccaacacagaaaagatagtttgaaccaaagttcttccatagttctcagctaagacactgtttttggagggcaattccacagccacagaggccaggatgctggcttctgccagttactgagagcctaactcttggtgtttaattcccaactgaaaatacatcattcccagcaggttttccctttcgcagtctgcattcaggttctggagtgccaactctcctttatggggtcgaaggcctccatgatattgcaaaagacatgctttctcaagataggctggaggtaaaaaacctccatatttaatgatgctattctagtgaagcagggccttaatgatgataataataataataattaatggcacagctagagaactgacaaataatggggaacagatgatcccttcctggcctcaaaaaaaaaaaaaaaagtctgtacgcttgcagaaaatgaaacagatcctttcctggcaatttaaaactcagatgccgcagccagactcagttagtggtttctgtttttctctgtggagagctaaaagtataaaattccaactacttctaactcctgcattgccacatgaagcaaaatcaggcatatggcattagctctgggtcttaagtttagctgcagttctcacttcctaactggtcccaccagcaattttaagttcttttaagttgtatagtttctcaattgtgctaatgaagtgtaactttctcactctgtttttgcttctaccatcttttaaaatgactgagagttttaccaaatgggaatgttgggccgctcattatttggatcaagttgttcccttagtgctctgtatcctttgaggaaggtcaggtcatgctctggtgacaagcagtctatatctgttaccctgctaagtgaatctgaaaagcctcctaaccaataatgaaatccaagtaaatcagctcaggaagactctgcaaggtcctgctcaggcatctataggaacagaaaaagctactaaggcccattaagttgacttagaaatggttttcccactgctttgtgtctacctgtggcaccacaaaggaagagagggaggaaacaaagagttgttttggtttctgttaaggggagaagcagaacatcaggcctgtacctcactttgaaggatcatcacggcgtggttgaaatggtgatgctccaaggtagcagaggttccatagagttgggccagggcagagccactcctgaaagaggacagagggtgagtgagcagggcctatcgatggttcccccacaccagctttttggatcaaactgcttttcttgcttttggcaaaggaccatgagcagacacatccttaggtaactgcttttgtagtccattcatctatgaaataaatcgttcaggaactttctatatataagaaagttcctaatacatagaactttctatgtattaggctagatgctgcaaatgatatttgatgaatttgacacagtctctgcccctaagaaatttacagactagtaagaaagatgagatgagataacaaggaaaaataatgcacataaaaacaatgcaaatactaatcactgtagaaatgtgttccaggtccaatcgaagtgctatggacgttctgaggaaaaaaagacataatttctggctccggggatcagggaagcttcatgaactaaaccttctgtgacttctgagtgttcagaacaactgtcttatacaaaacgtatttgaccttccataggagaagaccttgtgaatattctgcagagtgcattttatctactctacatgaaaggctgacagccttctactacagctttccagtccatagtcacactgtgatatctcagtgtggaactctgaaaagttctctggatttggagggaaatctcagctcttcctccaagtagtagctttggacggttacttggcctttttaagactcagtttctttgtctctaagattatattatctacctaacctgttatttatgagaacaataaaatatttgaaaatgcctattacagttcccagcatgtagtagattgtagtctgtattaattattaatcaataattgaaacacatatgactatttccattttaaattagttaaatactcattgatacttaaagggattactttgagttatctgtaaatttcatttatgtagaacaacccattccttaacaatgtcagttctgcaaagcgttcattacttgggagtctgaggcaggagaatcactcgaaactgggaagcagaggttgcagtgagctgagaccatgccattgcaccccagcctgggcgacagagtgagactccgtctcaaaaaaaaaaaaaaagttcaaaaaggttcgtgtccaactctgtttaagaaatgggagttagagcatcttaagaatcaagagacatcccagagaagcccacagtgtaaacggcagccatgggactcaggataaggatccatctagatcattttgttctttcttgcttattgcagggggcttcgatattgaaagggcaatttggccttaacttggaaatgctggagattgattgcatacaatctgtcctgctagtgagagaagcaaggactgcatctaagtgcaacatgaagacttttggtcccaagctttcctccaacttcagtgggaggcagcccaaaaccaccgtcggttcaagaatacaagtgacctgcaattcttggaaagactcccccaattcttctcccaatatgtggtcagcttttccagcaggattaggttcggtaggaattattgaatataatataatataatgtaaaatatcggaattatttttcttaggtgcttagtaaggagggtattagattttaatcatatatgtgttatttctttaaatcttgccttaatttatattatttaataagtgaagatttgctaggcgaatcttagtgataaattaatacttaatgttagttactatttgtcttacatagagttcatttctatgaagacacgtgtttcaaaacgtatactatatgcctttgtcttggctgttgaaattctgtgatgctttatatgcatatcacatcctagagcctggcatagagtaagtgctttaaaaaatattggttgcttgtctaataagcttacagtagttactatgtcgagagattacagttcaagttgggaggttgataataagtgtgttagcatattttataatactaatattattattaataaagctaccattagtatctaccatgcggtagtctatatattaacaacttaatacattatagcatttagtcctgacaatgaccatgatataagtattattttctcatttacacatgaggaaaacagggctcagagaagttaagtaacttttccaaggtcacacagctagcttgtaccagttccagatttgaatccaagtttttaagcttcttgttacataatgaaaatgataattataacatacatttctgacatttgattctccatttttactaagctgattgttatcaatgaaagaagatttcaaaatctaattcagaattctattagtatcattgctaaccacaggctgattcctgtgatcattcctatgaatcagccatgctcacatgcacctcacttactagtgtgaatcttttgtatctagtcaagatacaaaatgttatctcttcccttattcatgttgggttaacagactccacaaaagctgcatcagctagatgatcagaagtcactctgtatcttctttgttttggtgaataaggaatgttttctcctttaagggagtggggatggggacgataacaacagcttttaacaaatacaccatggcttctgaggcactgctccttcctgtgcgtaggatggaggcctctctcccatatccatatgtctccgatctggtgtgttctatctcccagtatttgtgcaaaggcagccactgtctatggtttgaccatcttcctcgtcagattccctctttgttctcttttgtaattccatcttactttctgcccagcctcacacaatactgattcaatcacagaaaataggtagattttgccactgaaccagactaatgccatgaaagtgtggggagactttgttattcattcattcatctatcattcattcaaccaataagcattgataactattatgtcaggccccaggcatgtggaatacaaagagaaataagacatgttctgaccttcaggaagctcacaatcccctataattgtgtcaggaatttttctctgatcaaccttgcactaaaaatgctcacttttctgcaaacaaggtgccatcttagccctcagagaatggagcatggtactaactcaactttgaggggtttttttaaagtaaaaccatctaagcaagaatacttccatttccaaatggatcccttatttacactattagatttggcccctggcagattttctagactgccaaagccctcagtgccttttgtctcaggccaaggcccattaggaatgctgcctgtatctgctgttacacactgggaacttcctgggaccaccaagagccaagtctacagtcttgatataagtggcaaaaaaaataaataaataaaacatatctgtgaagataagctttatcaaaaagtattctacagaatactagttcttctgaatgttaaatggcattaagagaagaagtaaaaagggttccgtggccaaataagtttggaaaatgctggctttaaaaagtgaatctgtttatttatggtaaggattttccagaggcggcaatatgtgaaaatgcattgtgattttgtgggaggggaacataacaagcagcattatctacttttaattgattgtgaaacctctttttttttgagacggaatctcgcctgtcacccaggctggagtgcaatggcgcgatgttggcttactgcaacctccacctcctgggttcaagcgactctcttgcctcagcctcccaagtagctgggattacagacatgcaccaccacgcttagctaattttttgtatctttagtaaaggcaaagtttcaccatgttggccaggctggtctcgaactcctgaccttgtgatctgcccgcctcggcctcccaaagtgatgggattataggcatgagccactgtgcctggctgattgtaaaaccatttttaaagaggtcatgtctctcacataatacacttccacttataaaggtatgcttctactttctcacataaaatatgaaaaaaaaaccctgagatcaatcacatatggaaaaaattgactttaacagcacacctcattttaattgtttgtgctaagtatatccatcatataagtgtctttggggcacacatcctttagttgtgaaaatatgattatatatacatagggtgtatggagagaggaagagaagagaatccaaattccataagtacaaatacctttatacatgtaagtattcatgatgtgcattattgatggtaggtcatcttaacatactaaagcttttcattttggataggcagctcaatgaggagaaacttattaaaaagaaaagtcaaggtggaaatttccctataggcatttggcactttgcacaggcaccaaaaatgtgtgcaaatgtaaatgtaccttcataacttccctagatatgcatattctttgaaaaagagactgaatggcagtgtgcagctgtgacttaaaggaaactttaaaaaggaaaactatgaaaggtaattaggaaattgagagttgttgggagatggtgaggaatgggattaggctgtcatggcagattaatgtgccccagtatttcacttctgggacctggccgaaagcgacaagatgggttttcattcccaagaaatgagtataagagattatgctagaaatgaatagaagaagtctcctaggagaatatactacaaagctgcttggtactgatatttaatcatcaggggcagctgtaatagagagaaggatgagtggggaacgctgtccctagagaaaacaggggagaggtgtgaacagagcaatttcaaagcactgtggtattgctgccctctctacctattgatcattcattgtatgcactccaatacttaaaaattaagaacaaaatatgaaaatgcgaaggatcacttgtcagaaaggctaagagaataaatcaaattgtgctctaacgaaagccacactttttattgtagaggcattttgcattttatatagtaatttgtcccttgctaaatgtctcctgtttttttatagccttatatatgaaaaaaaggtagcatatactttgctgcataataattggtgcatttaaatcccattttcaaatcacttcaaagactagaattcgactgggagcactttaagagaagggatgtttgctatatctctttatttctcccacaattcctagcacagcatcttgaatatagaaaatactcacttactgggaaataaaaaacaagaaaagaagataggtttcttgcaagggattttctcaacaatggcacactcactgaataaatctcattctaatcaataaaaaggtagttccttgaccatgatgctaaaaagcctctttcagcattcatcgtcaagggaaatcttaacggaggttgggtaatggtggcattaagtgtcctaagtgcaaaaatgactccataaggtaggtgcagtgcccctgacatcccatgagctgataaactgcgtacaaagttaattgtcttgagaaaaacgcatcacactaccttggaataggcagatttgatcatgtgatgtgaggatgcaaaaaaactctctgaaatctagtactagtgactcaatacctacctcatatgtgtgaatgttgttcagtcttatacaagcaacctgagatttggggacctcggtttttgtttttttttgtaaaattgaggaagtgtaaaacatagctagtaaggtttactttggttttataatttttatggcttcatgtctttgaactgttggatgtcaaaatatattttagttcaagagctcacatatctggaaaggcagccaataaactggaagctcaacaactcaaaatagatgtcacaaagtcatggaccagagtgtgatacagtggttaaagaatggcttctgaaaacagacagccctggtccaggctccagtctaccacatgaatggatttgggcaagtttacttaccttcctgaggctcagttcctcctgtaaaatggagacaagaatatcaactctaaagagttgatgttggtaagggcttaagacacagtaaacaataaataaactgtagttcttctcattgtctcaggaagtgttagttgcaaagaacagaagtggagtacaaccagcttcactaaaaggaaggctgattgaatgataccaggaactctgaagtagcccaattttcacaagcatggctgggtctcctagaaataggaacaaggatggagagagccaggcatcaagcctgtcttttttctgtctttctctcaggttacacagtctctccgttctgcttctctttgaatatcagctccatccttctctcctctttgtagactggttttcttgtttttttcatccgcttggtatgtggtcatcatagcttttcccaaatggcagcctcagctcccaaatctgcatgagcctgcagcttggatccctgcagctaactgtcttaatatcacggtaatccaactccaaattcctgtgagataaaatccgatcggtccagctttgattaggtgtgcactgttggtcccaacagctgagggatcaactagcaagaagagcagcctctgtcagcgccatacaccagctctctctctggggaggggccattggtatctgagtataagtattgggcacttcactcttgaaagtactgaaaaggctctgactcttgttttacagacacaattctaacacagttatcccatctttctgcataagtggtagagtggtagggggctggagagagcatgctagagggagatacagtgatgatgataccattggcctgggggagagaggaatcctaaaaaagtaatgcagtgcagacacaagaactccaaacaaggagcaatcggaccctacaatgaaagcatacacaacgtacacaatgggctccagctgtttagtgcagcatcaagacaatgtataaaacaatgtttcattgcagctctattcacaatagcaaagacatggaatcctaaatgcccatcaatgacatttgattgaattttaaaaaatgtggtatatatacaccctggaacactatggaacactatgcacccataaaaaagaatgaggtcatgtcttttgcaggaacatggacagaactgaaggctattatccttagcaaactaatgcaggaacagaaaaccaaacgctacatgttctcaattacaagtgggagctaaatgatgagaacttatgaacacaaagaagaaaacaatagatactggggtctgtttgaggcaggagggagaagagcagaaaaggtaactatcaggtactgggcttaatacctgggtaatgaaataatatatatttaacaaacccccgttacacatggttacctatgtaacaaaccttcacatgtacccccaaacctaaaataaaagttaaaaacaaacaagcaatgttttataataatttataagaggttgcatctgttaaagaaatcaggaaactttgttaaagtgctgtagttaaagatatctcatccactcatgcagttatcctttgttcattcaccaaacatttattgtttattatgctcccccaagtactgtccatgcactgttgtacatgccaaataagaagggaagacacatctgcaagtcagcaattaaaatggcatgaagtgcacactttggaaaaggcacaaccagggcataggaaattgaccatgggggtacattagggtggatagaaacacgaaggtgatgctttcagaggagttttggggaaagaaggagagaagggcatgccaggcaggggaaacagcatattgggcagcagagagatgtgactgagcaggaccccaccagtgcttcttggagtccctgtgtctggaacatagatgcatgagtagggtgagctgcggcgagtgggcactgggccagggaaatgggcaggagtccgaatgaaaagggcccgaaggggctaagctaaggaactggaacactattctaaaagccacaggagatgtggatggcttttaagcaggggagtgacctggtcagctttgtgaattagaaagattattctggagtgccaagcagcctcgggaggagagtcgtgctgttcgttgtagcaaaccaggagtcatgccaagaagcagtccttgctgtaagcatgcagaggaggcactggctttgaggggagctgcagggtaggctgggtgactggcgcatttttggtggggccattccttggggtagagaatacaagaaagaggcatggagggaaagactgaggttgaggggactgtaggactttgaagaggaggtcttcctcaagcaatggaataagtgcctggagataagctgggaattatggttcaaagaaatgtattcagggctcatcagcagatggctggtggccctgcctgaaggatcgtgaagagtgagagaggaagagggagggcatcatcagtgaaggctggggcagagggacagaggcctgaaaccaacggagattcaaggttgtacaggtggatgaaaaccctttgtctgtgagataaaggaagagagagtttcaggaaggagggagcgacaaagtatatctcatggcaagaggtattatgaaagaaggacaacgaaaaggtccgacagctttgagaaaagggggccacgggtgtcattcctgaggtggtttctccaatgattggaaccggaagccatgtgggaggacaggggttgggagaagggaaggaagtgaacccagacagctttccatgaagcttgactgggaaggaaagaaggaaatagaactgaagctggagagtgaagtggggattagggtaggcttttttcaagatgcgggggagctgtttctattaataggatgcagacagccagcagaaagggacagcagatacaggagggagaggaagattgatggcacaaagtcccagaggagaagcaaggaagggtccaaggcagaggtggagggattagcctcggacgagggaaggacagccctcttaccgagataggagggaaggagggaaggatggggatggacagataagtttgtaggtggcaggggaggaaattgagagaattctcgattgatggcctcaattttctccgtgaagtaggaggcaaggtgatctgctgagtggtgcgggggaggcgggggagcaggaggtggttttggaagacacaagtttggtatatgaaactgctaagagcaatggggaatggggctggctagggacacagaaagactggcagcgagttctagcgtccagccaagtgggaggaatatatatttggtatgtctctaactctcacaactgtgacattttctcctaaagcttttataagtctaggcagagtagcaagagactgaattgttagactgaaccaggactgagtttctgcagagtggatgtcacagagacttggtcaggaaatgataggatattgagaagagagcactgaagtgatgggctataggatacagattggacagagggcacaaaattgaaattcatctgctagatcaggagtaaatacaagagtccaagactcctgaagtcttagtgggtagatgtttggaggaaaaaagagaatgatgagctgaaaagaacctgttgacaaagagcagactgtgaaagtttcagataatagaggctgacttgttctagaggctgtgaaatcagtcatctgaagttaatcttacctcttcgttgaggccttctctactttccctaccccaaaacttttctctccagcctctgaaagcctctgtcttttgtttgcaggcagacagtgaaagaaacattaacggcagactctcaatatacaagtcaggagacctgggttttggtcttatttctagcacccataagttctgtggccttggccacagtatgagccacaaagcaacagctatcttgaccaggaaaacctgcttagggacagattattctatctatacacatcatgtgtgtggcaaatagttgcccagacatccctgtatttctgtaattcctttgtttcttccacctttctatgggagtagggaatgggaggagcaaaaactatattccttgaacgtggctttattttactatagtttatataatacccaacatcaaaagaatcctggaagagactctgttggagaaggaaaactatattttgcttcatcaaatttcctaagactgcttttattttaacagtctcacaccagagtttgagagtagcaagtccaagaagcttataacgccataaaggcaaatattctgggaggaaaaaagtagaccctttaaaatccaagctttgttatctgagtaaggtcaacagagaccgaccaaatcaacaagcatgacatgaagggcaaatctgcaattaaaagaagaatagggaattataaagatggatgggccccatgacatgcacgcccaagcctgcatggccttggcctcggatgccagaaattaatgctttactctttagcattcgtcacctttggctctgaacagaaaggcaaatgcattaaaataacaacagtttagaacacttacttagcttggaaggcattgttggttcccctgtggtcgaggtcatgacacaggcatcccacaatcaccgctaaaatttccacctcggtcagaatgtcttgaaacccagcagtctgggaagaaggggaaaatggcaacagtcactactggggtacggaggatggataaggttaggtgctgagcaacagtcaactctgttttcatacccacatcatttaaggagatgattaactgccactccctcagacaacagtaagttgggtggtcagttgcacagcctaaggtccccacagtgatgaattagcttgctgtcacagcagcccacgctgccacactgggacatagttcagactattttgttccctttttagagagaaggttggactatccagagacagtgacagtttagcaaaggcccagggcaaaatgtgttttgttattatacattttaatgatgagcatagggtttggaggttggaggttggggaataggaaggggcagtgaattgcaaagtgaacactacacctgccagatcccacccaaatgagagcaggcagaaggagaacacaacccttctttttttttttttttttaacattaaaaggagacactttaacatactcaaattgttatacaatgacatcctagaggttatcttgtaaataccctaattcatattaggttggtagacagatgaaattcatacagataataaggcagtgcatgtcatggacaccagaatttgtcagaggattgtcaacccagactgaggattgagtggggtatccattactgggaattcttttttcttatcttgtggtagcttgctggtgaaatgcacagctgtgatgtgatttcttttagaagcaggttgacataattatgtaatcaacagcagcaatgcttcttgggttgctgctggccctttcattagtttagaagaggaagtggacctctgggaatgcaggtctatgcattttcttgatcgaaggcctttatatctccccctcttttactttgtaagtctcccatttcattacttattaaaatctttatcagagagtgggaggagggggaggattagggtacaaattgcttcacttttcatgtgtttttttccaccaaatctaggatcactggcccacacctgtaagacacttctcttagtaaaatgaaaattttgtttttaaattggttatgtttgtgttgcagaaataactgaataacaggtttctgtgttgacaattttattttttttttaggagacagtcttgttctatcacccaggctggagtgcaatggcaccatctcggcttactgcaacctctgcctcctgggttcaagtgattctcctgcctcagcttccccagtagctgggattacaggcacccaccaccacgcccagctaatttttgcatttttagtagagatggggtttcaccatattagtgaggctgggctcgaactcctgacatcaggtgatccacccatctcggcctctcaaaatgctgggattataggtgtgagcctccacgcctggctgacaattttattttaataaatagacttgggtccactgctacatttagaaatacatataacttcatttgtatagcaaatgggaatgttaataaattgggagtatgaaatagtccatgtcaaagcttgcatatgccggccaggcacggtggctcaaaattgtaatcccagcactttgggaggccgaggtgggtagatcaactgaggtcaggaattcgagaccagcctgatgaacatggcaaaaccccatctttactgaaaatacaaaaattagcctcgcttggtggcacgcgcctgtaatcccagctattcgtgaggctgaggcaggagaatcgcttgaaccgggagacagaggttgcagtgagcctgtatggcaccactgcactccagtctgagcgacagagcaagactccatctcaaacaaacaaacaaacaaacaaaaaagcttgtatatgcccttcattttaaaatctgcagttggctgttagtttttctaagttaattttattttacttaaattattacctgcagtaactaaaaaaattcaaattatactgagacttagaactaaaaatcagtagtccctcattattctcctttcttgattcctgaaggcaactactttctattttctttttcacctaaattcgtagttttcccaccatatttcttttcttttttcttttttttttttttttttttttttgagacggagtctctctctgtcgcccaggctggagtgcagtggcgcgatcttggctaactgcaagctccgcttcccaggttcatgccattctcctgcctcagcctcctgagtagctgggactacaggtgcccgccaccacgcccagctaattttttgtatttttagtagagatggggtttcactgtgttagccaggatggtctcgatctactgaccttgtgatccacctgcctcagcctcccaaagtgctgggattacaggcgtgagccactacgcccagccccccactatatttctatatagcatgcacatattattagcacttggttattcaccaagtactcatattgtcctttctatgtaccatacattgttctaagagctttacagccatttaacttatggagttctcataacagtcctgttaggtagaaactattactgtccccagttatagatgagaaaactgagtcacagagaggctaagtcatatgcccagggtctcccagctagtgcatagcagaagggagcaagctcctagcatcctttcaccagaatctgcccttgaacactggcgacgtctagcagcgggtgagtttatggtcaccctcccctcacactcccaatgtgatccacagagctttcctatattaccatcctataaatatcattcaccgctgagccaaccagtatacaatgattgtttccttaataatgtacattttcttgtttcctggagttaggatttctgtgaaacatctaagtcttctcacaccctacacaattctgcaaaatgcttctcaaagcaattttgaagtgggtcagaacggtcacagcttgtttctagatccttcctgtcctggggactccttcctgcagcctgaccctggggtctggtctggattctctcctctgctgccagcagccctcggagcttcctccaccgtcattcagggggttcctccttcccctcctgtgtctggttccccacctcctgcagcccatgcctttctttttcctcatttactccctcattttacaggagcacatctgcaggggcttcatgagaaaaggtcttactgtttttaaacactggaggagttggttgttttcgaggatttgcatgactgaaaaaacatctttattctattctcgtactcagtgtgcctcacaattctaggctgaaacattttcactcagaattttgaaggcctgctctattgtgttctagcttccaaagttgctttcgagaagaacataccattctcaatcctaatactttgaatgttatttgattttctttcttttagaatttcctctttatttctggtgttcagcaatttcacagagatatgctttgggttggaacttttttccccgttcaatttgtgtgttaagcctaatctggagaatcaatttcttcagcacaatgaagaaatttactaatctttttttcttttcttttttttttaaaataattttctcttcaggagtttttttctgccctatttgaatgaaactccaattagttggatactggacttctggtactgattttcttatctcctcttttctgtttcctatataggtctttcctcttactttccaggcataataatatgtttagtttataaaaattttcttgtttgctgctccttgtcttataatagcatgctattcttctcccatggatgcatgatcttttcttgtctttctgaagatattgattataattcttctgaaaatttcttctgttccccgtattgccttttttctctgaactccttcttttctctgtgtttggtggtttctctcaagtgtctgtctggtaacctttggtggtcttttcattcttaagagtaaagcatcacaaaactcactgtgcaccagtgtatgtgggtggtgcctggagattgctgtgtcttatcacggggtgactgtgtggccagctggtcttttgctggagatgcccaaatgtcaacatctaaactcattttctctggactttccaatctgttgcctgggaatggtgtaaacacgtgtgttggcatcctgagaaaagagaactgtagctgtccacctgtgaggatgtaggctttcacttaatcctcttattttgagtgtgcacctcatcctaactttgctttaggttgtgtacccaactctgggattcagtttttctggcaaatactctggttatggcagaggcagggggaaaagtagccctccagctacagagaggggatggagacttaggcactcattgtttccatcactccctcattccacatcacctaattttcatggtatctgaggcctccagttcctgagtctcgttaggtgctgggggtagcattatttcttatgggtaccccttcctccacaccctcacctctgaagacacttgggtttctcttctctgctaagttatgaactatcctcccttcactttctgccttcatgtgttatgagtccatgcaaggcaggatttgtgtacatttctttctctccgtattatttgaggatgatttttgagaaggggaggggggataaatgtattttgttgtcatctctatcatcttaaaactcaaaatgttgagtttggtcttgctaatactaggtaaaacttgaaaagtctatcaagtatgaaataattacctatgatactccagaaataagtgttgtgcaatgatattgtgctaaaatttagagagactttgcccatggaaaagctattgactagaattagctgatgaatcagagcagtaagttagagataatgttaaaataaggtaatttgactagaaatttaatcagtagttaaaatcaaatgccatctaatagatttgagatcaaaatccccagccatttttaagccatcagttatcacccattttataataagatggaacatattttgctaaaatgttccacacagtccctgtcccctgctctgcccagaaatctagcatcttggtcttaaactactggtatcatggatacttttaagaacataacagagccctagactctcttcctagaacattttctataattttataatatcaaagactatggagcctatctctagatcctcggagtagagaatccctgaagtacagcacccacacacagtcacacaaaacatatttacctctcccgacggtgatacctgagttactgaagcagcacctatctcttgactgtgatttaaagctgcctggtaaatggtttctgggagtcatcaggcctgaaaaatgcccacctgccactaagtgtccttttgcccctcccccgccctcatccatcttcctcccagggctatccattcaggcctgcacgtactgatattgagtagaaaaagtcaactgcctgctgaagacaatatactttcaaaagaaaacagagaggcggcaggaagtatattttaatgcatttaccccattcttgactctggtttattcttttattttcaaataaaattatatttttctgctcctgacccaatcattatgggttttattgagctttaatgttaatatatcttctcacctgtattccctcacagttcgtatcagaaataataagcagtaaatacaatatatctaagtaaagagtcagccagggcatataaacctatttcccatgtcaccccctccagcaaagcctttcacctgtcctctgagcaggcctccaatgatattccttcattgggctgaaatgtatactgggataagcctacccccagccactacggcatataataactagaactccaaaagacccaagccagtaagattgattctcagggtctcctggactacccagtaatttctatcattagccaatgtaaaatttaaatcagccaggatgtactctcattttaatgttgatcctgtatgataccagtgaatgggggaatatcatagccagagaaaaatgactgttactttgtgactctgttgaatccaaacaggtgtaaaaacacccataatatcaacactagatggtgctatagacaatttactaatttaagaagtgtcattaagtgcctattatatattgagcactgggtagatttgagaagaggcctgggataatgtcaacaacagttaacttttatagtgcttagtatatgccgggcattttcctaaatacttcacattcattagctcatttaatccttacaagaactctctgagacaggtaactgttcttatcttcccattttgtagatgaaaacattgaggcaccaggttacaagactacaaagtaagagaggtgggataaaagcccaggtagcctggctccccagtctgtgttcttacttactgtgctacacagcccctaagttgaggtgtgggttcagttgcacagcttttaaatcctattgtgatgatacagtgttagataatagggctgtaaagaatcccttggtgtgtgctttatttcacgaaggacgttattcttgagtaggaagagattgatactgcagagccattggatatttttagtttaaatatggctctgtcacatcaatatgtgcttgataatatacagtgctttataagtgaggtttggagagaaaagaaagatacaatagtttgtaatatctcaactttataaaatgtttaaatatatgtataggaaaaagactgttaagatgtatatcaagatattatcagtagtggaattacagttggcttaaattttttcctttgtgtctaaaatttccataaagaacatttgtttataagaacatctatatttatacacgtgtatgtatatttgtacattcttttttgtttcaagaattagcccacacttcatcaaactgtcccagcttgaaatgaaatagtgatattctaaaaagtgtccattcattcattgaacaaatatttattatttactgatttcctggcactaggaacagggcagtgaagaagacagccgccccttgctgcacatagaatctggttacccttcgagccagcagagcagtgccacagagcactgttttctaaagagaagctgtcataacattggttgtgctttgtggaagacagaactggtaggaatgtccagctcctcctgcttggtttctggaggaggtgcaccatggactgcacacccttgccatgtgtgcagtcctggctcagcaatctgagaaaatgatgccagaaattctgctctcacctttctttttgaacccaactatcggaagtattgaatgataagggatttcctgatgagttcatcctgttgattctgagatgtagcagatggcaaactaagacagagggaatctaatgatgtactagaaattcctaatggttgcagacaccctaaagctgaagacagtaggctccatatgctccaccatggattctgatgtccaggcactgcagcagagccctaggtggattggctaaggttgagggacaatatgatagattttggagagtctttcttcctcttcttcatctttctcactcttttggaaaagaagaggaaaaagtacggctcagacaattccaaggggttggagagacatggtttctcaaggaggtgcctcctctagaagagtctgcacaccatattcctaatctgtgtcatcgtgcctttgctgatctatagatggcttgaatttgaaggccttatgagcttggaacagaaaggcagtatttacagaagaagcatttaatttctggtattttaaaatttctggtacgtagagtgttgcagggtcactctctggggtctttgtttggtacattattaaaatcacatttatttcagccaaaaaagtgctctttgaaggtttcattgtaaatgccacaaacaagatgctcatatcatcttaacaacaaaaaaaaaggcccaatttgcaatgctgatggctggtccagctctgctgggtcatacttaacatgaagagtctgcttgtgaaacttacatctcctaatggaagctgatggttctataagaagggtgccttcaatcacccccaagttcagcacatatcccactcatgggtggatcacggtggtcagagaattgttagggcaatgttagggctccatgtgcatggacagcaaccccagtatgcttctttttgagaccctattttatttgctttgtgatggaatggcaaccactcaacatatagatcctaggggcagcctaatgggtatcaaactgttttatatgctccaaggcaataatattgagcagaggactatctcaagctttggagtggaagcagatttcaattgcttactaggagtgcttatgagtatttatactactggatgtcgcagcataccttctttttaaaaaaggatcttacctttgtcaatcagagacagtgtgtgatgaaagcataaggggaagaacaggtatgcaaccacaaacttcaatggaggggaaaaaatccctactgagcaaactatagcatctagatttagtggtcatactccctcggcatttacagtaaagtttgtctaccaataaatgggtctgctgaagagaaaagggggcaccttagccccattttgaggtccagagaccagaacctttccagctgatagggaatcaccatctaggaccaacaaactcacatgtctcctttaccagagtatgcaatgtaacaagccaattgcaggttgtctaattattcatgggaacgggatagttttgattgaatttgcttatctttcttttcaagatgaatgcaaccaaatattgatttggcattaattaactattgatttaggcctaactggtcctttccttaccaagctcagagttggaaaaaccttacagtctatatataaatgactttctttcccaaccagaagcttctgaaggcacttactatcaaatcataaaaccttagtcatgttttgggaatatgttgaccctttagcctcaactacggttgcaagtgcttgtgtatgtaagtctcagaaaggcaacacagtccagtacaattacatatgttgcgtagatgtttgatgcatacatttaaaaattggattaattttatatataactttattattatattctattacatttataaccacttctaaggcttaatttttaacctgtttattagcataaatttcaaattctttattttggagagttaaaaacatacaaaaaatagaataccattaatataatgaacccagtgcagtcattgcctaacttcagcaggaatccaggttttgcggcttgtttcatctgtctcttcacatgcagtgtgtgtttgttttgttttgtttgctagcgtatttcaaagcaaacctctggtatctgtcaacactatttcattctcaagaagtcctaatgtggtcaaataaaatttgctcaatatatttctgctgtcttattttgataaaatgtacaaaaagatatacaaataatataaggaaattttcaactaaataataagacttgagaaagtggaggtttctacatcaaaagataataaataaacatagctgtatgtatatagcacatataatgcattttaaaaggaaccaaaagaaaaatatcagattcttaaggacttagctttcaaccctaacaatatttgtgctttatgattttttttgaggacaaggacggtatgttttgtccatgtttagaaatataatttatattttatttctgataaattaccagtgaactgcatataatataacatatggtttatgaccacagaaaatgaagcagatcacttgctgcacattaattgtgtagaaagacagatctctcaaagtgccacagagcccaggttggtgaatttcaagaatttgaggcttcttcaaagctcaaatttttattagccataattcagccgaaactaaacttgagacccatgaaaatttaaaactttttatagctcccaacttaacacccttaggtgccaggtttcagtcccaagaaagtgccactaggaaatcatacaccgtggaaaatggaggctgtgataaatgaccatggctctgctgctgggtctccctgacctggaggatttggctggcgtcataaaacacaaagcgacagattaagcagtttaccaacatcataaaaatctcaagaataaattcactttaatcaaaaatcctatattgtaactaggcagccccagcctcgaaaccacatacatttacgtataagcctatgtccgtgagcaagaggttatactttccctgtaacgtcggacatgattatgttcatacacttttacaatttacatgtcctaagaaaaatacccagctctggctgatggtgcgggagaatttattttcactagaaagggaatgacccataactcatgaatggcagcgcttaaagtgagttatggaggttactctcctgtgagaggaaatggattggattatccttctgcccaattgtatgtttggttattagcacaccaggttcttaattatgtgcagctttgccttttttcttttataaaataaatgtggataaaggcaatgtcagctggaagcatggagtgcctaattggggctctgagatgcagtcagagagaagaaaaatagaaaccttttttaaatgattaaaagacaggagtcttaaatgtaatttaaacacagtattcaaattgattagccccatagttaatttattgtgtctggtgctgatgttctgcaaaaacatttaaaaattactccttttctaaattaaaaatttgccatcttgtaggttacatttgcatgaagattaaagagttggttattctatcatgtagattttattatagtattacaataatgctgccatttattttaaagtaaatataacaagttactacttttttgataaggaaatacaatgtaaaaatgatgtttgatgattacaaatatgattactgtttattaatttatttcagtcagttacagaacaaaacatctagatctctctgtaacttccagtgttacagtctacaaaggaatttgatttctgttgagattaggattctgattattgagtaaaaatattttatttaaaatttcaattggttctgtatttcttggacagggagggaggagtttcagctgtgcttctaagatcttccagaatgaattttctacctcaaaaatcaaggacttttctggaaactgcagtcagaggacagaacatcagcctcaagctggtaaataggatggattttctccctaaacatcccttctgctttctagtttgaattatcaataaaatggtttggcttatctctgaaaataaccttgttgacaacacaaatatggatttaaacacgctacctccacattaagatttaagaagcccccagtaaatgtcagggggtgtcaatgtgtttgctgtgatacttggttattattagtgtttaactgcaattccccaccagcgccacgctgcctgcaccaccataaattttaatgtgatcatgtgctcttctcttttcatatccagtgaattctgcaagatcataatattctatatgaaccctagctgaaccttagtgtgatatgaagaaagaacaagatttcaagcaataatagttgttcaccattttatagctttttttaactggacactgagcaacatggttccttgaataatattaccctaaactaaattcactcattcaattaatctttattgataccctacaggatgcagggcatggctcaaagtgctaatgagtacatttatgggatagtaaagaatactgactcttaaagaaatctttttttttccccttggaaaatctgtcagagctcatacatcatttataaaaccgaaaaaaatgtctctgcaaccttggcaccactacatgccttttattttacagaatacaaacaaaagcagagtcatttccgatatctagtctacatcgtgaatataagaaatatgtccctcatcttttatcatgtatttatagttataatttatttattatgtatgtgcatgatggaatatttgttctataaacttctattagtaaagaaaatttatatgatgatcattcatctgcaggttttcttcctcattttaaccacaaataataactgtcactacctactgtatttgtcagaggaattcaaagtatttgggaaattttaactatctaaatatctttttaaaaacaaagaataacattgaagctttcaaatttataaatgtgaaatttcagaccagaggcatggaacaaattaataagtcattaacagggttcccagtgaataaaatgttcatcattttatatcaatttgcctgtcctacacagtagttctttttttttttaatttctaaaggaacaaaaccgctttgttacctacacatgaacctgaatacttttgcaaaacacaatgctgagtcaataagtttattttccacccgtgaagtgattttagggttaaaggttaggaagctggggcatatatttataatttgcttgtcctgttgtacgtggtgccaaaatttgttcagcagtgacacacaactatgcatttccccattcccagagacaataggcttggaaaaatacacaatcacagatttaaggtcacacggagaacactattattcactttaacagcacggtatgcaaggtggcagtcataaaacaggcccatcctgatgggagatgctcttttccgacagactggttttgttgctatctcttttaggaaaaacatttattttgtggtggggtgtgtacctcagtattccctgtgctagaagaaaagaagcactttcaaggaaggtgggtaaggttttttcccccttttctggaaaccagctgagaaactttgccttggagcgccatctagaggaagcctcagcacacacacgctgtgctttcttagccttatgacatgacccaggttgaatccaatggttggtacatggtgagtttcttttcttttctttcttttttccccccagattaatagagaattttggttctaacacaacccacagacaggaaatatgagatcactggaatggaattttaatcactgataagatcaaaacattgaaaggcttttagaatcttcaggagtgccaaaagcatgagtgcccattggtggtaagaaatagggcatcattttaccataggccgagtcacattccagagatgagaattgatgagcgagttaaatttatttttagctacactgattgagtcgtctttgttacttctgtaattattttcttaattaaaaaattctgattaaccagattgaccagagtcaagcttggagaagatacttacgttagagagaaacaaatgttgacacttttaactgactgtaacccttagttaagttcaacaaaatttaatgagcagaaaatactatcttttccagatgtggctactcaatacaatgtgaaggagaacaaaataacgttgtattctttctgaagtcatgtttttgttttgtgatctcctccacccaccctccttagagaaatttgacaatgaagtctcctctttctgtgttagcatgaatgcaaaaaaacaaaacctaagccttctccaacaatgctgctcttcaagattgctgagcatacttgcaaaaacaactgtaccctggaaatattctgacgatatgagcatccccattgtggtgacatagtttaagaattctattctcttcaatttcttggaaaggatcaaaattgcccatataatggaaatacccactgcagaaaactggatatatatttccttttgctcctaagtgtccactgtgaccctgctgctcttgccagtttcccctattccaactattttaaggtttgttataaaaatctgtctctgtccttgacatttctaactcaaaaatgtcacagccatttctttttccttcattgaacagggttcctacttacttattttggcaattcgcataaatccataggttttcccaaataatgggttaaaaagttttttattgaatgtcctctgtgggccagacatatgaaatctgtacacaaaacattataccttgtttactgaggtaggatatggaaaaacaaaatgaagattttttttttccaagcaatggttgttacttgagctattaagcctcatggttcaaagcaccttcctttctcacttgatggctcactcctctaacggtggatgcaacagaagaatggaatcagtccagttttcccaggccagtctgcctgtttattaagcagttgaggacccaaagcacaagtccctagtataaaagacattctggccccatcttatgctagatgcacatttcagctcatgtcaattcaacatacattttttgaaaacccaccaagtacatgacagagtgcagggtgctggtgtgaccctcaataaatggtggttgagcaaataagtagatgctgttgaaaaaacaagaaatgatctcttccctcagcagcttactctataggaggatgacagatttgtaacttaaaatacacagtagcaagaaagatgtgttgtactagatacagtacagggaaagaagtaattattgatgatttgggagaaaggggaagactttgtagaaaaactggcactagatgaatgccttaaaggatgagtaaaattttaataggcagaaaatgaggcagagttttttttttttttttgagaaagaagcagaattgtctttgttcatttggaccaaaggaaaatgcatttcatttggcgttctgattttgtgtttaaattttagtctgggtgcaaaaatataaggtatttattttatgttggaagagtccaagactcacattctttttttttgtatggcaatatgtttacacacacccacagatatgtacgtacacatgtgtgtatatataactatgaagccaaagaaaccaacatatttaagccagaaaacattgtacttgatgatagtgtaacaatgtagtagaaattatgccaaaaaaagccttatttcttgccagaagaagtaaatagaggatttgtttcaatatttgccacaaacatttgctttgagattaaattccaaggcttatatctgcccagctgcactagatatctccgtgaaacagactggccaccatcactgggttaaaaccccacgggacgagattttaaggcaagtaagccctaaacctggagagtgcgcactcttacccctcttttctccttggcctccctgggcattgtctcaaataagcatcctctcaggatttccatattcctgcgggtgatgttcacacctccctactggctttccaccagccaagagagtcatatccagtgatctctttgttctgttactcaactacatttcctctgcaaaaagattactttaaaaatctgagcatttcttttgtaaaagaacaagtttaccaagaaaaaatactgaacagaagctcaagtaatcattccaaggctacactggcttcaaggggtcaacaatgttacagctttcaagctcagaaattgctggcacatatatactttcataaccagggtaggtaagttccaacataaaatgatcacatggtaatttttcagagaaatggaaatgtaaaggagaaggcctgccagttcctacgaatgagaaatgatcttccaccatcactaagcacacttacggttaacatcgcgaacatcagctgacacacgttgaaggcatgtctccagttgtggtatagaaccatccgatagtttttcctcactgtcaaaagccacctacacagtgtctgaaatgggagggagagggtgcgtcaggcagttgtaagtgattctagtggacccttatctcaatggtgccttatatctgagtaaccctcagtgatcaaaggccttccacaaacatctcttctggttctcacagtaatcccatgaggtgtgcagggcagggattatcatccccattttgtatttgggaaaccagtggttcagagtggctaacacgttgtcccaggtgaactgcttggatcacccaagacagacatcttacctcatagtcaattttaaatttctgtaccatccccagctccatgaacatccggagagcagctgtgatcatggcatcaacgtcgagagaaaagtcatcaaaatgaatgtcatcgatggcaagttctgacaccagagggatgttggctgcctagaaaagcaaaagacataagtcaagccaagttcaccagctttcccaaacccccatcctgctctcctcccctgcttatcagaagtgccacataaatcaggcctgacctgcacttacaccctgatacagctaaactctgagctgtaaatgtcttttgtttctgaactgcaaatgccccaagcaaatgaaggtgggggcagggttgggggcggggggagggaaactaatctgaagataaaatacacgcactggatctagcctgcagaatttataatacagaactgtcaagtttatggaaactgtggtcatacaatatattctgatgcatattacagagcactaaatgcaagaaacatctgggcagccagcagctgtgaattttaattgatgctattcaggagaaggagaagggaatacaccactttgccttgtttcttatatccttatatcctgtagcttgcacgtgttctttgttacacacgtgttctgtatattcagaatgatcgaaaggatcagacagcacatctctggtgggaaatatgttgccttaataaaatagagatatctgaaggtttagcataagcctatgtttcactgaggagatcaattttgctttcttgtttagcttcattctatataaacatcacaacataattacaatactggtcatacatattcaaggttttcaaaacacccatgttaggcaactgtcaatcagctgcccacaaacgagcctaaagaggagaaaaaaaatctttggaaatcatttgtatggtgatttcattgggtttaccatattctttggatcactcttggtaagggagtcacttttatattttcaggttatcagagaccattctgtattcatattcctatctattcactgggtttaaattaccctgacagtaatttatgccctggagctacttactttggctaagagattcaatccaactctggctgctctaagcattccagaaaccacataattaatccttgcttcccaactctatgctcctccataggtggagcttagtttttccatgtacttgcaattaattcaacccctaaactctctatcagttgtctaagtctcttctcaaaatgttcatatgctttgggcattccgtcagtttcacgaataaatcactcctggaacttcccgcatttctccagtctagaccaactatcttataagtctgatgtgtagttttcatcctaggatattccttcaccataattgtggggatgcctttctctctttcttttgtttctctagcccacatctttctctttcttgctttctcctctcattttggtgagacacatcctctaacagattcccaagaaaaggtgtggggtagatttgtgaggctgtgcagtctgaaatgtttttgtattactgtcacatttcattaatagtttgcctaggtaagatttctaggttggaaatcattccattagaatgttaaaggcattgctctttgagctttcgatgttacttttgagaagtcagaagctattctgtgctattatactttgaaaataactcccccctccaactgagtttttgtagaatctttttgcttcaagagttctgaaatgtcatacaaatgtgccttggtgtgagtttattttcattcattatcctaggcactttgtaagcccttttcttttttccccctttttttttccagtgtatctattacaggtttttgctttgtagttaccatgaggcttagctttagctgtagtaaattattttaaaggcttatcattagctataataaattattaagatgacatcttaattttgattgcaaaaaaagaaacagagggaaaaaagatacttaattccatccccctctgcattttgattttttgttgtcactttaaatcttttttaaaaatttatttattatactttaagttctagggtacatgtgcacaacgtgcaggtttgttacacatgtatacatgtgccacgttggtgtgttgcacccattaactcgtcatttacattaggtatatctcctaatgctatccttcctccctccccacaccccacgacagatcccggtgtgtgatgttccccgccctgtgttcaactgttctcattgttcagttcccacctatgagtgagaacatgcggtgtttggttgtaagcccttttcttaattggaaaattatgtcttttaattctagaaaaacattttaaaataagctctttgaagatctcttcctctctttgtttttctgaaattcccttaacttgacctttggactggtttgtctttcttttctttttctttctttcatttctcttttcctttagtttttattttctttttcttacatgtttttcatttctcatattttttcttttcctttttgctctgctttctaggaaatttcttcttactgttgagattttaataccacggttttcattctaagagctcttcttttgtcgtctggatattcctttttatgtatttttaatagtaccctaattttatttcacggatacaatattttctcttacctgcctgaggatgtgaatgacaattctatttgtcattttcttctcttcttataattggcttcactctctgtactttgttttagtctctccttttttattgtggtaaaaatactgtactgtgtacagtacagtagtgttaactatatgcacattgtcatacaacagatctctagaactttttcatcttgcatggctgaaactccatacttattaaacaattccccatttcctcctcctcccagctactgacaaccaccattctactttctgtttctatgagtttgattactctacctcctacaagtagaatcatgcaatattcgtcttttttgtcattggcttatttgactcagcataatgtcctcaaagtttatccatgttaaagcatatgacaggttttcttttttttaagctgaataatattccattgtatgcatataccacatttttgttccattcatcaatcgtttcatctctgtcttcatcagccaactttcaagaaattattttaatacattagaggctttagaaatattagaggttttccttagcggcctgataatctttagttttccactcctgtgtaaaagtggggctctaaaagtttctattggagcttctgggggcttctctgtagggggaatgtgtctgacctgtttccttggggaagccaccaaatatcagtgtctttgtgtctttactctttagctactcagaatccccagagaagagtcttctggctggagcctagcggggaagcaggttggaggaggagtctcagcattggtttcctgttcattcagtcctcctgctttcaccctgcacgcccaccctcaccctctgcactgacgattccctaacccaaagacccaagattatactctctccagaggacaagcctctagtctttatggagtgggggagtagaacaaaggatatggggctctaactgcttcttagactctctgttttcctgtttataagcccatcttcatttgcacttccaaaggtacttaattagtcaattcctgagctatctgtggggaggagtctatggtataaatctgcttgcctctcagcttttcccattgctaggttattttggctgtcttgagtttgctaaattactttctattcatccatctgttttctagcatccaaaattttgtcaccattaagtcccttcccaatttctttggctttgagaatttatgcactaaaaaaaacctttatttttgttttaatagggcatggggagagaacaaaagaaaatgagtgtagttaatctatcatctttatccaaaaataaatgaagttatctttattaaatgatacctagaatggtcagcttggagaactcagagggaagccagcctttggtctgtaggccctttgtttctatgtgcacacctggctgcaaccatgtagatctcgttctcttattctgcgcccctgtgggttcacttgtgccagtgaactcacttattaggctgtaacaatcttagaggcagatgccatgtttatttttcttagggaagatccaaacaattctttactcctatcatgtgtttgagggtttgtaaatagagaataccaaggtctcagaaagatctgtgcttgtggtaatttgttccaattcaaaatcaaatgttagtgggaaaaacacttttcaagagatagaggccctgtcccaaaagacacaaatctttctggtctcaggagagaagtttagttctgaattggcaaaggaggctgaaccttgttacagtttgttaccaaagaagcagaaatggtgatagaggcagcactactccactccaggtggcccctgtcttgtagattattaatagtgtattccctgataccattataaatcctctaccttccaaaggcactaaatccacttaattatcttaaaaattaaagaatataggaattttttcattatgaagtgttaatggaaaggaaataagaacattacgttgaaaatgtaaaatgacctctggttcaccaagacccatccttattgaccttgtctttttttcccctaataggttgattgatccatggttaaatcataccggtgtgtagatcacactaagccctgccataaacccttgctggcacttgtagatgaaagaaagttccaagcctttcaagaatgaccattttcagctattttgagaagtctgggtagttttcatccccacattgctgggttcaagggcaggttctggagaaaactatgaagagtaacaggcagtatgtatcctgagcagacaagcataaaagatttgggaatagccttccattgacaaattccttgttatagagacacagtgctccccattgcttccagtaaacagaaaatgagattgcatcttccaaacctataattactctagccataggatattaacaaaacaaatcaaagtcaatttctccaaatgtcagtcttcaacttttcaatatttataaggtgtcatatccctaaatcaaagaggagtgccacaatccaaaataactactgaattaatagccagaaaataacatttggataaaagaaccatttactttactgcagcaataaatgaaaacacagaattatgagtcctggagctaatttgaataatgttcaagaagtgagactctagctggctggaagcacctgatatcctttgaccattcctcttctttgtttgggtcttaacagttaagtggttatcaaagggagtcataaaactgcctcctctaaaattgaaaaggtagctttacaaagaggccataaaatgttaaaatacaatcctggatcccttgacacatgaatattacattttgtgatgctcagaaaatgggaagaaacaacaaagtgggtggtagtccagccttggcaattcaaaggaaaattgacttgttgctaattccagcccactcactctcttaatcctctggacaaaaagcagtagtcaggagccttacgattctgggattaatggagacaggaggttgagctgtggtgatgtggaagggacagcaaagttctttcttttgccaatataattatagcccttattatgtgccagatactgttttagtgttatgctttgcatatactcactcatttgatgttcacgagaaccctaaaagcttgggaatagttttaattccatgttatgatgaggcaactgaaataaataatgaataagttggtcaaatttgcagtgtgattgtcagaggcagatttgaacctggggagctttgtgctagagactggctcctaaccatcacactgcctctcaaaatgggcctatgccaagcgagggtccccctttctgtattatgcaaactaacttgggtgcaccatgactggagtttgggatttatatccagatgactagcttttcaatccgttttttattataagcaacctggacctatgtgagggacaatgtttttgtctttacctatataaaactccttgggaaagtctccaaattcagagctgactttggaatgaacccaaattgttactttgtgttgattgtagctaacccagaatcaactcgaatactcccaagaccatgctgaaaaaataacttgtcttctcggggagcaaacaatgaggaggtgacaaacgaggagataaatagtattagcagaacagcgatgttatgaaaaagtaagtttttgcttgatcacaggagtttgaggctgcaatacactatgatcgcgcctgtgaataggcactgcatacactccagcctgggtaacacagcgaaaccccatctcttaaaaaaaagtaggatttaaattctcctggcaattgttttctcttgatgccattcattaaatttgccttgtagttgcctagaacactcttcatgacagatatgggctctcatcctacctttaacacttacttggctgagtggcagtgggcaagaaactaaagtaagcctcagattgagcattctttgtataaacaatcacaaaattgtgttgcatggctgttgtgaggagtgaatgaaataatgcacacaagagcctagcacagtgcttggaaataggaaatagtaagtaacggtgcctggcatgatggcgcttgatgttggtgtgttgttgttatgctcattatgatttttatactgatagcagccccatagaaggatagggtgagtggagaagattttggtaactagactctgaagagtcaagctctgtcctctgccccaggagaccgcccagtttaatccattttaattcagtacatatgtattgtgcatctaactgtacgccaggcactggcatatgctgtagttatgtttgtaaaattagtgtggtccctgtgctcgcagcctgtcagaggatacagagaagcaaacgggcaattacagaacagtatgggttaagagctgcgatgggggaaacacggggcaccacaggaacccccgggagagtttagtgaaatacattcggcttcacgttcctgccttaattccaaactgtcattaaacctcagctttataaagtatatttagtaatttaaacagttaaaaatagttactatgataaaaaaatgtttaaaggtcatagagaatgtatcaaaacctaagaaaagccgtggactccattcctgagatgctcatggcctacccaagaagaaagaaaaaacaatgattcgtggaaaaaaaaaaccccaaaaaaccagaagcataaagttcagaggcaacaacaggaatgagcgtatgagatgcaaagaagcacaatggaggaggatcatctaatgtgggcattggagggtgaatacaagttcaccaggagaataaggaaacatggcggagaacagcactacagagtagagttccaatctcccctgaagatggtgcaataccaggaggcacagacagggccccattgttaacaaaaaaacagtgcttgttcacagagatccaagacttcctctaataggcttggaccccttggctgcctaaacaactgtaaaacttgagttcatccaagtaaagggcatccgctttgccaagctccagtggccttggaccacagtgcaggcgcctggtttgcctgtgactccaggactgacttctgttcgctgtccatgccaggttggctcccttgacccctggtagtgaccagtctccattctctatggccaaacctcccagaacttcccctttgaagctctggtcccaattttagttgtggcaggtggcaaatgtttgggccgttttcgtatgggaaagcaattgtcagtgtttccttttccctttctttgctgcactcaacagcgaaccctttctttcctctcctgggaatatttgaagaccaagcaaccctttgtgtcctccagggaaaaggaatttgttttcggttgagtggggttctgggtctaatgggtctatctattttgaaagaaccagggaaaaagagagagtactctagaaccagaaggaaggaaggacgtgctcccgggggagataagtaacagaggaagggccaggcgtagtggctcatgcctgtaatcccagcactttgggaggccgaggcaggtggatcaacagaggtcaggagttcgagaccagcctggacaacatggtgaaactccgtctctattaaaaatacaaaaattaatacaaaaattagctgggtgtggtggtgggcacctgtaatcccagctacttaggaggctgaggcaggagaattgcttaaacccaggaggtggaggttgcagcgagcactgcactccagcaggggtgacagagtgagactccatctaaaagaaaaaaaaaagaaaaaaaaagaaagggaggaggaagaagaatttccccctttcacagagatacaggaatgaggaaagagagggaaggagacagcccctgggagcatggctgctgatccttgtgcatttacctagaaagtggatgcacctagcaaaggacccccatggaggcaaaggactcccatgttggagctcccataagctaagtgacagttgaatcagaatccatggactgtcccatgtttaagttgaaacctctcattatttgcactcaagagttcaccagctcttcctcccatggaagagcggtaaggactttagctcattagcatccagcacctcaaccactgaccacccaatggaaatgacacctgtttgggtaatgcacccttgcttagtcaccaaacacacaatacctaaagacactaataaagccaagaaagaggctgggtgcggtggctcacacctgtaatcccagcactttgggaggccgaggtgggtggatcacttgaggtcgggagttcgagaccagcctgacaaaatggagaaaccctgtctctactaaaaatacaaaaattagctgggcatgatggcacatgcctgtaatcccaggtactctggagactgaggcaggagaatcgctttaacccggaaggcagaggttgcggtgagccaagatcacgccattgcactccagcccaggcaacaagagtgaaactctgcctcaaaataaaataaaaataaataaataaataaaataaaataaaataaatcacattattggctgggtgcggtggctcacacctgtaatctcagcactttgggaggctgaagtggacagatcacgaggtcaggagatcgagaccatcctggctaacacagtgaaaccccgtctctactaaaaatacacacacacatacacacacacacacacaaattagccaggcgtggtggtgggtgcctgtagtcccagctacttgggaggctcaggcaggagaatggcattagcctgggaggcggagcttgcagtgagctgagatcacgccactgcactccagcctgggcgactctgtctcaaaaaaaaaaagccaagagagaggggcagggttctggatacctacaacctacaggaatgctgggagggtgggagtggaaggtggagaaggcttctacacctgaactaggttgggaagctgaaatgaagcagcttaaaacttcctgagagccaaggcagtggttaacgatgtccatcattaatatgttgtgtaattattgttgaaagtctgatggacaaggataggaattacgtctgtcttgtttactgttgtgtcctaaatgctcattgcagtcttcaccactgtaggcagtaactggcacatgggagaaactcattaaatatttatcagatgaatgagtgaaggcttgataatcctgctggaagtcatcttactagtttttcccaaaccatgccacaatatcccctggtgaatttgagttgtgtgaactttttgccaaccaccctggtgattacctcacacttagatacacgtgcacatggaaatccaagatcaggtaatataggtgagtcaagttgccttctaagtttgtgtgaatccggtgctccattttttatacatcagtggggcagtttttagtagaagacacatagaggagtccctaaccctgtgaccccaatcttcaagttccaatctgagctcaccagctgggtgactctgaggttagcctgcttcatccctccaagaagaaggtaggtccttgcagggtggatgtgtgagtgcagcatggtggctctgtgagtttgtcatgaatttcctgtagtgtccttctttctatgtcttagtagcaggaaagtgatggaaggaaggaagtgctcttgggggagacaagaggcagttaagcttgtgttgactacattacacattaaggtttagagacgtaagatacgaattccccaaagatgatgctgccagtccagcatgatctttctggctcagagattgctgccttttgtcttggttctgctcagacctactatgctctctgtatactgcttcttaactcacatgctcggttgaatcttaatggcttcctgcctacatcaacctcaacctgctgcattgtgggtctttcttgagtcctcactgaccctccctgctgcagcctcaccagagagagggagggcacaaccactattccttcttccatattccatggtgcttgatagcacacaggcatgagacaacaattcaatgactgtttcagtgactaggcagaaaaagaaggaagataatgagagaacttgttcaccagcaggaaatgaagctgtctggaaacatcggcctctagagatggaccagggttcgtaaactaataatagagaccacatgagttggtttagcactttagtgtcaaacagctaagcctaatgaacatcatattcccttgtttctgcagtttaaaatgtcaagtttatcaaagcattgccagtaacaataagtcaaaggaacaagccaacactaacatggaaccaagctcttaacgcacaaaagacagcaaggggcatcaagcctcaaggcctgtgaaatggtagagaacaatgttagagggcaaagggaactggaggctcaacttcctgtttttatcgttttgttcaaaattaacctgatcttgccctgcttgtcctggggtgatgagtgccaatggtcctgttacaacgtgctgcactccaccgtgcagcaaagccagtgaagggtgaaactggaaccttgggattagacttagtagctaatggcaatagtaggctaccttgaggatgaagaggatggtgcaaagccactgccagaagaggggttttatttgggttttctattcatgttactaactggatcccatgctcttcctcaatcttgtcctgtaccccaagctcccatattttggcctgctatttggagataggagtgtactctgtcaccagtgacacatgaggctagttacccaatcatcaccttccagtgagctggtcagaagaaatgtttcaaaatttatgcattcaatataaacaatttcccatcctgtgcatcaaaaagtatcgtagagtctctttgtcacttctgaaatgaagcatctctctgctgttgtctcaacattcagttgagtgtcttcttaaagaaaaacagactctagtttccacatatttttcacggtccctctatgcagcaagataaataagaatttatatacttttacttgtaaatccagtaaatatttatattggtttttgccataaaagcacatgaagcattatgaaagaggtttctactcttagggctgaataaagccatcactcgcagtgaggaagtaatctatcaaatgaggcaaagaggggtgtgtgtcctgattcctgagccacaattccctgtcttgaattgtacctggatttactcttggctggatggtggtgttcctgaatacacacacaagtacatacatgcacacatctcatgtacacacttcgtttttaatctgctctttgacttctctcagatattttattagtccattctgtcttcagttctgttagactgttattccacacagacaaacatttgaattttgcctggactgtgttgttggtgaaatatgttagtatctgacttaagctgaatatggtggacagagcaaaactaccttggaaatgaaattatatttgaataacccacatacaaaggtcagtgaagatattcataaatttaacaacactaagagctttaatttaaaaaattaagaactcaaccatgtttagacaggttggctagttttgttagtgctgggtggaacacgcattagaaactttttttcatcatggtgcatttattaagacatattgtgtatcaagcattgtgctaagtgctttatagtattccatttaatcctgcaacaaccccatgggtaagattctattactagtcccagtttagcctccatagcacagatgaagtaactgaggttaagaagataagcgactttctcaaggtcacataactagaaaactgctgggactagaaatcaatcccaatgaatctagccctgccctctgtgtttgtaaccactaccctatattgcccacacaatcatttgaatgcctcttagcttagatccactgcagcacagcatggaattattgcttccagagattttcttccatgcagctttaaaaaacttatttatttttgtggtcttgtgaatctgtctctcatcattcataagttccataaggaaaggattcagattctcatatgtcagcaattatcatagcctagtacttttctcatggcaagtaattaataaatgtgggttggtgggatgccaagtgcataacctcctgagccaaacagatgtgcatttgaatctgagtttgctgcgtgctaaagctgtggccttgagcatcagtgtcctattctgagaagggaacacaatgataactatcttacagtcattgaaaagcttcagtgagacaaaatacttagcacagtgccaggttcataggaggccctcagaaaaagacagtgtgttagtctgcaaaataccacaaattgggtggcttagacaacagaaatttattttcccacagttctggaggctggaagtgcaaaagcaaggtattggcaggtttggtttctcttgaggtctctctccttggcttgtggatggctgccttctcgctacgtgctcacacggccttctctctgtacatgtgcacctctggtgtcttttcctcttcttgtaggacactagtcattggattacagctcaaccatatgacttcatttagccttaatgacctctttaaaacccctatctccaaatacagtcacgttctaaggtactagggattagggcctcaacatatgaatttgggagtggggaagaaacaatttggtccataacagacagttatcattattgcaaatgaattgagcactaaatatctagaaattcaaaataaatgttccatgtcagacccaaaaatggtggtccctttaaagtgtcctgattacaattttagttctttctctccttggtgccttagagaacgcaacctagaaaggctttttctctttagggaactgcaccatattcactcttggaaagaaatatattcaatatggggttatccaagatacactggaggaaaacatgatacatcaagtccaagttaaagataagaactgggtgtgatggctcatgcctgtaatcccaacactttggaaggccaaggaaggagattcacttgaagccaggagttggagatgagcctaggcaagatcctatctgtacagaaaaaaaattagccgggcacagtggtgcacgcctgcagtcccagctacttgggaggctgaggtgggaggattgcttgagcccaggagttcagggctgcagtgagctaggatcacaacactgcactgcagcagccttggtaacagagtgagacactgtctcttaagaaaaaaaaaaaaaaagataaggatcagaggactgtaaccttgtcaaatgcaattatcaggctgcacagtctgccagggaaggagaccctcttgtgaagagctggcagtggagtgcttctccagtccaataatcttgttgagtgcaccctcccttactatgcctaggttcctatcattatactccctgtatttagagaaaactatacatgactatcctgtttagaaaaggtccaggaaagattttcccttctcggggagccctagtatgacaatcccagtttgtctcaccccatctagctctacggaacccctggcctgcagctctaatcctctctattgcccctgatgaagtctttcttggtgcctccaagcacaggcaatgtctgtcacttcgatcttcccttacattttgtccttttctctcctacagcatttaccatagactgctctccatcgaagttgctgtgcagtcaaccactcactcagttcatttgacaaatacttagtgagggcttgctatgtgtcaggtacattgccaggtgctatgcaggtatctatgcatcccacaagacagggactctctgaagggccggacagaacagaaactgtgtttgcctcatttttgtaccagctagagagtccaccccttggcaggctgtccctaaatgttagctaaattcaatggacagatgtgaaaggggactttctctgagaacactttcctcaggaggaagacaaggctaggaaagtaaaaggaggcaatgtcttgaggtctgaagaaaagctccatttccaaaggtcagtagaggtaatggaggttctgacttttaatccccatcctgaaaagggaggccccagctaagaggagaggtggcagagccagcaagaggaaagtgttagggaccagtcccagagcacaagcgaaatgatcaagcagctaaataaatatcagctgcttttcctactctgatgcttctggaattcgtgggtaatgtgtttctgaattcgcctcctgcttctgcataaacaacaacatgatttaatgatgtggataataaagctgttgaaaatgatttttctttagctctcttttgggacaaggaaagggaaagaatcaaagcttaatacagatgctgattacagaaaccaggggtgaaactcaagttttaaataattgtacttattttctgttaaactctcatggtttttgttagttataggatcactaattgttagcaccacacaaaggttaaatgtgcaaatactgctctcttggtttcagctgtgaaagaaaagagataagaacaaggacatataaagagggcatgaaacttgtaagatgaaggacaggaaagtgaagggtgagagaaagaaattgggtcatcaagtgctcactgagcaccaacagtatgccttgaactgtgcaagcattggatgacagggcacagggtagaaatgcctgcacaactctcagataaaagggtacagggtagagatgtcaggaaaatcaacctcacttggtctaggatggccaagaagttatagttcactcagatcccttgaagagaaattaaaaggaagtgaattagcattttttaagtggctaccacctgcagttagtttcttgttgaattcacacccttataaggcttagagagttaactaacttgctggtaagaatctgcaataagttattactatattataaccctaaagggaaaaggtagggagtggggtagagtaagaacttggacagttttacaactctaacacccagaaatcaggaaggggtgattgaatggggctatggatgaaattcaagttggaaatgagagaatgtgtgagcagaaggccctaaaatctctgccagccttgactgggtgagataacttttgctttttaggtatctgtatcactcagaaagaaagataagcttgctaccacctggggtccacctgggggctttcctcccctcctctcctcctctgcccctgcccagcagtgaagccaagcaagaaagggaatagtagggctggagacttaaaagtcaagaccaaatggggactccagttcaggaaacagaggggaggagaaaaccttgaagctataaaacagaaaaagttggaggtattgggggaagggaataaagggatgtgtgcaagaggaagagttattaagttgggggtaggaggataagagacatgctctagtgaccttgcagggtgcccctgaagtctgtctgtgataatctgcctgggggagagtgtgccaaccagttggacctctctgattgtttcatgcttttttttttttactatatgactttagagagatcaacatgaatctaaagtatgttcagacttctttcggattccttttgcttgtttgctctgtggagggcaggaagagaaaggacatctcgcacctgcctgaatcactgagtgctgagataccaccagccatgaggtgtaggaggtcaagggtccagttcaccttattcaatcactatctatcaggtggttttctctactgagtctcttaatgaggataatttctgaaagggatgctttcaagctcaatggctgtgatgaatggtattatttccagtatccactttcctacatgtgagaggattctacataagcatgcattgccatgtgacccagggcctccctagcaatgatgatgtttacctgtccagtgacttcaagcttggccgtgacttgctttggccaatagaatgtgagtgggttgatatatgctctctcacacgcacatgcacggagcagaaaccataggtttatcatacggttttgctagctctcttgttttattccttctgccataagaatggcatgtttcagatggggcttctacttcagcctgaatcctggatgaaggagcaacagagccacagccaacccatcgctcaaatatagtgagagctagaaacaaacctttgcagtgcttctttccgcaacataacctagtgaaagttgctatcataacaattttctctgtatgccctcctcattttatattgccccagcatttttaggtccagtgtttgtaataaaggatattcattccttttcacaaatacctttccttcttatcccaagctatagaagaccatgtcacaaaaaatcatggcatgaaagagagagaaactggtatattgaaaaagaaggagaaactgagtatatctcaggtctttgggagagttagcattttgggtataaaacacagtggccagaactcttaccagggcatatttgttccaaacacatctaaaatggcctcctattcccctagacagaagcatcagcttccaccctaaatcagtggctctgctactcagccctgttttagattcacctagagaaagcatcaactcagatttccaggccccacgttgagagtctgattcagtaagtctaggacgggacctagaatccttatttcttaaacattccccaggtgatgccagtgagatgccagggtgggaagccagggctagtcccactccactggcaggcttgctgggccttgagagtgccagcaaagcccaggtcctgaagggttctgaggctggtgtgagatgctggcctctctgggccacatcagagcccaggccttatgctggagagcactaggaattctaggaacaccctgtccccagtggtccttcttggcaggaggacagcaacagcatatgtgagtgtatttgttttcccagccctcttgtatatcttgcccactacagcttgtcaggcgggctgagtcctcctccactcctgagaggtggggatggtatcagccatggctgccagctgaggagactagggagcccaagaggtcctctgctgaagtctccatagaggttgataaccacctgcctgtgaactgtgaaccccactgcttacctgtggggcctcaatgcctttcaatagtccttggactgctgcccttgaagtctcccaggagtcagacctgagcctcaatgaacaaaggaaaataacaaggcataggaagaacccagccaccagacagaaatagagctgctggggtagacagaagacaatttgcatatcatcataatcatcatcacatctaagggttaaagcaggaaaaatgggtctaaaaatgagactttctaaaaaaaattcgtaggtaaattgaacaagatggttcttgttgagatctgaagtagtgagttggaagattaagtggaagaaatatactgaagcatagaaagatacaaaaatttggaaatctggagggaaaacacaaaatacttggcggatagatctgggaggaaacggaacaaacaccagaaattccagaagaaaaaaaaggaacctattgaggaaatgaaataactaaacaaaccaaaataagccatttccctaaaccaaggaaagaccagagtctgtagaaacaatgaaaatgacccatactcaggcatattctgatatcacatctaaggtggaaggaacaagaattctacaagctgccaaacggaaacaatgcataacttaaaaaggaaaaagaatcagtctggtattttatctctcaaggcaaacttggaagctaaaagataacatctatggacatatgagacaaaagaattgcaatcctagattcctatgcccagcaaagacaggcttcacttgtcagtgtgagagaaagatttgtggctgggtaaggcagagcttctaaccatacaagtaagcctgaacagagactctgagggtgagaggggaagaggggaggaaaaagatggtgagaatgaaacttgcagtatagagagctaaacctaaatgtgaagtaataaaagattgactgggattatctaacattagcatcaaatgaggattactgaaataagatagataccagaggaaactaagaactatctgaaagtattaaacaatgacagaaaaactgaggatagaggcagggtatgaagtgggcaggcacaggagaggagaaaagaaggaaaagcaagcattctgtaatgtcagctggatagaggccagaagtaggagtgttctgaagctttattgtggtggtgcaagagtcctggggaaacactgacctgttgtctccatataacagtactctgagggtaggattctcactagtagagaagaaagtaaagaacaacttgaaaagcatcaatgattttgtcagggacctgcttcattgctcctgaaatacagccagcgttccctcgactgtgccttgttttgacaatttggctcctgtttctaaattcaccccacctgtgggaaagaccctgttctgaccttggtgctctactttggacacatttgcttttggctctgaactcccagaagcctggtctccagcctccgtgcacctcaagtcacacacttcacctctacatagaatgggtggcacagggagtttgctgtggagcatctgggccaagtccaaaatggttctgggtctcctactcttgaaggaaggtaaagaagtcaattctggcggtgttccaaactggtctcttgggctagtttaaaagcttagagatgttggaattatccttttcacctttctcctttcctcttccacttccatccccacccaggatccaatgctgaagtttccattttgaattttgggttctcaggcaacatatggcctgccttttatcgtattgcctgtagcattcggggatttcaggaaagcctttgagagaccttggtctcatcctcagctcagctcactaggaacaaacaagagattggctgtgggcctctgaatatcactcagaacacctgaaaatgatagtaggccgatccctgcttgtctaatgccagagaggtcgaataacttgcccaaggtgagagcacctgttggtggcagagccaggattagaatctaccatttccagtccagaccctcccgatcctctagtccttgccaagtcccctttcaatctgaggcagaatttgccaacattcaggatgccctgctcaatctttcttagattggactctaattggtagcactgtgtagcttgtgtctggaatacgaggcatttcagataataagggtcatacttctacttttatgccaagaaagctccagcacatggaaacacgtttaataaatccaataaatgatatgataaataatttatttaagacagaatactttcaaagtcagaattaccactgagaggaaacattttgcctccatgaggatgatttgactaaacagaaattctagatggagtccattttttggactcatacaggagtcctgcatgctaacccatcagagaaagagtagacagattgtaaatttatcttctgaaaatgaatcaagtcgtatttctcttcattctggttactcttataaagacacagcaggtgaataaagccctttttctatcttatctatttgcgtattattaaacactgagatcgtgcaatgcctctgcctcctagcaacagtgtactggtaattcttggaagagtcatgaactatgtagggtgaatgaaaaaagcttcttgctcttatctagtgttgtgggatatatactataggcatgagacagcagttttttttttttattcttttaaaggtcacaaaggataaatgattacaataacatttcacccactgactctaggtttttactagtaaatcctgatgttgatttcaaaagctgcaaatctataattcaaatatttctgatcggaccataaatcctgaaaatcaaatctttttctgaatgaaggatctatgaaaatagatgatggatttcatgggctgtcaaagcaaaaatgttacatttcatagtttgtcattgaatatgatataaaacacctgcaggtaggttatttatattgataaaattattgttcttcaacattggaaactgttttctggggaataaaaataaaatataaaaatagcttttaccacaactagaaattttgtgctttagaattagacagtggaaaataatgtggataaatgccaaaagccattttctttaagccaaatacagtgtgtgctattgcaaggatggataggccaggctggactgcttttcccatcagacactatatagagtatcacccatctaccattatttttgctggaaatacaggagttttgtttgtttgtttgtttgtttgttttgtgagagagggtctctcacactctgttgcccaggctggagagtacagtggcacaatcatagttcattgtaacctcagactgttgggatcaagcaaccctcctgccttggcctcataaagtgctgggattacaggcatgagccactgtaggagctaatattctaactcttttttgttgtttttatactttctttatatattgtccttttttatactttcttcccagaggttaacaaacattagatttatatttcagtcaggttaagtatgtccaaagttattctttcctttctgggtagtgattgtgagattaagaagctagtttgctttgctattttctatggctactgtcggtgggccatactccagccaactttctcaggcaaatctaacaccacagctccccagacaactaagagttgtttaatgattaaattaagataacacatgtaatctggcatatagtaagtgctcaactaatgatagtaataatggtaatacaaattattattattattttcattatacctaacttgaataatttctaaggcccttggcatggagtatggtcactagtttagtttaacatgatttagaaattgctcatggttatatattaccaactacaaatggaaaaatgacattgttggaaagggagtaagtcagatattcagggaatatgtaggctcatattaggaagggaagatgcaggctcaaagagctcccttctcagatcctgaaaactagagtttgggtttcatttacaacagtacataatctcagctgcacataagaaaccttgccacttctgctcagtaaaatacaaatcactgactacccgtttttattttaggcagttagatagttagtacatcgttaatttctgcacatactcaagctcaatatcattgtcagttcggttttatttccacctcctttcagagatccctggctggaggtaaagacttgctctctgagtgtctctgggtatactaaggcaatatgaatctttaggagctccccttctttgggggcaatttataactcaaaacagcaacaaattttcttttcagggtggaaatactgacaataaaaaatgaagcagctttgaaatatacattactgtaattaaagtgacttgctctttggaaattcctgagataagtctttattgcaactattatttaatgatgagcataataattaaaggctcattcttgaaatagtatcagtgccaggatctggatggtcctgcagcatttcagattacagaacatggccactggtggatgcctcagctcaagattctctctgcctttcttttgacaatgtgaggccaaggccaagtccaaggcaagcatgtgcttagactggtgttccctagtacactgttatagaagccaccagctgatgggctttgtaaaaggtgtggtcaaaactggctgggtgaagttagtactctaccatttgaggcacaatgcccacaagggtataaagtatcagaaattgtacagtaaaggcacctgtttaactttatttaatatagcatttaaaaaaattatttgagtaccaaaacactttttgtggccatgtggtacatctattaatattctgtggagcagtgttctatgagataccagtttgggaaatattagctagacctgtgcttttcattcctagctctattacagaatcgcctgggggcttaaaaagtatatcaattctggcccactgcccaacattttttaaattggtctggggtgacatccaggtattggtattattttcaaaggctcccttccctagccaagtctaatgtccagccagagctgagagccactgacagaagcctctcacttatgcatcccaattatcccctttctaatgcatagagtcatagtgagtaagaaaaaaaaaaaaaagctctccaaagctctgatgtgtctgagaaagaagcttttcctggggtcagatctggatctactcactgatcttggagttttagctgatatgtggatttgcctgttcatggacttacttcctatcacacttccttctccttggtggttgtcattttcagcaggaagggacaggctgcctgctccacccagaacctttcctgaaaacctacacctgccactataccaactttatgtaaatgactaatagcgcttcctcacaaaaaatgatgagaacctctgttgtaggtaaacattccaagactttatctacaatttatgaaagcctttctcccattgagctggcaggtcctggaagccccagaaatgtccatatcattagtgcagtttccctgggaagtgggagctggggaagaagcctgggaggtggagcctcagaaagctgtgtctaatgcagatttctagctttaaatttgttccttgtgtctgagattttctagagttttactggaagagaaaacccatttctcctcccctttaaataagaaacaaaaatttactgattaagcaagaccaaagagaaaaatgagatgactttatagactcattttataatattctaaacaaatgagattcatcttatttaagagtacaggagaaacaggcatttaatatttattgagcatctacaatgtgctaggatacatacaggttttttcatatttccatcttatttaatcctgacacaaccccttgaggtgattcttctgttctcatttttgtgactgtggaaagggaagcccaaaggggttaaggtgttgcctacagtgggacgtgagacagagctgggacttgaacccacgtctagtgatggtgatggccaaaccagagccagatgagccagttccccacctctgcagcgctcaccacgagaaaaagaatgtgaaaaactccagcctgagatcagtgacctgttgagagctcaggtttttcatccggcctgcatcgtgactctcagtgtatttcatatcatctccaaaatagtatctgaattttatacgcatattctcttcaatgttctactctgggctttgaaacagaagaagggttaatgctgtggtgaaatgtggcctgtcctgctccctgggttcttctttcattactcaaaaaatacgtaggtttcagggtagactcttataatggtaacaacatgagctttggattagacctggatttaaatcttatactgtgattactaattctgtgaccttccgtgacttattttacctccttaggcttcagtcttttcatccataaaatgaggtaataataacatttgtctcatagagttgtgaataaacaagattataactcaggtctcctgaatttactttccattagacgcatatacccaaacatgtaaaagatcgaaatgtttcacagctttccaaggcttatcatctgtgaagctcaggtagatttgcaagttcgggtttatttatcaattcattaattcagtcatcaatgtattgctttagtcattcaacaaatgttttattgagtgcctactatgtgtcaggcattttgttagtcaccggagataatagcaattttcaagtagcttagagtctaactaaggcaaatctgactgtatcattatttatacccattagaggttcacaggaatgatattcactcactaatttgttaatgcgagtctgcagaattaacatgcatgtaatagtattcaatctaagttaatatgtttgcccattgttgattatcataactgttagttatagttaatttccaatctgtctagctctctggaaaagcaaaaagcaccttccctccattttgctgctctgaactgggaaagagcagatgcccaggtgaatggcagtgaagaacgtatattcagtgagctcttacaaatcaaactgtttgccctgaattaggctcaagtccacaactaatgacaactaatgtatggattcctggcattgaagcatttggagtttaactgtttgttgtcattgaaagtgaatgcctttccaacatgtagcctgaagtgctgagagggcagatcctcagctaggaccgaatgtcagtaatttaatcatttattttttcttgtctgttttatgacatgttcttttcagagcattccctagttgctttgattcacatatacattccatcaatattaattttctgtgttatagtaacaacaaaagagtaaaaccagaaagaggaaaaccttatttttccctatgaatagcccaggtccacatgaaggagaaattagagtagacaggtggcactgcagcctgttattcaaggcccaggcaaccctgactagttccttcgttctctcctttgcttttttctgaggaagaaaaatcagcctgaagagtcaagcagaatgacgaactttttaagggcaagataattcacaggatcagttagtgatagagtaactttggggacttgctttgcatttagaatacccaccctatatggcatgttagtcctagcagagagaggcttgcttccacaccaaaagccctaattcactttccacggaggccctccccatccctcagcagcacttccctttatcaggcagataagattgggggggccaacatctatcttgtatgcatcctatgacactgcagatgaaaactacctgccctggtgtggtgtcacattttttacatttgatttttatggatgaaagcattgcttcatctgatacttataaaataccacatttgccactgagaggcttctgtgtccaaatatctgccccgccccccatgtctaatcttgatcttcacagctgaggcccatctggatcatcctcctttccagctgacagtgagagagccaatgaaatgccttttcctgttgctgggtgactgcgaatattttgaaaacaagttccttaaaggcagcagcttcaaagcctgccattggctggctaggcatactgtgcaatgctgacgcatgaaggctggcagaggagtgacagttgggaagagctacgcaaatatattactggcctgatggtccactggagggaaagactatttcaaggctgagtgacaactataacataccctgtcagaagaaaaataaatctccctgagtctacattcaggcatctgaagaacattgcagaaaatactgcagacaaaaaaaatgcaaaaacaaaaaacaaaaaacaaaaaaactcaaggttgtcctaccctcagatctcctgctttttatggtctgatgagcagttcttcctgttcaagaaatatatgggtatttccacatactttggtagaatttgtgttcatacattttaaagcccaagcttgtttatttggaaaataattttcaacaaagtcatggaagattttctttgcttccttgtctccagcgtcccttccttcaccttcctcccctgaccttcaagtccaaaaatccagcaggcacagtatgcggtcagtgtcaggggcagcattggctgcattttatctcactctgtccacttaaaatatttgcatcctggtgggaggataagcacagtcctgtctaaacagccttggggttcagctttgcagctggagagagctgtttggatacaagtaactgcttttgctaacaccgggttaactgttcacacacaaatctgccaacgagcctctaggaaggaatgtccttctactaattgaattctaatgaggccaggaagtagattaggaattgagctattttactatgagtttcaaatatcagatctagggatgtttggcctgtctgatctccttaattctccagcaggtcccaataaattcatgaagaaatgactagaagaaatctgtgggttattggttgatccagttgcagggggcttttctatatatcagagactacagtgttcaaacacaagagaaagaggctgatctgagatgacctgatgggctagtcattagtgaggagttcctggaccaatttaattggcatgtccctggaagttatatttatttgccttataatatttgggtaagtttgagagccaaatcagggtgagcatcagtggggtcacccctgattctacttagttgtggaaatagaaatgctttaaggacatagtagaacattcttttcaataatgctatatagccaacatcacttgtggaaccacttcagcagacagagcgatcacttgtgggtgtcacccagtttctagacattacgaagaggctcttgtgagcatcttgcctgtatcccaggaaatgcctgcctgccataaaagagggcatggggtcatgcaaaagttacctgcatgtactgtgaaggacagctatgataccatccaccaggtacctctttcctttctagaactggccctccttctgctgcgaccccatgtttccacctggatttgatttttccaactgacacactttcctaagcacacactcctcatcacagttgactggtccagggatggacaggggaaccaagtgggccaagcggaccaatcagaaaatgtccctgatattttccaaactggaacttgggactccatagttcccttctagaaggggttgctgaaagatgagaaacccaggctctgccagaggccacttttacccctttgtagagcaagccagtctgcagtgagtacccaagggctccatgtgcaatgtgaggcttttcatatttggcccaaggggccacctgggtgcttagtggagagtcacagcagccagccccaggaatcaccaagtggctctgagggtagcagatggttttgcaggagcccattctgtggggcagggtttccttttggtgtgcactacgctctcatttgtaacacttcctgggaagactttgggcttttacatactatatagaggaaggagattttacatctgggaccttggggccatttcaaccctgccttcccactaatgaatttaccacacaataagagaaagagttcctgttgggagagaagcttgtttgcaccccaggtcagacagggccactgctaacactagaatagtgggcccctggtctttcaggggttatcaaaataaccagcttttgccctcacacacaactcctcagagaaccggagtaaagctgttttcaagaagaccactgatggtttaaaagatatttcaggcagaagcataaatttcttcatggttttaaagggaaagaaattccctttaaattcatattggagaaatgtcatcacagaaagcctctcactctcttctcgttcatttctgaattctaaatcttttctgttggtggtgaggggaagagtaaaaagtggttttcctcaaaagccagcttcagtggtttacggagttgtttgacaaacttaagcccaagtgttgaggacggccacctgttcccacagaaatcacaaagcttggttttcacagaactcgtctccatctccaggaaggccagaggtgaattatagtatgtgttaggaaaatgaacctagtagcaagaggaatgggatcactcagcacaggaattgtttgaaatttgccctttggagaaaataagtgctgttagcgcccacaaacatgtcccttgaagttgatattctagaatgttgaaggctaaggaatcatacctgctcaagcaatggggctggattacttttcaaactatgtaaccttaaaacaaacaaacgaacacataaacaaaccaaaacattcttagcaaggtctgttgaaacctgaacccatctatcgagaaagtaaaccaagattattcaagggctcacaatcagacgataaggagggtcaagccaagacgagaagaatctcaaacaaaacgcattccatgacatttcaaaaaggatcttacaaattcagcatgcccacccatatctcaatttcttaatgtgtgcaatgtagttacctgggcgtttctctttgtacctcagttttatcatctgtaaaataagaaaaataatagtagggtttttgtgaagactaaataaattaatacaggtaaggcaccaaaaactggcctggcagctggtaaaatgttcagtaaatgtttattttccagatgactgtcacatggagtagactgagcatatactggggcccaagaaaagggcctcagcagcatgaaccaaggtctccaaactggcagtgtaacatctctcttagctgcctgatccttaaatgggatagagccgctgatgcctccttcagaggcttgctgttaacattcaatgaaataagagctatgaaagcacttagaatcagcaaaaatgctgtggttatcatagcatttgtcttagtgaacagcaatatttgaaaatgtataatgattggtatcatgttatcctacagaaagcccaggaaatgtattttaaagtccgtccacttgtagatgcttaacaacagaacagtatttaagcctcttatccctggataggttgaacagagcctcgctgtaagttcttaccagcccttctcagactctcacctttcgtgggtgtggatttgattatagtgagtgtaaagaagtacctgtggatgctgctctgggaaggctttcagagccagtatgaggccagatgctggggcccccagcctggggggatgaggtgaaatctgttttgaacttagatcccttctaccatgtggtcttatagaaacgattctagagttttctgttacagtgggactgtaacagacttgcagtttttattaaaattctgacttgttcacagcctaattccttttagtctcaatgaaatgctttaggccctggatggaaacatcatcctgaattacatgacagtcttagaatattctctgtggaggcaaggcacggtggctcactcctgtaatcctgtaatcccagcactttcggaggccgaagtgggtggatcacaaggtcaggagatcgagaccatcctggctaacacggtgaaaccccatctctactaaaaaaaaaaaaaaattagccaggcatggtggcaggcgcctgtagtcccagctactcgggaggctgaggcaggagaatagcatgaacccgggatgcggagcttgcagtgagccgagatggcgccattgcactccagcctgggtgagagtgcaagactccgtctcaaaaaaaaaaaaaaaaaaaaaaagaatattcaaagaacattctctgtggctatcaaatccaaagacagaaaaatcctgcacagatgttgtgtattgactatagatgttctgatatctggctaaggtggtgtctttgtgaacgttatgaattgcttctagggaagcgaaaagcacctcaacagagctaccatttcaccaacatgcagtattctggggaaaaggaagagaaggagtgcctgatggctctatcagctctggcaaggaaatgaatgcattgaaggaatagagtgcaggcacacagacagcgaggctcaaatctcctggctgcatgcatgctgcaattacacaccacaataaaaagaattaatgtagcatctgacctgctgacctccagatgcctactgcaccacctcatcaacaatccccagacctccacggtgcctccttggccacccgccggctgcctcactgggatacagcaagcacaagggccttacacaggctttgttcttaaggctaaaccaaaggggagagtcccccagtccctccacctcgtgcctgggcaaatgaataagctgtccatgtcactaacatattccaggtcatgcgtacacacaaacattattatatctcgatattacttttaaattactgtctctggggttttagccattttcctagaaatgtggctcagcaaatccttacgtggagcaaggatggcacccagtggccaaagtgcttcatctcagaccctgttttctcagggattttccatttgcttctctctttggagacaatgaattgccatgagatccttttgtaaagccagagttgaaactccaaatcatatgactatcccgttaagttggagcacgtgcacacacacacacacacacacacacacacgcacacacaaatggaaacagtatcaggagctaattcagaatagctaaaatttctgaaaaatctttaaaatttaccttgagagttttatgttaaaatcatcatatttcagatgtgcagattaccatccatgatgttcccaatatcaagtatcactataggaaatattataaaaaatgcaagcccagtctcacattcttcacttcatattcccccaaatagtctctagttcataagtgctcatgccttaaacataagactttatcacctgacaagtgctttatcatgaaactgatgtttgcaatctcatatccttgttatctttcgtacaaggtacttggcaggcctggagagcacaggataatagagtgggactactctttttcctttgagctttccagatgtcaagagattttgatacagctagatagccaatcagactgtaaggaagacaggcgagatgtcagaataatgaaccatatactctcttgctaagaatgatgcaatgtctccataatgtttctgtttccaatttccttaggttcccaagtaatctaaaaccccagggcaaaaagtcacatggatagtacaaccacaatacaaaaagaagtttctaataaaacaacattacgtattaattgcccaaagagtaccataaacagtcttactaaaagtcaatatgttgagttcagccaacaattctgtctttctcagacgtcattaccattcatgcttatttgacccccaaaatgtcaaaatgccaccaagatttcaagaataatagctgaatcaaaagaaatgacttaaaaatgaaactccatgacattgcttccattttcctactccgccacttgaagaacagcattgtcttcaggaacagacaaaacattgcagaagaaaaaccaaagcagaggggttccatttttcttgctggttctttgatccttagttgccttctacataaaatggagatatgctaaccctgccctcaccaagactttgtgagcctcaagtgagataatggacatgtacctgtttttatacactgcaatttcttagtacttaagacatttttcttatttaaacatttataggtagcattagtgtatagtttttatactgatgagattgagactcttgttttacccacgtaatcacacatcttcctcatgagtattattatattatattacctttcaaatataatatagtcatgggggctttggaaattacttatatgtaattaaatcaagctgagctatcttgaacagagcttgaattaaaaaatttgagtatgcgaaaatcataaaaacccctaaatgttttgtcaacatttatgttgttttatgttttattttcccctttcttcctagagataaattttataggttcataaaattatagcattttttagctagagatggctttgttttgcagatgaggaaacctggagcctagaaattgaaattaaccaaaaggtctggtggttactttgtctttttatacacttgcttgctcttgtcttactgtgtccatggtcttacaaagactgttaaaagggcagatctggctacagagactgcagaaaacccttcagccagacattgtctcctaacttcctatttcatagggtgtcttgagaccaagagaattatgattcacaaacacttaaaagattttggatgaatccatttccaaatgaggaaaaataggaagaacagccaaaccagagcatgatttcaaaaacaggaaagacagactatagaactatataaaatagtaaatacaaatacaaataacaaagcattaggtgttttgaaggtcaaaaaaataggtttaaaaaaatttagtcagcagggtggtggtaggaggatacatgaatgaagaaacgtatttagtagtaaagagattgctgaatcaactaagagttaaagggcaaggggcttttgcctccagcggggaagagagacactatcattacagcacactccaaagaggataggagtacctatcctaaacaaagaaaacgaatccctttattttcatatagtttagggtgcacaggacaacaaccaggaacataaaaacaaggggtttcaaacagcataaagcaaggattggggtgaaattgtcagaaatttccatcgtcataggtccctgcttcaaaattccacccaagcattataagttcttttgccataaaaatggcgaacatttcaaggaatttggtcacaaggtagaaatttctccagcacccaggtgcaaggcatggctttaggtgatataagggttaccaaatgagtaagtcaaggattctctcctaaaaatgcaactgctttaatcatttgagtagacaggtgcaccaagatttatattgcaaggtagaaagtgatgaatatggtaggaagaaaggcaaatgagaaggtcacttttgactgaaggacagcaggaatgacttcatggagaaaggggcagttgagaagggtcaggtagattgttagcgatttatatatacagatagggagaaggatgggtgcaaacatataaaaggacagggaatgggcagaaaacaccaagtagaactatttggttaaggatagctcagtgggagcatgggaaacaggctggaaaagtgagctgaaagttagagtttggaatacttttaatgtccaattaaataattcgaattgaaagaatctagaggcttctagaagatactaaactttgtgagctggaacctacaccaacagaagagttcatctgttcatctgttagctgtgcacaggatggatctcggatagggtcaacagcaggaggcgggaacccagctaggaaagcagtgtacaataatggcctgcctgaaggagaatgaggatctgaactagtgagggctgtgaggatggacaggagcaggagatgtttggaaggcagaatggacgggactgcatgtgggggcgggcagtgatgaggaccccatgatgactgtacaatgatagccaaagtgtgcaactggagattgagggctacagaagcccaacagccaggaggtcgtagctctgtgcacactgaacgaacagtagagggaaggccacccattgtgatggctaacccaagcccctctcactgaagtgagggactacgtgttcttcatttcctggcgtcacagctagagttatcaatggatctaattagaggaaaactaaaaagaagataaagtgatacagtcccagatgcgctagtgttctggaaggttctgatgactttaacctctccagttcccttcacagttcaggagtcagggatctcactgggccacactgttgctctccactggaccttcaggacttgtcgccgctttgttcctagcgctctgaaacaaaaatgagccctcctttgtttcactgcctcaagttcagacttcctgcgccttcccgtgtgacacttagggaatgcagtgaattctgctgtgctaacatgggggagggagaaggtgggagaaaatcctccaggcccgctcttcctcccagggaaaggagatgctcacagtgatcttctggggagagtgtcctcgctttgttttcaaatagaaagaagtgacaaatagtggctgctgaagttgatgtgaggggaggtcagggtcaccacaggatgtattttggtcaggcgggtccttgaagggccctcaatacctagccgcttagctcagcaggagggaagacgagcctgggcttgcagatctggttcccctcatgctcagcacccactcccccgccctccgccactatcttcaatactcaagagtgacaaagtacaaccatcctttttctgatgtggcatttgattaagacacaattcatacagacagccggacatttgaacgcgaagcactccgcatatttatggatgcgtcctgagcagtgcaagccgcccggctcggctgctgcttgtgagcaggagatgccctttagggtgctgatgcagctgtttcctctgcagtcaatttcctggtgaaggttcaataactttctctgacgataaaaaaaaaactcggatattaaacttgacataaatactatttaaagtcaaaacaacttcctaaattccaaaggcgggcacagaagaggagacagcataggctaggtaacgaattccttctatatagcttcgaggtaatcttttaaacaaccttagaaatgacccgagatgcactggaaagccactgttgggatttcagaaggtagcatttcaggaaggccatgagaactgagactgtagataaacaagacaaagctcctgccctctttctggtacccagaagtcctgctttatccccggctgtggaggagcctctatgggtcatctgccctgagggggaggagctggaggtgcccctaccgatggggtgggtagtaagctcccggcctctgccaccccgctgctgtccatgggactcaggtctacccctcttcctcttcggcgttctctgtgtcgcctgagtttgggtaaatgccatggtgttaccctctgtctgcatagtgcactccgcctctgcaaggggctgctgcaagaattgggctcttccagggcttcggaaattgattgcacagggcggtggctagcgcgtgtagtgcctttgtggcaattggagaaaggagcgccacctggtggatcaactactaaaaggcactccatgcacttggccagccaagagaaggggggcagccctgcacccgcctgctgtgcaaggggccctagtgcagggcataaggcagacacatctcctggcatagctgtaaaggcagtcttgagggctgaagcttcttattatacactatttcatggattaaagtgtcttatcaaatctaattttttttaagcctagtaaatcacatcctattgctcagtctgcaaaggaggtcataagatcctatttttgatgcagtcattcttatttcagtatataaatgccacaaggagtacctattcttggtactttattttattttattttatttactaggatattaatttgtggcctagtcattaacattgaaaacttgaaatatgtatgaggtagtccaaacccaaaccccaacctgagttactggtgcttaattactgaggcagttacagtgctgtaaatgagttcatctctgattgcagccgtaacccatgcagtgctcaattgaaggaagggatgatacaaggtggcaatataacaccacaacatccatgagttgattttaattggtaaactggcaatatatagtgagaattgtttggtctgtccaccgcattgcaatttaaggaaagtccataaaattacaggagcatataattggggtactaaactcattttcttatgttatcacagctggcatctttaggttattgaaagcctttaaaccagccatcttcaaggagatgtaattgtcaatgtggtctttatacattattcctgttagcacagagctgcagagataaaaacagtcactaaaatatgcacaaattttctgtatataactttcttatttcaagttcatggaagatcagtaaatgttaatgaggattaaaaaccattttttagatcctggtttcctcattagatgcacagggcaatcaacccataaaggataatttattgatactacaacctgaatcagacttttgaaatagttaattcattagttccaggaagttctgtgatctttttgtgtataggtgaagctgcaagaaagactgtttcttgaagtataaatgatatatcagaatcaggaaaaataaacccaaattctgacattcttggatgagtaattatatgttgttttatctatttattctggctgcacagtccaaggacacttctagaaaggttttcacactctaatcccattctcccacccatcactactacatgctcctcaaggaaatttttcccaacagaagtaatagggttatcagaacaaaacagaacaacaacactctccctaacaaggcattctagaatagggggagaaaatcccaaaacataaaggagtatgaaacagaaagaccagatatgaggaagggtaagatggcatcagcctagcattaatgattattaaaagattcactacaggtttatcttatgtgaaatcaatcttcctttaggccccacaatctctgagtacaaatggtacaaactaagagtaattaatggtgtatatatcacattctccaatagtacagagtctccatctctcctacttatttttgggagtcctcagggtgtaccttacctgccttaaaatgtgaccactgagcctgcattgattccatcgatgccatcagcttctgctggtcacacaggtaggaaggggccctgccacgggtccgtagtgatgcttccttcattaggctgctgccttctgttagcacactgacccattctatcgggagcatttgatgcactgaaaccataccaaagctcatgccttctgtgtttactcacgttctgagctgagaacatggatccatgggaggctgaggtgagggataaatccaaggtacaaactacatgctgaacttggaatcatctagacactgaggtccatggccttaactttcatgaggaagagttcttgactcagaaggcctgttagtctctcatgtaaataactacaactagcttgtctcccagacatttctgcatcccagatgtggtgcaacttgggttccaactgaagtctgtcatatttacgtatgtaaaatttgacctccagatttttgtcagcattggatgaatcagtttcttcccaaactctggcttaagctctgaatcactgatcactagtctggtcgggtataatccaatacactgggactcagccatcctttaactcagtggtctccatgctttttggcgccagggaccagtttcatggaagacaatttttccatggacctgggaggggtgggggtgtgggaatggttttggaataaaattgttctacctcatatcatcaggcattggattctcataaggagcacgcaacctagatccctcacatgtgcagttcacaatagggtttgcactcctatgagaatctaatgccactgctgatctgacaggaggcggagctcaggtggtaatatttgcacgcctgctgctcacctcctgctgtgtggcctggtaccagtccatgggctgggttaaggaccccttctttaactcatgaaatctcacggataactgattccagacttcaaatcattgcacacttaaaaaaacttttttacaatcatgtttgttaaaaaagtactgcaggtaggaagaatgacaatacacttgaacgtaaacatggtttgtcatatatattggtcaaaacaaagcatgtatttactattatttagctacaatgttagaaaactgccattgcacatactccagcctggaatttcagtaaacgcttttcactgtctatgtgcaggattatgttaagcccactacattttaatgttattgctgcagttataacagacatcaactaccaattagaataatgttttatttactgtctatatcaagaaaaatcccattttaaaatggttaaaatgatctactatatctcagttacattgtaataggatactagctaatatctgtcatgataaaatctggagtaaatcagttaaattattaatcttgataattttaagataaaataaccctttgttctcaaatttaaaaacttcatattttaatatatttgtgagctaacaatagaaatgcataccaaattccaggacaatgttttctttaagcaaaaaattaagcctgaatgttggtgcctttagaaagtaaacagctaggccaggcatggtggctcatgcctgtaatcccagaatttcgggaggctgaggcaggcagaccacaaggtcaggagttcgggaccaacctgaccaacatggtgaaaccccgtctctactaaaaatacaaaaattagcagggcatggtgatgcgcgcctgtaatccctgctacttgggaggctgaagcaggagaatcacttgaacccgggaggtggaggttgcagtaagctgagactgtgccactgcattccagcctgggtgacaaagagcaagactctgtctcaaaaaaaaaaagtaaacaactatggattttggcctgctatatctctgggcagctcttgcagtcatatctagtcatatgagtcaaagctcatattatcatctttgctgtctttcttcttgcctaccccaccctcttttagcaatgatgataattataacaacagcaaaaatataatataaacattacattagcattttagcaggaactggatattttcataaataggattcctaaataattgaactttattggctaacattaaaaagcttaaatatttttgatggaaaatgtataaaatttacatacattaagtaaaatttatatgaaatatataaaataattatatattatcaccgttttaaaattttcttaatgaccaactgcttcgagttctagaaccattggtgctcttcagatgtatttattcattcacttttccattcattcattcatccattcaacaagtatctattgagtgttactatgtcccaaggaccaaaaaaggcaggagagatacagcagtgaataaaacacaattagtgctgtcctgatggagcttgagttcaagctggtatgcaggatgttttcctctgcaacaaatgggccctgactgctgtggttttagttgttctgtctcctccctctgctgtcagctgtcacctcttggtggcaccctatctctccctttttatctgggttacaattgcaggtctttccccaaagcatctctctatgtcaataatagaccctatccttggatggagcctgagcagttcctatgcttgcagtgtatgtgctgcttccggcccttgcgaggagttcttttatccctactctcagtgtttggaacaaacatcttcctttgctccctttcatcattcatgcgcttgtgtttggaacaaacatcttcctttgctccctttcatcattcatgcgcttgtgtttggaacaaacatcttcctttgctcccttttgtcattcaagtgctcagttctaatgatctgattcaattcttaggcccaatggtctctgcaccatatatatgcaaatgggactcttagaaaagtgtccatcaccaagtgatattacattctaatattgcagtataaaacatgatctttctcatcactgtggtagcttttcctgataattttctgaactgccacctaaatataaaaaggcaggcaccaaaactttcaaaaggaaaggaaatcaatttccctttactcccgtgttttgctcattgctaaaactgcctggtaggagtgcagggacacaagcaggaattctgaattgcacttaaggaaatggtagtaactaaggtgataaggaatatctaacactcattcatagactcatcagatgttggagttgaaaggggatcactctgtgcggtagtgaagcatggtggttaagaactccagttctgggaccagattgtcatacgtcttacaattgtttgaccttggcctggcatctccatgcttcaatttattcatctgtaaaatagtatgtttttcacaggattgtgaggattaaatgaattaatgcaggtaaaacgcttggtagtgtgtctggcacacagcaagcacttagtgttagctattattatcccaatctcgtcacatatttttacagatggaaatacagccctaagcttttaactgaacagcaagttagaggtaaaactgatgccaaaaccgggtgtcctgattctcaccatattatagacttttttttccctgatatcgtgctttcttaataaatgggaagaaatactgaatcatgtacatgattataaaatgactactcagttatacaaaagtccttcttcccctctaaaacagaaatataaaaatacacctttgcccagtgctagtcctccagctcccaatgggcaggattaattctctagaggcatgtgacagagctcaggaggccaggagaagtttaactgtatgcactaataaggaaaccattttcttccttaccttaaacttgtcaacttcagcttttgaacatgttgcatggtatgatagcacctgattcagaagaaaaaaaaataattttaataactagacatgactgtattttctgaaattctcctggcttaaaaataagctttgcttatgtatatcaccttgatttaaaggtggactttaatgtatgacaagaaacaacatgtctaataacattctctgacataattcacatattaaagaatattttataccgggatttttctatgggtagttatgtcatcaaaaggacaatggccaggtgcagtgcttcgcgcctgtaatcccagcatttgggagggcaagatgggcagatcacttgagcccaggaatttgagaccagcctgggcaacatggcgaaaccttgtctctacaaaaaattcaaaaactagctgggcatggtggtgtgtgtctgtagtcccagctattcagggaggctgagatgggaggatcacctgagcccaggaggtcgaggctgcagtgagctgagatcatgccactgcactccagcctgggcgacagagtaagaccctatcaaaaaaaaaaaaaaaaaaaaaaaggcatgctgtggctcaaaactgtagttcccaaaggatgtgaatacttgtcctgtgaaatgctctacaagcaaatgaaaagctagagcatgtgtgtgcgatctgtagcaaacactgtaggttgatgactcaacttccatttcctcacctattctcatttgcctgcttttattatattaggaaagattatattgatatatatctgtgaccccttttgtaagaggattgtgcttccctgccctattgacatcagcattggcatatgacttcttttggtcaatgggaaaagtaacaaatgcccttttgagtgtgtcttcaacagcaatcacatagttctgccacctcctttttccctccaccaagggaagggcatggcctgagaggggccgatccttcagtctgagcccccaaataaagaagatatattgagtagaactgcagccaacctgcagctgatggcatgtcatttgagtgagaatcaacttttgcaatttatctacatcataactcactgacacagaggcttaaaagttaaaaaccccaattcgcaggctccctgcagctggggtggtcctatagggtggcctttatgacacggccttggtcaatgaattataagtgggagtgtcggcgctgcttctttctttttcttccttcatggaatacagctgtaaagcctggaggtgcagcaaaatctggtgtgtatgaggtgacaagcatggcagtgaatgccagcttgctgtgaacagaacagaaagggaaagagaaaggaccctgggctcccctgccccagaattcttgttgtgtgagacaaataaatgcacattggtggcattttataaggcatatttacagacatatacacactcacacataaatagcatatgtatgttatatgttttatgctgccagacacatgtttgttgtggttttgtttttgagacaggtctcactctattgcacaggctagagtgcagtagtgtgatcatagctcactgaagccttgacctcctgagctcaagcgattctctcacctcagcatcccaagtagctgcgaccacaggcatacaccactatgctcaactaatttttgtattgttttgtagagacaggtgtctcatcatgttttccaggctggtctgaaactcctgggttcaagcgatcctcccgcctcagcctcccaaagtgctgggattataggcatgagccttcgcacccagcctacattcttaatctacacaaatctcaaacaaataagtctgggaaatgctaactccttcttcacctacaaaccttagagaatcacagtgcatatttggctgcaaaaagtaaagtaacatgctttatttcattaaacttagtatttcccaaatttaattagccacagaactcccttttaggtaacattaaactggtaacattcaacctaataacctattgaccaagaactttgagaagcactgacctatggcacataccatttgtgtgatacaagcaaagccacaatggaagcagtgtctcagggtggttagaacacagccttcagagtcaggctgccacgcctccacttccgagccctgggagcttgggcaagtggtttaatctctttgggtctcatttataaggtggtataacataatactacacaggcatctcctgcttaacgtagaggctcctcctgaaaacactaacaaggagtctacttttaattatttttaattggaaaaaaattacagtgtattataagatctgcagcaacttcttaaaactcaactaaagcacagtaaaattcataggtatatttaaaacaaaaaatacagttatgttatagttacttaaaatgttactttctgtgggaggctgaggcgggcagatcacctgaggtgaggagttcaataccagcctggccaacatgatgaaaccccacctctacaaaaatagaaaaattagctgggcatgatgatgggtgcctgtaatcccagctacttgggaggctgaggcgggagaatcgcttgaacccgggaggcggaggttgcagtgagccgagatcgtgccattgcactacagtctgggtgacagagtgagactctgtctcaataaataaataaataaataaataaataaaaataatgctactttctgatcataactaatatagttattaacaaaaagtttctttgtgttaagtaatactttctcttccattgtagacttttttttactgagtttacttgtttttccatagttttctcaatccttttttatctttgggaggggactcagaaaaatgttgtattgagagataaatatgttctatgaggtttggttattaaaaataaagatatattctactgggaaattttaaccaaggaaatattctatggagtgggcctgtactttacagagttcttaggaagattaaatgcaatactacatgtaaaataatgtggcacacaaatagccaacttataggtattgtattaatattcaattaaaattctaccaaataaatatttggctggatattatgttatgtcattatcttatcttaaaatatcaataggtatttcagtgcacagatgaattgattttgctcttttgtttcagttttactgtggtaaaatttaatttggctgtcattttattagaatttcttactgttttcaagtctatttctgcagattcactcttcaaactttacctttaaaaaataacccacaaaaactcaagctgcaattcaaaatctatgccaccaggtggtgcttagttaggtttgtttaaatcaactcttcccacttcctttatttaaaaaaaaaaaaaagctatttactccactaaattgaaacaatttgaaacagtgaagcagacaattattacagattaagacttttgctcatttaaaattacaatagtttgttttgtttgttattgagttgtaggagttctttgtatattttggattcaagtcctctgtcagacatatgtttcataaatattacctccagtctatggcttgtctattaattttcttttaatgtgtcttttaataaacagaagttttaaattttgataaagtgtaatttgtcaattatttaaattgctatcgtttcacatattatttctttctttttttttgaagagtctcactctatcactcaggctggagtacagtggcatgatttcagctcactgcagccttgacctccctggctcaagtgatcctcccacctcagcctcccaagtagctgggattacaggaacacaccaccacgcccaggtaatttttttatagaaacagggtttcactatgtggcccaggctggtcttgaactcctggattcaaacaattctccctcccaaagtgttgtgattacaggcatgagccactgtgctcaatctcacatatcctttctaaaatttttttactgcccccgagttgtgaatatatacctcatgctgtcttctacaaactttatagttttatcttttatgtttaggtctatgatacatctgaaattaaatgtatgtacagttaaagaataagaccttaacgaaataaatacatgctttggttactttttcatgattcttaaatttcatgggccacatcttagacctaaagcttttttggattgtatcctgagattttaagcctctactggctaatctattaagtacataggaatttatttattctacctaattagacaaagttaatgataaggaagcttctggtttaccttctggatcttcttgtttctgagagttcctgtttgtaggactccaagaaccagtagaggggggagagaaatggtctagctaaagaatctttcaactaccttttcccagaagagtacaatccatgttggtgagcagggaggaatcatcggctaataggagtacattgttctgaaggactgggccctattgctaaaccacagtccaggaagatggtagcattgttccctctaagaatccgtagaaaaaccaacaagccagaggagtggattccttaagataagagacccttaaatcttgcttaagaactctgattttcttctttaagcagttccttctgtttggtcccataggattttctgggatgcattcagaaagatggtggtgcttcagtttaccctcagtgtttgcaggttttacacacagggcacagcgagaacccagtaatatctgtacctctttcatgtattgtatcaatttagccatcatgcgattctgactggatgtaaatacacaaccaagctaagtttctgcttagctcccagcttcttgttgaaaagcctgtgaccaaatgtatttgccttgctaattttaacaagcatctacacatgctattgtggtcacataggacttttccccatcacctatggtcactggccatatcccatttactcctcaatatgcctcagttttggttctgcccccacctctccactggaacagctcgtgtcaaggctttcaatttcttgccaacaaatccattgatgaatctccaattgccttttgcagcagtattaaacttgggagagcactcactcctattttgaaaagtctcctttctgggcttccatgacaccacattattttggttttcatcctatttctttggctgctctttatgttttcttttttggcccctcatcctctaccttaactgtaaatgtggaagcttctaggctcagtctcttcttcagtgatgccatacactctcatggctttatacaccatcgttgtgttgataactttcaaatctctttgagttttgcactcacatattcgtctgcctacattactaacttccaacttggtcaattcactggcttttcaaatttaacacgtctaaataaacatgaagattttcccatatgtgatagacagaataatgctcccccacaagatgtccatgtcctaatcactggaatctgtgtatatgatatgtcacaaggaggaactgaggttgcagatggaattaagattgctaatcttgtcaccttgagatggattatcttggattatctggctttgcttcatgtaatcacaggggtccttataagtgaaagaaggagacaggagaatgagagtgatgcaatgtaagaaagacttgactagccattgctaactttgaaatggaaggggccacgagcacagaatgcaggtaggttttctgtggaaaaggcaaggaaatggattgtcccctagagtctccagaagaatgtagccttacatacatcttgaattttgcccagtaagacccatttcagacatctgacctgaggattgtaagataataagtatgtgttgttttaatccactaagatcgtggtaattcgttacagcagccacaggaaactaatataccacacaaacccatttctctctcagtcttccccagctctgtaagtgccactccatccaatcaattagtatcaattggatactaatccagtctccttggtacacatcagccagagtgatctttaaaaagtagaaatcaaatcatgccatctcccagctgaaaagtcaccagtggcttcccactgcacttttgctgtatttccttcaatggcatccacagattggtcacaaatctcaggttcatgaggttaggtccaaagcctggatcgtgactggacaggtcctgcaccatctgactgttggcacgttctcaaactaaacttcgtgctgcctgtgctctgtcttctacacacttggccacactcatttttgttcatttttgttcatttatacaccaagcgcttttctacctcagagcttccctgtcctcatcacctcattggtatcatcttctgaaactaagttaaatgtcaccccttcagtgacttattccctgaccaccatgagaaatcagcctctgttaactccattattctctgagttaagtggctgtttccttcatgccacttgcacaattggagttgcctgttatcttattcatcacctgcctcccctactagactgtaagcactttgaaggcaaggattggtctagttttggtcatgaaggtatatcctatccctgggagtatggttgatacttagttggcacttagtaaatatttaatgaatcaaggaataaaaaataaaaacattttaaaacagtatctccattacccatatgtctcactgtttgtattattaatggcctgaattagtgtatttttttcaatgaaatcatgatatgccttatatatgagcataaagtaagcaatgtaggtaggatcaccagttttagcaaataaaaatagaggacacccacagttaaacttgaatttcagatcagcaataaatattttcactatttgtgtcatatgcatacttaaaattgatttatggtttatctgaaattcaaatgtacttaagtgtcctgtattttatctggcaaccctccttctacatgctccaaattaagaaggctagaaacaaatccggaaaacgctaagctacatgccaaaatactgtttctcctttcacccccacctcacaacatctcccaatgacatttcttccaaaatattttatctgctaagcttaccaaatgcctcaagtctgaaatattttcagcaatgctactattatgaggggaattgtgccccccaatccccaccaattcatttattgaatttctaattcccaggacatcagaatatgactgtatttggagacagggcctttgaagaggtacttaaggtaaaatgaggtcatgtgggatgtgggtgtgtcctaatccaatatgactggggtccttacaagaagaggagttcggaatatgaataacagaaatagaagaccaggtgaggacacagagagaaggtggccatctgcaagccagaaagatagccgtcaccagaacctgaacatgttggcatcctgacatggtttggctgtgtccccaaccaaatctcatcttggattgtagttcccataatgtctatatgtcatggtaggaacctggtgggaggtaactgaagcatgggggggcagttaccctcatgctgttctcatgatagtgagtcctcatgagatctgatggttttataagtggcttttcccccttttgctcggcacttctccttcctgtaccatgtgaaggacatgtttgcttcccttctgctgattgtaagtttcctgaggcctccccagccatgctgaactgtgagtcaattaaacctctttcctttataaattacccagtcttgggtatgcctttattagcagagtaagaaggaactgatacacaccctgattgtgaacttctagcctccagaactgtaagaaaataaatatttgttgtttaagtgacccagtctgtggtattttgttgttatggcagcccaagcaagtttatacagtcacataacctcattaacctaagacctgtcacaaatctatggaggccattgaaggaaatataaaaaaagtaattcttaattacttttagcatagtcaatcttcaagagaatcgttactgttttatatacataaataatattatatggctcagataatgactaaaaatcaggcaaatttctatagttgagaataaatcttaacaaattgcagaatcatattatttaaaagtactattgccctaccttcctggataagttagtttcctccacaattccaaactatatatttcatagcaagtatctaggttcatcatacatttttgaataataatacctttgatcaagtaaaaatgctttaattgaatgcattataatagttttgaagaaagaggcatttgtaagacatggttttataaatatactatcatactctatgagaaacaggttatgagagtattactataacgtacatatcagttaattttttcgacagctaaataaaatttgtgtaaagcatacatacaaaagcaaacagttaatccacagaacacttgatgagcattaaactttcacaagaaaatttctgatagatggatttatcttttgtgttggtattaattgagcaaatatttttgactcagttttgttggtgagctctgacttaagaaatttttatagtttctaaaataaatcactatttgcaaaaccataccaactttaattaacttttggattgaacttgcttccagcaaaacaacaacaaaaaagcagataaggcaattatcggacccatgaaagagagaggaaagaagtcacgtttttgtgttgcatttacacagcaagaaaagacaattaactatatttcaaaagaaaaacaatgggcagagctatgagataggaccactggatcaagccttgccattctctacatgcagttcaggaccagaaccaaatgcttgtcttgcagcccccagaactgtccctgagtagctggaagacagacctcttgcaccaattgtcttgaatgttaatttgttgtggatttgggcagccatttgctcctgaaatgagatatggaccattataccagcagagagaaacacaaatgtaaagaagcacttaagagcgaggaggaacaaagaccccactgaggatccagactgagtgtctcaggcacaaaagggctgcatgaatacgtttattgctctgctggcaaagtggcacttggtaaaggctggatggccgacttaagctaagctgatctgaagtaaaatcccaaataatttatattgatgagctccaaagaaataaagaagctttgctctcagcagtagtccttaaactaagaaagatgacaaaccacaaggaatgaaaagccaatttacttggaataacccgacagaagtgtcatctaactatatgaagaaccatactccaggatttcttaacaagatgatgacagtattcaaagacatggcaactgaacagacgcgttgaaactgagaaatcatcagtttttattgtcaagtatttaagacactgctgtataatagaatgaaatgttcaaaaggtacttcagataactgtgtctgctgtgtgatctgttatcatgaccttcagaatcgatcataaaaaatatttttaaaaaatctaagaaagattcatttttttaaaattgaaagtagaataaaagatacctgccaaacatggggtaataataaaatacaggcatacctcagagatattgagagtttggttccagacgacctcaataaagtgaatgtagcattaaagtgagttacatacgttttttggtttcccagtgcatataaaagttatgtttatactatgctgtagcctattaagtgtgtaatagcatatctaaaaaacaatgcacataccttaatttaaaaatacattattgctagaaatgctaatgatcatctgagccttcagcaagtcgtaatatttttgctggtggagggtcttgcttgaatgttgagggctgctgatagatcagtgcggtggttgctgaagctatggcaatttcataaaataagacaatgaggtttgcacatgaattaactcttcctttcatgaaatatttctctgtagcatacaatgctgcttgatagcattttacccacggtagaacttctttcagaattggagtcagtcctctcaattcctgccactgttttgtcaactaaatttgtgtaatattctaaatattttgttttcatttcaataatgttcacagcatcttcaccaagtgtatattccatctcaggaaaccactttctttgttcatttatgagaagcaactcctcatctgttcaagttttaccatgagactgcaacaattaagtcacatattcaggctccacttgtaattctagttctcttgctatttccaccacatctgcagttacttcctccactgaagtcttaaacccttcaaattcagacatgagggttagagtcaacttcttccaaactccggttaatgttgatattttgacctcctccagggaatcataaatgttcttaatggcatttagaatggtgaatcctttctagaaggttttcaatttattttagccagatccattgttggaatcactatgtatggcagctacagccttacaaaatgtatttcttaaataataagacttgaaagtagaaattactcttgatctatgggctgcagaatgaatgctgtattagcaggcatgaaaacaacattaatatccttgtacagctccaccggagtgtttgggtgactaggtgcattgtcaattagcagtaatattttgaaaggaatctttttgtctgagcagtaagtctcaatgggaggcctaaaacatttagcaaaccatgctgtttactgatgtgttgtcatcaagactttgctgttccatttatagtgtacaagcagagtagatttagcataattcttttattttttattttttagacagggaatctcactctgtcacccaaactggtcttgaaatcctgacctcaagtgatcctcccgcctcagcctcccaagtagctgggactacaggtgtacaccaccacttctggcttgatttagcataattcttaagggcccgaggattttcaaaatggtaaataagcactggcttcaatttaaaatcaccagcaacttaccatagcccctaacaagagagtcagcctgtgctttgaagacattgacttctcctctctagttatgaaattcctagatggcatcttcttccagtagaaagctgttttgtctgcattgaaaatctgttgtctactgtaacaacctttatcaatgatcttagctagatgttctggataacttgctacagcttctacatcagcacttgctgcttcatctcacacttttatgttttggagatggcttcttcccttaaagttcatgaatctctgctagcttcaaacttttcttctgcaacttcctcacctctctcagtcttcatagatttgaagagaattagggccttgatctggattaggctttggcttaagagaatgttgtggctcatttgatcttttcttcagaccactaaaactttctccatatcagcaaaaaggctgtttcactttcttattattcatatgttcactggaacagcatttttaatttccttcaaaaacttttcctttgcatttacaacttggttgtttggcataagaggcctagctttcagcctatctcaccttttgacatgcctttctcactaagcttaatcatgcctagcttatgattaaaagtgatagatgtgcaactcttcctttcactggaacacttagaggtcattgtagggttattacttggcctaatttccatattgatgtgtcttggaaaacagagaggcccaaggaaagggagagagatggggaagagctggtcagcagagcagtcagaacacaaaacatttatcaattaagtttaccgccttatatgggcacagttcatagtgccccaaaggattacaatagtaacattaaaaatcactgatcacagataattgtaacagatataataagacgtataaaatgttgtaagaattaccaaaatgtgacacaaaaacacaaagtaaacacacactgctgcaaaaatggtgccaatagagtttgcggtcaatttgagaccttgcccatcttggctgaattctcaatttctttttcttttcttttttttttttttgagactctgtctgtcactctgttccccaggctggagtgtagtggcttgatctcagttcactgcagcctccatctgctgggttcaagagattctcctgactcagcctccaagtagctgggactacaggtgcgtgccaccacacccagctgatttttgtagttttagtagagaaggggtttcgccatgttggccaggctggtcttgaacttctgacctcaggtgatctgcccgcctctgcctcccaaagtgctgggattacaagtgtgagccaccatgtccagctgaattctcttttaattaaacttcttgaccaaagagatatgccgtttttgcttttgttttatccaaaggtatgaagccaactctccagtggtttgagtgggccctcaacttgggatgagaaattcattcaccattttttcacccaaatcaaaggtttaatgtaatcattctatgtcattacccagattaaaatgttaattttagtaaccacactttaaatctcaatctaatttttaaatgcaagccattaagatgcattcataaggctaaatactattcattagctagtacataatgacaacactgacattcatttggcagtttcccaaactatctttccctctaaatattggtacctgtgcccttgccagaggataacatatcttgtattatataaatcttgaaatttaacaggtactttgcaactacatccaaattattatctggtgaattaagatgaccacacattctttgacactatttctatgagaggtggggtctatgtcccttccctttgactctatgtggggtttgtgtttaaaccattaagttgccaaaaagtggttaaaaagcaataaataaacaaaacattatcaacattcaactgggacttgccaccctatgccatccaaagatttctgtaatcaggtgtcaactgaagcttccttgtctttcaaaatctaggtaagatcaacgtgaacccctaaactcatgaaatactatggaaattcaaagcctttttcaaaatgtctacatattcttggcaggtttatattctcatcttggcctttgagttcttatgtattcttgtgctgtatctgttatataatcatcacactaaatgtgaaattcagctccctcctcaatttccacaccaaaaaaatccactcacatcaagaattcataaatttagtataatgtgaagaaggttctttcttttttgcttccttccttccctcttcccttcttccctacttccttcctttctctttctccctcctttttcttctctttctctccctttcttttctttctttccttcctccatccttcccttccttctttctctatctctcccctctccacttgctttctgaaaagacaaattatgaagttgcatcaaaacaaacaaacaaacaaacaaacaaacaagcaccctctcatgaagtatcagctccaccattctcaaaatagattttgcccctgccaccaatggggcatttcactgaccattaatctcgtacagtctcagcctttactcatatttctggcttctctccaatgtaactttctctttttctcttttccccctccctatattcaaatgtataataacacaattctcttcatttctcatacagaatcatttcccacatcctctgattactagaggcagtcaatattcattccctcataatctgtacaatatcaagagggcttgtcaaggattttcccatacaactccttccttagtcttagtgaggaatgctggggcctatggttagataacatttcattcaccttgttatacttcagaagttctcatatgtgtcttaagttatttattagctcagtggttagattctagtcttgtccatgtttttgaggtggtttttttccccctggaatttggactgatttctaaattctttctgagcaacaagtacccaaactaacattttcatatttgtcttccattttttctattaagctcattaaaattactactaccttttttcctgaggccctgcaagctaaagcttattccttgcaatataggcaagaaaaatgagtcagattgccactgcattactcttctgtaactaaagatgctttaagtctaacatctggatagattttgcccaaaattaacctttgtttttattctgtttccacaaaaacgcctcttattgaaaatctgtttggctttgtatttcagacaaaagggtactggttttccagcctattcacttagatttcaaatggcattgatctcttcctataagcattgttaaactggggttaagcattttattaattatcactaggtgctatttcatttaaaaaattatttgttatattcaacaggtattcagatgggtaaagtttatatcttccaggctaccaaagttccagacaaacatgataattgactcaagggttccagcctgtgccactgcaggaaggactgagtccctataaatcattagataaggtagtgagagatttctatgcctccagatcagatagagatgacagctcctgttcaggatgaagcagttacagaagatgaaacctctgtccctctacaaccttttaggattaaggaagagtgcacagtctctgaggagagatgaaaaaggaattcagcaggacttgtttcacaagatacagaccacaaagactgctgataaaacaggatgtggtaaagaagtctgccaaaacctgccaaaaccaagatggctatgaaaacaacctctggtcattctcagtgctcattatacactaattataatatattagcataccaatggaaactccaccaacatcataacagtttacaattacaattacagttacaaatgccgtggcattgtcctgaaactaccctatatgatctaaacgggagaggatccctcaattctgggaactctcagctgctttcccagaaaactcatgaataatctactccttgtttagcacataatcaaaaaataaccataagtatagtcagtcaagcagcccatgctgctatctgcctatggggtagccacccttttattcctttagttaataaagttgctttcactttactctgtcactttactgctggctttcactttactctatcactttatactttattgctggctcttgaattctttcctgcacaagccaagaacccatgtgacctcccaagctgagttccaattttgaggtttgccctgtgacatctttggcttatgaaagcaatctgattaagatccagcttaaaattataatcatgtaagtcaactctactacatagttttgagcacagaaatcagaattcatgctatgaattgccctaggcttgtagtctgaacttgttctctccctatttgcaggggtcagtggtaggatttaatctgtttatacggattaactgctgtatagattacctacagcaattcttaagacaggctgtttcctttcatttagtaaaactttgttttcttaatttgtcaatgcttagtgtgccaacaatggggggccagtatagtttggtctttgagcataggggctttgtgtcagactgctgagctcacaatcctggctcactagacctgtaaccttggcctaattatataacctatgtctcagtttcctcatcagtaaaaggtgagaaatatatgcacttttcaatcatatttcactggccagagcaagttacagcactccacctgatttcaaggaagtgaggcagtgtaatatgatcatgggcccagataggagagaaccagaaaaaaaactgatgatgagcactgatggtaaccacaatggtttgggcaatcaaatagcaagttatgttagaatagcgtttaaagacaattctgggagggcagccaagatggccgaataggaacagctccagtctacagctcccagcatgagcgacgcagaagacgggtgatttctgcatttccatctgaggtaccgggttcatctcactagggagtgccagacagtgggtgcaggacagtaggtgcagtgcaccatgcatgagccgaagtagggcgaggcattgcctcactcgggaagcacaaggggtcagggagttccctttcctagtcaaagaaaggggtgacagacggcacctggaaaatcgggtcactcccaccctaatactgcgcttttccgacgggcttaaaaaacggcgcaccaggagattatatcccacacatggctcggagggtcctatgcccatggagtctcgctgattgctagcacagcagtctgagatcaaactgcaaggcggcagcgaggctgggggaggggcgcccaccattgcccagacttgcttaggtaaacaaagcagccagaaagcttgaactgggtggagcccaccacagctcaaggaggcctgcctgcctctgtaggctccacttctgggggcagggcacagacaaacaaaaagatagcagtaacctctgcagacttaaatgtccctgtctgacagctttgaagagagcagtggttctcccagcacgcagctggagatctgagaacgggcagactgcctcgtcaagtgggtccctgacccctgacccctgagcagcctaactgggaggcatcccccagtaggggcagactgacacctcacacggccgggtactcctctgagacaaaacttccagaggaatgatcagacagcagcattcgcggttcatgaaaatccgctgttctgcagccaccactgctgataccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacggaacaaagctggacggagaatgactttgacgagttgagagaagaaggcttcagacgatcaaattactctgagctacaggaggaaattcaaaccaaaggcaaagaagttaaaaactttgaaaaaaatttagactaatgtataactagaataaccaatacagagaagtgcttaaaggagctgatggagctgaaagccaaagctcaagaactacgtgaagaatgcagaagcctcaggagccgatgcgatcaactggaagaaagggtatcagtgatggaagatgaaatgaataaaatgaagcgagaagggaagtttagagaaaaaagaataaaaagaaacgaacaaagcctccaagaaatatgggactatgtgaaaagaccaaatctacgtctgatcggtgtacctgaaagtgacggggagaatggaaccaagttggaaaacactctgcaggacattatccaggagaacttccccaatctagcaaggcaggccaacattcagattcaggaaatacagagaacgccacaaagatactcttcgagaagagcaactccaagacaaataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaacactttacagacaagcaaatgctgagagattttgtcaccaccaggcctgccctaaaagagctcctgaaggaagcactaaacatggaaaggaacaactggtaccagccgctgcaaaatcatgccaaaatgtaaagaccatcgagactaggaagaaactgcatcaactaacgagcaaattaaccagctaacatcataatgacaggatcaaattcacaaataacaatattaactttaaatgtaaatggactaaatgctccaattaaaagacgcagactggcaaattggataaagagtcaagacccatcagtgtgctgtattcaggaaacccatctcacgtgcagagacacacataggctcaaaataaaaggatggaggaagatctaccaagcaaatggaaaacaaaataggcaggggttgcaatcctagtccctgataaaacagactttaaaccaacaaagatcaaaagcgacaaagaaggccatcacataatggtaaagggatcaattcaacaagaaaagctaactatcctaaatatatatgcacccaatacaggagcacccagattcataaagcaagtcctgaatgacctacaaagagacttagacttccacacaataataatgggagactttaacaccccactgtcaacattagacagatcaatgagacagaaagttaacaaggatacccaggaattgaactcagctctgcaccaagcggacctaatagacatccacagaactcttcaccccaaatcaacagaatatacattcttttcagcaccacaccacacctattccaaaattgaccacatagttggaagtaaaggtctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacgtaatgaaatgaaggcagaaataaagatgttctttgaaaccaacgagaacaaagacaccacataccagaatctctgggacgcattcaaagcagtgtgtagagggaaatttatagcactaaatgcctacaagagaaagggggaaagatccaaaattaacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttcaaaggatcaacaaaattgatagactgctagcaagactaataaagaaaaaaagagagaagaatcaaatagatgcaataaaaaatgataaaggggatatcaccaccaatcccacagaaattcaaactaccatcagagaatactacaaacaactctactcaaataaactagaaaatctaggagaaatggataaattcctcgacacatacactctcccaagactaaaccaggaagaagttgaatctctgaatagaccaataacaggatctgaaattgtggcaataatcaatagcttaccaaacaaaaagagtccaggaccagatggattcacagccgaattctaccagaggtacaaggaggaactggtaccattccctctgaaactattccaatcaacagaaaaagagggaattctccctaactcattttatgaggccagcatcattctgataccaaagccgggcagagacacaaccaaaaagagaattttagaccaatatgcttgatgaacattgatgcaaaaatcctcaataaagtactggcaaaccgaatccagcagcacatcaaaaagcttatgcaccatgatcaagtgggcttcatccctgggatgcaaggctggctcaatatacacaaatcaataaatgtaatccagcatataaacagaaccaaagacaaaaaccacatgattatctcaatagatgcagaaaaggcctttgacaaaattcaacaatgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctgtcaccactcctattcaacatagtgttggaagttctggccaggacaattaggcagaagaaggaaataaagggtattcaattaggaaaagaggaagtcaaattgtccctgtttgcagatgacatgattgtatatctagaaaaccccattgtctcagcccaaaatcttcttaaggtgataagcaacttaagcaaagtctcaggatacaaaatcaatgtacaaaaatcacaagcatttttatacaccaataacagacaaacagagagccaaatcatgagtgaactcccattcacagctgcttcaaagagaataaaatacctaggaacccaacttacaagggatgtgaaagacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcgccatcaagctaccaatgactttcttcacagaattggaaaaaactactttaaagttcatatggaaccaaaaagagcccgcatcaccaagtcagtcctaagccaaaagaacaaagttggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagacatatgtagaaagctgaaactggatcccttccttacaccttatacaaaaattaattcaagatggattaaagacttaaatgttagacctaaaaccataaaaaccctagaagaaaacctaggcattaccattcaggacataggcaagggcaaggacttcatgtccaaaacaccaaaagcaatggcaacaaaagccaaaattgacaaatgggatctaattaaactaaagggcttctgcacagcaaaagaaactactatcagaatgaacaggcaacctacaaaatgggagaaaatttttgcaacctactcatctgacaaagggctaatatccagaatctacaataaactcaaacaaatttacaagaaaaaaacaaacaaccccatcaaaaagtgggcgaaggatatgaacagacacttctcaaaagacatttatgcagccaaaagacgcatgaaaaaatgctcatcatcactggccatcagagaaatgcaaatcaaaaccacaatgagataccatctcacatcagttagaatggcaatcattaaaaagtcaggaaacaacaggtgctggagaggatgtggagaaataggaacacttttacactgttggagagactgtaaactagttcaaccattgtggaagtcagtgtggagattcctcagggatctagaactagaaataacatttgacccagccatcccattactgggtatataccccaaggactataaatcatggtgctataaagacacatgcacatgtatgtttattgaggcactattcacaatagcaaagacttggaaccaacccaaatgtccaacaatgatagactggattaagaaaatgtggcacatatacaccatgaaatactatgcagccataaaaaatgatgagttcatgtcctttgtagggacatggatgaaattggaaatcatcattctcagtaaactatcacaagaacaaaaagccaaacactgcatgttctcactcataggtgggaattgaacaatgagaacacgtggacacaggaaggggaacatcacactctggggactgttgtcgggtggggggaggggggagggatagcattaggagatatacctaatgttaaatgacgagttaatgggtgcagcacaccagcatggcacatgtatacatatgtaactaacctgcagattgtgcacatgtaccctaaaacttaaagtataaaaaaaaaaaaaaagaatagtgtttaaagtcagagcaaatgagtccaatgtatgaactctagtatatacatttgtggtttatttgacttttgcttacttcctgattctctcctgtgtttcagggttgtgtttgatagatatgatctccaaataagtaagattatagtatatgtttcttaaatattgtttatatttaacatacatagtacatagagtatatgaccattaagtactattgcttttactatattttgttacctataggagaaaataattatgttaaggaaaatgattggcttatttttgttctataacttttgtgaaatgcttagttattaatttcaatcatttcaatgtccttaaggtgaaagaaattgcctatttctttggaaaacgttgcatgtgataatgagtcttctgatttttctaagtttttagtattctcctataaaggatctcaggcattaacacttaaaaaggttttaatgattaattcttagtgagattaaatatggctctatacatatgcatattggactataatttataactatttcaaaattagtgttccattcccacaattgcattactcctctcattctgttttaaagtgaggctgtttttcttaatcatataggttattaaatgtattaatgtttcacaaattcttttctaatgaactacttgcttatttgcttttctcattaataagaacagagaagaacatagcattcttcgggtataattgagcaacttggattggttattgctgtttctgaaaccactataatatgtgccaaattgttttcaaatctataacttatataactagaacttttagtagtctgatttcacttaagaccatacttctgagtagcatgttattaaatatttatatatactgattttccattcctctccccccatggtttttgcataatcaaaggattaccattatgctttgagagagagatacattgcttatttgcactggttatgcaggaacaccatggagcattttatgtttgaaacagcgtggctctgctgggagctcctgaagtaaaaggaataaggagagatcaggcctagtttgggccactgtcaaactcactagggccacagaagtgactcgtcaccatggatgaaataaaaatgcaaagggcaatttccaatctgtctggaccaaggttgctggccatggagatcagattagatttgagtaaaccagggaatcacatcaatgcagtctgggatgtaccgatgaatgaaccattcattcaatcaagacatatccattgaagacttaatttgtgcccagaactgcgcagtcactaaacaggcaaacatacaagttgaaataattgctacaaagtcaagtagcaaaatgcgaaagaaaccatgggaggaggtgggaagaatggcagggagtggcagggaagttggttagggatgacctctttgagacatgatacttaagctgagacctggaaaatgataaagaaccagccagccaacgggtaggggaagagctctgggcagagggagcagtcacctttgtgtggtgttagggcatgtaagtgggcagaggagacaggagagctgggcacaggcctagtcatgcagggcctttcaggcggataaagacttcattagagtccatgggaagccatccagggtttcaggcaagaggctgacattgtctcattagttttccagtcattatgaccttggaaggccctaatgtgcccctcctcagtgataccccaccccagaagtgaccaccactctgacttttgtggcattcattcccttggggtagtatatagttttgcctgttcttgaacttacataaatggattcatattacatgtagaacatggccctggttgtgtagagggtggactggaggtgggcaagagtggatgtgggagggaaaacagtggctggatgaggatggtggatgcgagacctcgatctgtggagacaatacacagggatctgcaaaaaaaaaaaaaaaaaaaaaaagagctccactcagggaggaaaggaccagagccacagaagcactcagtcccgggtcccggtccctgaaggaaggagccatacaccagagaccatcaaaaaggaggaggaaagggcatgtgaggccacatacaagcaaactggaacccaaaacaaggaaggctgcttccctctgcttgtgagtacctggctccatcgctcacactgcggcagtacagggatcaggcacactgacttgctccggtgtctagtcagtagaaggatggggagggactggaccactttggttcacagccatctgaagctgcagatagtgaatttcattatgaatttgaggcaggaatgggcaccagtattgggaaacacaatgcctttaaacatttctcagtcaacaaatatttattcagtatcagctatgttttaggaactattgtaggtgctagggatacatcagtcaaaaaaagagacaaaaatctctgccagtatggggcttatgatctagagtggagagagtggagtgaaataaggaaaaggtagtgtatcaagtgatgatgagtgctatggagaaaaacaaagcagggaagggagattagcatgttgggggcaggaaagggggcacggcagatttaaataagactgtctgggaaggtggcactgaatagtacaaataaaacctgaaattgcagagagagcaagccgtgtggatatcaggatgagagggtgtagggtgcaagtgcaaaggtcctatggcacaaatgtgcccagcttgtttaaggaaaagcaaagaggccagtgggacagagtgaggaaagtgagaataacaggaggtcatagagggaccagggattagatcacagaagttttggaaaccatcgtaacttggccttttgttaaaacaagtaagtgtaggcacttgctggggataaaaacaaatttcccagaggcaggctcatcgaattgggcccagtatacttgctaaattaaggagccattttcctccttttcaaagagataaaggcagctttcccctcatttctgttaagctcaggggctgctgtcagccccacagacccacatgagccagatctttttctttggatgaatctaattccttggcaatctgggtatgattcccacccctacccctacaccgaccccccaacacacccgacaaacgaatgtctgctgtttgttaattggtgtctggtttttgtttgtttgtttgtttgtttgtttgtttgtttttgagacagagtctcgcactgttgcccaggctggagtgcagtgtcacgatcttggctcactgcaacctctgcctcccggattcaagctattctcctgcctcaatctcccaagtagctgggattacaggtgcccaccaccatgcccagctgattttttgtgtttttagtagagatgaggtttcactatgttgaccaggctggtcttgaactcctgacctcatgatccacctgcctcggcctcccaaagtgctgggattacaggcatgagccactgcacccagccggtgtctggtttttaaaatggcattctaacctttattcttatttcattctacgggatgaatttaatcacggaagttgaatgtgaggttgggagatgggtctgatggggccaaatttggagtttctggacaatgggaggagtgtttagggtgggacacacttttggaaatagacatataaaaatagagggtttgaaaacttccttacattcatcacctggtgacatctgatgacaggaacgggaaggggctacaacaggtaggtttctccagtctctgctctgggcccaacacctgagccaatgttctgattggctcctgtttgcttccattccaagagcagatgtttttgctagaaagtgttgattacccgcttcggcttaactgccacagagtttatcaatatatgtgatgtcacacacacacatttagggcatggagaagggggtgggggcttttatgctctttgtttttaggtgctagtcaaagaccttctgaaatgccttcttgggtacctaaagtcaggcctctcctctttccactgggcagggaattgaagataaccccaagcaggttttgttttaccctttattgatatatgataatttacatatttatggggtacatgtgtttgttacacgcaaagaatgtatatagatcaaattagggaaactgggctatccaccaccctcagtgtttatcatttttatgtattgagaaatgtggatcccacctccctaagactctgcatcatcacatactttcaggtggttagggagggccacgtgaagcaaaagtctcccatgttgtctctggggattgtagataattattactattattttgtttaaactatatatatatatatatatatatatatatatatatatatatctttgctttaagatgccagtatggggcttatgatctagagtggagagagtggagtgaaatatatcttaaagtgatatatatatatctttgctgtaagattttagctacagtaagtctttttggaaaggcctgactgtgactttaaggccataatgaaggcaggtgctgggatggagacactcagaacaggagcctggttagtgtctttgtgacactcaggtgactgacttgtgagagttggcctgggccccaagctttgaagggctccactctgtctcttctatcccctggaaagaaaagtccatggatttccgggacgatgtcattcagattatattccaggtacctgggatcagccaaactaaattccaggtatctcaaattcccccaggtaccccaaatgccccaagcccattgccagtacctgcatgggcttccccctgagatttgggctcctctggatgcacctctgcaggggctgtgtgtggggttgaccaagtttgaaatgtgcataatgtagggctcacacctgttaaaatccagcacagtgtggagggggatctagggggaaggggaggtgagtaactccaatgtcttctaaacggtttgtaggcttagttccttctggttggatttggggtgtgatctgccaccttttgatagcagcatcctggtactgtccccttatgacagcactatcaagatactgagcactgggcctaaagtgaatgtcagtttcttacttggccaactataaacacggctttcataagccaatgttttacaagagaagccagcaggcaaaggcatggctgttccactacagaaagctgttctctttcgcacactgtggggtaactgacctgagtcaactaacttagactcagcaactgctccagaaaaaagtgagctgctggagcccaacagagacactggctattactcctaggatctgcactgtaaaaccaaaagcattagggttgaaagaaacagtttccttactgacaagttagtaattttcagtgaggtaaaagaggaggaggaggacaatacatttccaagggtgctttattcagtttgagcttttaaatcaatgggcaagtcttcattatttacccttaattactgtcatcacagtctcataaaccagaagcatgcccccggtgtagaaaacaggccctttaccttggctctcctcccacttccatcagggcagccaagggctccagtggtaaatgctctcctgcaactgataggacattcctcaaaagagcccttgcggtacaatttgtacaacatggccctttgaaacagatagatctgagcttgaatcctggctctacttctagctgtgaaatgcaagccacaaaacctctctcagcaagttcctaaacctttctgagcctcaatttgctcacttgtcaaatgggaatgatactgtgtactccatgctgttttggtgaaggttcaataaaatacatatgcaaaacacataattaatgcctgacacataagcatttaataaatatagcatttcaaaaaggaccaaaataacatagcaaaagcagaagaaataagaagaatgtaaggtaatgaaagaaaaattttaaacaaataaaccagaacaaatgcatccaaataacaattacttcttaaggctactatggggactatgttaagttactccaaatgttctgctgtgtttgggaactcttatccaggatctcaaagtacgttccttagaccatgacagtggtggcaaatcatttgagagcagatttgattttggaaaaccacaaaaatcatttaacagaaaataaaataaaaacatgatcaacaattttgttttaaaaaagtatgattatgaaatactaagataaattttatcttctcagctgccaacatgatctctctaaaatgtcaaactaatcatgttcctctcctgctgaaaacacttcaatgattctccactgcttttagaatcaagttcaaattccttcatgtaacacaagcatcctttgtgatctgaccccgggtagctctccagcctcaggccctgcctctcccctgctgtgcccttttccctgtctgcattgaggtgcttgaatagcatgctacttcagttctccctacttttacctatgactttccttctccatggagcattcctgctagttgtctttagaaattgtatagctcactgctacctgtcactctgaaattgccttctatgcaaagcagttatgtctgactttgaacaagatgccccctcctctatgcttcccctaacatatctacctctttcttggagctcgttacacttggcagtaatcatactttcatttatctctgtcctctattagactgaaatcacatgagattgtactacagcttatgaaatttacatagtcgtagtctactctatgctgttttggtgaaaatcgagttcttggcacataataggtgatccattcgtaacattaatgattatttatcttacaaatctcatggtttccattaaagtgtttcaaacatatttaaatgatgatataattattagaagtagtacatagactcccctgcagactatttgcagagaagcaccatttgtgcatacacataagttcttttttgttgctgttaaaaaattaccttactggattctggtataaaatgatatctgatgaagaaaggagtagtggaatataaccctaagtgtaaaacaaatattggtgtatatatatcctgagtatataaatatattgagataaataaacacataaacagagagaagagacaaatatcccatacaaaagaattctaaataatatatgtagataattcctcttcaaggaggtggagcataactccccactccttaggtgtgagctgtgcatagtgacttccttctaaagactacagtgtagaaagaggaaaaaagagtaactgtacattggggaaacctgacaaacactacttccaccagacgatcaaggttaacatcaatcatggtaagtcattttgatagtatgtccccttgatatgatgtgattaaaatggcacttaacctctgtgccttcctcccccaaacccataattttggtgtaatcgtgaggaaaacattgaacaaattctaatagagggaaactctacaaaatacctgaccagtttgctcgagactgtcaaggtcaacaaaattgaaaagtatgaaaaagtatcacagccagggagagtctaaggagacatgatgaatcaatgtaatagggtatcctgaatgagatcctggtacaaaaaggggatatttggttaagattaaggaaatatgaatcaagtatggactttagttgataataatatagcaatatggttcattaattataacaaatgtaccatatcttaatagaggaaactgggtatgaggtataagggaactctctgtactatcttcccaatttttctgtaaatctaaactgtcataaaatataaagtttatttctaaaaaatgatacctcacggctgattctccatgtaagttctcccactttccacagaatacctaaatgaaaacctagaaaccatcaataactaaaactgataacctactactagaatatgagaagaattttcaccaagtataaggcagatgcagctggactcagaaaaataactagtagcttaaccatgctttatctccacccccaaaatgaagcagtcccccttggtctgaaagaagatgggaaggcattgttctgaaagcagtctccagagggcagtgttcctttctgtactgtctgagctctcattcagagacccaggatctgtgctaaccagaaaattaaccagttcaccttctactgaatggtagctgtttttgaagtattcgctttcatcttgtgggaaagagtcactgcaaataaagcactgtatgatggtggggggtgggggatgttataatataaataactactacttttgacattatatgaacacagtggtaaagattttactggcgttaattcacttcatcgttattaacaatcccacaaggttgggaagtgagaacaatgaagcacagagaaattgacctgccctgagatgcacaggtaaaaaagtagcacagctgaaattaaaatcctaatagtctcagaacaaaggttaaaaaaaaaccttaagaataatcctaacagtctaattaaaaaaatttttcttttttttttttgaaacagggtcttgctttcttccccaggctgtggcatgatcatagctcagtgcagcctcgaattccagggctcaagggatcctgccacctcagcttcctgagtagctgggactataggtgcatgccaccatgcctggctaattttttttcccttttgtagagatgagatcttgctatattgcccaggctggtctcagactcctggcttcaagcaattctcccaccttgacctcccaaagtgctgggattacaggtgtgagccaccgtgcccagcctctaacagtctaatttaaagcctgcccttttaatcacctaactgtagttcattcaaaaaccctcgtagcagcgtatgctgaggattgagattcttgtactttaattatgatttttatttgtattttactatacttgatccactcaacaaacatttcctacatgcctactgtgtgctgctggtactgggcacataatggtgaaccagacccatagacatatttctatacataagggatccagaatccactgagacctgatggggggaagaatattccatctcagcctagcaggagtacactagatctatgtctacatgctagatgctgagaatcagcctagtaactaaatattagtacataagtttgctccccttttgtatatctaaccaaggagattcaacaggacataagtggaccacaaaagagctcaggggcaaccccaaagtcttgcctgttggcaaacactgcagtccaagggaaggagagaagcaccctaaaaacccagagagaatgttttaatacatctgataattgtttcatgcatgcaaccttttagaaatcttatgcttagtatcttcaaagatacaagaagaaagagcatcattgaaagtggatcagaaaaccatataggcaaaatatgtttgaatgaaatttataaaacaaacagaagaatgagttaacatagttcaactgtcacttgctcagggtggtctctcctgaatgtatccacagtagccccatatttttagtcactttttattaaaacatcctgctttattttctttatgatacagtataataaatttatcttgctaatttatttgtttacttgtctactgcctgtcttactagaatataaggttcatgacaatatgaatactgtttgatttttaactgctgagtcctcggtatggagaatggtgactaccaaaaagtagaagctcaacaaacatttactcagtgaatgaatatatagacaacaacagagatggttaaaatgtggaacagtttcaaaagaactcaaattataatagcagaatttaagcccacattggagttaataaatattttttaaatgcaagagctcagaatcaacaatcaatggaaaagaatgcagaacagaaatgggccaacacttattttttaaacaatggtgccaaagtgatcccatggaaaaagaagaactttttaataaatgataaatattttatttaaaaatgaacctcaatggctatcaagatgaatcatagagcaaaatgtaaaagctaaacccaaaaaagcttttagaggagaaaacagtacaatatattcttgatttgtgggtaggcaaaggtttcttagatcactaatagcaataagctttaaattaaaaaactgataaattagacttcatcaaagctaaaaagacaccatgaaaaaatcttatcaaaagacaccatgaaaaaatgaataagcaagctgcaaattgggtgaaaatattgacaatacatatatctgaccagggactagtatccaggatgtataaagaactcttccagtcaacaataaaaagacaagcaatcctattaaaagtgggcaaaaaaattggacagctcacaaaagaagacatccaaatggtaaataagcacatagaaaaagagtacaacatttttagtcataagggaaatgaaaattaaagccacaatagaatattatgcacttaccagaatgactaaaattaaaatcaatgatagcattaaatactggtgagactgcagaacaactaagactttcatagttacttgatagaaatgtacaatggtatagccactttggaaaaatatatacctggaagttcttataaaactaaacacatactgaccttttgaccaagtaatactaggtattagcccaagagaaatcatagcatatgttcacaaaaatacttatacaaaaatgttcatagcagctttattcacacagccccaaaatggaaatagccaaagtattgatcaagaggagaatggataaactatggtataatcatataataaaatgttacttagcaattaaaaacatcaaagttatatacccaacctggacaaacttcatatgcattatggtggttgaaagaagccttacctaaaagagtacatattgtataactgaatttacatgaaattctagaacaggtagaattatggtggaaagaatcagaacactggttgtgtctgggggtagcagtgatatcctggggacggagcaaaagggaactttctggggtgataatatatcaagacatttttcctattgaaaaataacaaaattgttgttttaagctaatacattttggggcattttgatatgcaagattagattaccaaaacaaaaagattatgcctaaccaaatgttatgaatacaggtatattcatactgcaaaagcacttgtataaatttaaaaatttgctaatgaaaatgtaactaaaaatctacaatacatgaacaaaaactaggaaactatagggaaagtgcatactccaattctttttttatatagtaagaaattaaaagatactcattcatttttgtcttgagaaatattgattaaagaatgcttttgtaaaaaaaagataacaaataattttcacttcaagtaaggactaaaagaaactaagcaaaatatagtccaaatagtaaaattcaggaaaagcaaagcataagaaagtagaagctcagatagaataagatgaaataatagatataaagcaaaatccctcattaaaagcagaatcttagattagataaaaaattatattcagagcagtgagattatgtcacttataaaaaaaatctcctaacaacaacaacaacaacaacaacaaaaagaccaggagcagatggattcacagctgaattctaccaagcatacaaataactaataccaatcctcctgaaactattcaaaaaaatcaaagagggaattcttcctaacactttctacaaggccagtataacccagataccaaagccagacaaagacacaacaaaacaagaaaattacagaccaatatccctgatgaacatagacacaaaaatcttcaacaaaatactagcaaatcaaatccaatagcacatcaaaaagataatataccatgatcaggtgagatttatctcagggatgtgagaatagttcaacatatgcaaatcaacaagtgtgatacatcacacaaacagaattaaaaacaaaaaccataagatcatctcaaaacatgcagaaaaagcattcaataaaattcagcatcccttcatgataaaaattctcaacaaatcagacatagaaggaacatacctcaacataataaaagtcatacacaacaaattcacagccaacatcatactcaatggagaaaagttgaaagcattccctctaagaactggaacaagacaaggataaccatatgcagaagaatgaaactggacccatatttctcactatagataaaaatgaactcaagactgattaaagacctaaatgtaagacctcaaattataaaaatctcagacaaaatcctagggaggactcttctggacattggcctaggcaaagaatttatgaccaagccctcaaaagcaaaggcaacaaaaacaaaaatagacaaatgagactgaagctaaaaccttcctctacaggaaaaaaaaatcaacaaagtaaacaaacaacccacagaatgggcaaaaagtttccaaattatgcatctgacaaaaggctaacatccagaatccataaggaactcaaataattcaataagaaaaacaagtaacctcattaaaaagtggggaaaggacatgtaagccggcaacaaatacatgaaaaaaatgtttgacatcactaatcatcagagaaattcaaattaaaaccacaatgagataccattttacaccagttataatagctattattaaaaagtcaaaaaacaacagatattggcaaggaggcggagaaaaggtaatacttatatgctgttgataggaattagtaaatctttatgaaaaacagtatggagatttctcaaagaactaaaaacagaactaccattcaatccagtaatcctactactaggtatatccccaaaaagaaataaatcattatataataaagatacctgcacccatatatttatcacagcactattcataatatcaaagatatggaatcaacataaatgtccatcagtataagactggagagaaagaaaatgttatatatatatccacataatggaatactattctgccataaaaaagaatgaaactatgtcttttgcagtaacatagatggaactggaggccattgtcttaactgaaataattcagaaacagaaaaggcaaataacatatgctctcacttataagttggagctaaagaatgggtacacatggacatacagagtagattaatagacatggaaggctacaaaaggtgggaggttgggagcgggtgagaattgaaaaattacctattagatacaatgttcactattagggtgatggatacactaaaagctggctcaccactacataatatatccatgtaagaaatctgcacttgtactccctaaatatattttttaattaaaaaatatatatatatttagatgtatgtagtttacaaaaaaatgcctaaaacaaaatgacccagaaataaaaaataaaataaacagatgagtcaggaattattgttttaaatatatatccttaagaaggatttacctaaaaccccagtagaggttatgtcccctctcagatgctcttatggcatcctgtattttctccttacaagaatttatcacaactattactatattctggtttccatgatttttttttcagtttgcctccacattctaagctctttaaggcagaaataaacctgctttgctcactgccttatttccagtgcccaacccaatgcttagaaataggaaattttcactgaatgactgtattccagaaaaggagtaaaataaaagagaaagcacagataacaacattaatttcaaactaagtcgattccaaggtcaaatcaatgaagtaaaagggtaatcttaaatctataaaagaaacacctcatgttcttgaacctgtttttgcaaataatatggaataaaaatgtataaaacaagaaatattaacaattcaaggagagggatagatgatagactaaaaatatgtttatattccttcctgacaaaatatcatgaaattaccaaaatgctaatatctgatacattcagatcagtagtggaaaatagaaaggattggccagtggtttcaatttatggttaggtaaagaagatctcaaaagattatcactgccttcataacaagaaaaaagagacaaagcaaaaatcatacttcattttaaagctgtcaaagagtgaatgtgagacaaagagaagtctaaacaaataaaattccagtcaagagaagccttttatagaccaataaaaagcagtgactgcttccatatctgggaccaattggttacatagtggagagatgagcctgccatcatagagcaactcctaaaaggagaaaaactagcaatttttcaaatgatagtatgggttggcaaacagactcttatctagaagagccacaaatgcaaaagtaaacctcttggcttgaaaattctctgccacaggaatttgctgtgaaattgatgatgagtgcagagccagaaaactgaaatcttacattcttgcacatgaatttggctggagttgatgccaaagagaactgaaatgaactctagctgcaattcaaacccctcccagctcaaatcctgattgtgaccagttactcaatgcagcctgggtagttgggattgggttgaagggcaaagggaaatcttcataatctctttttaaagcagaaataaactgaaactaataaaaagcttcagccaatccccagctaaagcattgcagatggtcaaatttttatgatcagcctctcattctagctgtctgacatttttaaaaaatcacatatcctctttatgagaaatagaacaaaacaaaagattttatttagttcaaacaaatctagtaaaaatattatttacttttgtccttctatacaacatgtttgatatgcaataaatacttatgaatacatgcaaagaagcagaaaaatgtgacctaaaatcaagagaagaaataatcaatacaggcagacttacagatgcccttgatgttagaattaaagaccaagaatacgaaataacaattataaagaattatgtgttaaaaatttatagaagaaattttagaatatatagaaaaatttatagaagaaaaggtggatataattaataacagttggtaagtttctgcagagaaataaaaccttaaaaaggaaccaagtcaaaatttatagaactgaaaaatgtcagagtgccagagaactgtgggccaatatcatttgattcaacatatacgtaactgggtccagaaagagagagagaataggaaaaaataagtatttgaaaagatattagccaagtattttctgaaatcaatgaaagttatcaactcttagatccaagaaactcggcgaacaccaagcataagaaacataaagtaaaacacatttatgtacatcatagtcaaatgactgaaaaacaaagatctaaaaggaaatgttaaaagcagtaaagaaaaaaacccattacatttaggggaacaacaaaaataatggcagagttttcactagtaacaacggaagccaaaagacagtggtatcttaaaagggctgaaagaaagaaaaaactgtcaatccaaatgataaggtagttagctttaagcagtaagttaccactgatttgatttcttctaaatactttttacattttctataacaattgcattgttcttataatttaaaaacatttttgtttttattattttattttattttatttttttgagacggggcttgctctgtcacccaggctggagtacagtggcatgatccagctcactgcagccttgacctcctgggctcaggcaatcctcccacctcaacctcccaagtagctaggactacaagcgcatgccaccatgcctggttaatttttgtattttgtattttatagagatggggtttcgccatgttgcccaggctggtcttgaactcctgggctcaagtgatcctcctgccttggcctcccaaagtgctgggattgtaggcgtgagccaccaggcctggcaaaaacatttttaaaagaacaactaagacaaatattgtatatgggttacacttagtatacaagaatcctcagaaaactatctgactaatctttatcctcataccaaatatctacacgattactactgttttcactagtctttgtaaaatatttatatatgaagattaactaaaaaacagtttttatgtgtcaatagcccttttataaagagattaaaagtaagaaacaatcacatctcttggggtaggtgagaaaacattaatgaaagacgtgaaatttgaggtttgttagaaaatactttaaggaaatggagaaaagtttcagaataaaaatttcaagatatatttgagaaacacaaataaatctaggttttttcatggagggatgaagcgagatattgatgtcaatagtggagaatcttgaaagatctaatttgtaggcaatggaaaaaaatatttacctaatctaacatgttttgagtaaagaagaatttacaaatgagaacaattctgtatctactggtgtgctacatttggatttctaattgacagcttggtattccttgtacctgtgaatcaacatgagtagatagttatcatttggacaatcactagatcattgtctgacagtaacttggtctgaaaaaattattttggtagataaaaggatgtttaagtggaactcttcctgagtttataacttagaacaacaggtactatattctaaaggtacatgctaagccataggacttggaaagaaaatgccccaaactaggtctacctcctccaagctgagctgctcactgttcatctctgaattgtgtaagaaaagggtaacagtttatgagagagccttatatggaagatttcttagctagggtttcttaaagcttccttctacagaactacttggagaacctaatatgtatttgcccaggatgtgacatgctagcagacactggtagctgatccatacctaaaaattctaaaggttagtggacagaaggaagagagtggagtgctacattgaggggacctgtgtttgtacaatttaatgagcaaagactcattaaattgagtgagttttcccctgacccaaaaagacccatgaaaaataatcagaccatggaagcaaccctagtatccactaatgtgtgaatggataaacaaaatgtggtatatacttacaatggaatattattcaagccttaaaaatgaaggaaattcttacacatgctacaaccttaatgaacctggaagacatgccaagggaaataagccagtcacaaaaggacaaatattgcatgattctatttatatgaggtagctagagtagtcaaattcatagacataaagtagaatggcagttgccacaggctgaagagaggggagtggggagttagtgtctcatgggtacagagtttcagtttgggaagatgaaaaagttctggagatggatagtggtgatggttgcacaacaacgtgaatgtacttagtactactgaactttacacttaaaaacagttaaagtcataaatttcatgtgtttattttaccactcttttaaagcaacaacaaaaacaaaaacaacaaaaaataaccttcaccaagaggactgcctagagaagtgagctgacccccacagagggagggtcaggatgggccagtggaagccaggaatgagaatggattataagctgttagtcaggagaggcaaacccacaagtaattgctaacaggagattcccagccaggcagttatctgaagaatttataaaagcagctcattacaaaaagaaaatgttggtgtctgacacagatggccctgaaatcaagttaggaaatcctaagactttgccctttcatcctacctccctcttgagccctgtacctgaattgggagataaggtgaagtgaggaagagtaaagaagctatgactgtgtctctctcctgactacaggcttctaaatgaagggaagggaagaagctcagagacaatttaacatctgtgtgtgcagacaatttaacatctgtgtgtgccaaaaaagtggtggaatggtactagacagtttatacaggagtggggatgattgattcaacagagtaagtttaaaggaagaagagtgagaaagaatgaagtggcattctacttgtagtctctgagtctagccctttcatccagtgagagaaaatctttcctcggagcttagaagattcctgatgaaagaatcactgcttccacttctctccttctcccttaccttcaggaagtcagattggcttcttcatcctcatctaaggatatatcccatggaagatggtatctaggaagaggtctaccatcctccccaaataaaagcgcaactctgtatctgtacccatggcttatgaaggaggaagggaatacgagctgatgttatgccagtctgtggtcagcaagactgccactaagagtgactgtcaattctcccaacatagcccaagcttttccattccagaatgttgtcatggcagacaaaatgattatttgtggtgggatgcattcatttattccatatacttttattgagtaccaattatatatagaatactgaaaagaataaaagctagataagacatgatcacacacttcaaggcacatatgtttcagcagaggtaaacatacagacttacaattaatgacaatgtagggcaaacaggaacaaaaaagctttgggattagaaatttttatagaggagattacatttacattgtgctttgaatgatgggaacattttgagtggatatggcataattgaaacagagaatgacaaaagtggaggggaggttagagcagagatcagatggcagagaaacaggtagctggtcttcagactatgacatcattgggtttgtaagtagcatataatactcttgagaagagaaatgagagccaggggtaggaaagtttggtatgagatttctgagggcctcaaaggccaggacatttgttctttaataggtaatgggggagtaatttaaggtctatgagtgggtgagtgatgaaatctaaaatatgttttaggaagaacaagtagaaggctattgcaattgtccagtgcagaggtaatggagcccttaagtaggatggttgctgtcacaattggaaaggcagaaatagatgggagaggctttggggaggtagaataaaagaggcttggatcctgatagcatatgcctttttcttactctctgtcaaaccctcatttcttccctcttctgatcctaaagctgtatgcagtgtcccttagcacacagacttatattttctggcaaatttctcttcagtattaggtaaggcttcatttgcagtaactgtgaaagacaccccaaaggacagttcctgatgttcaaaatgaggaagttatattctacatctacatttttattttatttttctctgtattgtggcttttagaaaaaggttcctccttttacctaagaatttctactctcagaaaatatgaacctacattagcatagctcttctgaagctcttggtcatatagaatggaaatcaggatcatgaaattaaagttattaaaatgatagtaaatgcctctctttgttccattattcagctttaagagcatttctgctctctaagagccttaaagtattaattttatatatttaggacaaaggattttaacaatagaattgtataattaaattacaagaaattaagaaaaacagtcatcaaaataattgagttgataattcaattgttaaacaaaatccagataatgtattagtcactccaatttttaaaggctagaacagtagaaaatgttttgtatgcttacatttctatttctcaccatgtgtggattatggctgaaataagctgaagttgccaatatgtgacaacagggaaaggactgccttgcatggtaagtcttttggggaagctttgtccttggagatgtctagcttttaaagacctgttctgtttctgacatggtaaattttgtatttctatgccctagacttttctgcagatacatgtatagtaacacaggctacagacaatgggcctgcattgagcaaacactggtgccctggagcagctgcacttgcgatgcttctgggatgttcagtggtgtgaccaaacagcatgtatcaaagaactaggaaacaggcaatctgttttcagctctgactttaagcaggtagtaattttcctgataaaacaggcgaaaaaattatagctccccagtcagcatagtcttacaagaaatcttgggctaagtagacaaaactcaatgaagattaaggactccaaatgcactggttggtaagaacaactaacttttattaagtaccagttgtaactaaacactctttctaaacactttccctgtaatttttttgtaactgttaaaacaggcttgaaaatttttttttaacttataatttttgtaggtacatagtaggtatatatatttatggggaaaacaggcttcttatacccatttaacatatgaataaaacaagattgagaggttaagtagcttgcccaaggtcaatagctactgaaccaggattcaagcctaactaaactgatcaggctaatactaaaatcgacactttaaatcttctccctatgctgccttttgcatggataaagttagcaacctccttctgcaggggacactgacacaaagcaagatctgcattaaaagtgtacttaaagcaatgaagtttctggtttagaaataggtagatcaatgggacaaagtaacatgtaaagaaatatacttgaatatatataagaatttatataatttaatgcggtatttcaacttgttcaagcaggcagataagctagatatgagcaggagggtgagtcccctgagaaaagggaggtttggaaaaatctcataacccagagaccacccaaaacatgcatcctagctatgagcagagaggaagggaaatacctatggagaaagagatgccccttgactcccagtaatcactcactccacaattaaactgtcctgtcagaatgtagctagctacatgctgttaagcgggtaaagagggaaaaaggagaaattcctaagagatacacaggtgcaataagcacagctttaaccactttccaaccttcctcaggtggtgataatgagtaatgcaggcattatatagaatttgtatccaacactggcctgcacatacatgtgaactaacagtaggggggaatcccacaaatttggagtggaaactaggtggggacttaaggcagaagtgggaactagacaaagacaaaggtggaaacttgaggcagaggcagaagcctgaagaaacagtctgccataataaccacaatgcagaactcttggggctgctgctggcttatcccttttaaacaccctgctctgcctcatctttcagcgtgcactgtctctgctactacctaacctttgaggctactactcctgtttctccagctggaccagcctgctcctttcttggagtgtccttctctcaataaactctgtactctttattttctttcaataaatcttttgcttacattactaattggtctcttggctgaattctttctcccaggtaagacaagaactgaggattcctgtacttcccagtaacaaaatcattaggaaaagtagccagtattaaatgaatatatagaaatcagtggctgtttgggagaaaaaaataaagttaaagccctattttttttaagtgtacttccagtgagctctgagtgttttagagactgtactctgccccatttgtgagaattattagtctttccagggaatatatatggagaatatttactttcagaggatgtaccatggagagaagtatttttatgaaaaatgccttgggaataggatttttaaaagacagaagagaacagtgtggtgctgtctcttgagtctcatgaacacacagcaagacatgtattcccattaactctctaggccatgaactacttgtgctccctttttaaggaaggaaaagattctagggtggtttttgtcactgggtgctgtggaatggattatttccctccactcttgttgctaaccggaaaaaaaaaaagacactgcaataaggttatgggactgaaagagctacatttagacacagctcttttggggtcaaggtcaagtaggacaataatggaaaagaataagcaaaaatgagacaacacaaggagaagaggaacctgggcacacctgagtggggaatcttcccttagccacagtggaaaaggggaaagcactagcccaggatctcagaaagaagggataggaatgatagaagggtaacatggcatttggctttctctctcagctctgttattactattttactttttaaaaaactttgttacataatatatattctcataaagtagctcaaatcttttatgggactaagcaagttataaatacatactttccatagaaatatttagaaaaatattacacttacacatattcatatataatatgtataaatacataaatttaaaaatatatattcagaagttgatgtatattataatatacgtatatctcattcctgaatttgggtttagtagctctcaaaaaatcactttttgtctttataaagtcctcagggtaagaaatccttccagatactcttgcacatggattcctaggccagggagcggggtggatgccacctgatcactagtgtcaagaatttcgtactcagtggggtgggagttggctgagagtggaagcggcaagagcaagatggcaacaccataattctgactgggaatgccactttccacactggcacaaaataaagcatgtggaacaaagaagtcaatgcctataagtcaacttcttgaaagtttcagattgtcacaaggctaagagttgggctagagatttgtcagagtcagtaataatttttgtgtctaaggacagagggatctgagttacataaacaagaggtgttcactatgaactgaaataagcaattcatgggtaaagagactggggccagaaattctagggtatatgagcattttctaggtaatggtaactgtggctcattggggtaggagtagtgccagtgagagtggtgccttttactgaatcttcccatctgggggtaaatggccattcatgctgcaacgcagttattctagctccttctcaagaggacgacgatgtgccagaggtagatgagaagtgagaatatgggcatatgtaagatgttctctctttgtgtgttaattatactgtgacataatgaagtaggatttagatgggactagtgtatggtgtgtccttctttttaatagctgcagttactgaaaaacaatgggtgaagcaacactgtggagatcagaatttgatgatggtgaaggaggcataactcaacatttgctgttctaaattcctgtcctttgctatttctccccaatccatggtgatttctcagtaataaatatactaccacaaataataatagtattattgctatgattttacgaatacttattaacatcttcacatgcttcatctcatttaattctcacaattgaggtaagtgacagatccaggatttgaaaatagttctgcacacagaccttaatgctatactaatgattcttatcagttggttgaatacttatagttcactcatttattgatgcatcttatagatactgtttttagtccttactataaaaagatattacatataaacgaagcagggctgtctcagaagagcaaaaagcatcccttgccaaggtaagggattctttccttcctccttctttccctcccaccctccattcaaaaattattcaataaatcccaactttgcactaagcaccctgctaggcattgcaaataaaaatccctgtgcttctagaatccatgatttagccagaaaattaaaagcacatagatagataactataattttacatcttttacatctcaaatcagagcagtgcaggtaacatcaatttgcctacttcttatatctggcttgacacacagaatattttgaagatttcatgtgtattatatcatactcttctatatacttttatcttggcactgacattttatcttgcctacttagtaagtatttcatagatataaagaaaatatttggtaaaatctacagagcaggccaggtgtggtggctcatgcctgtaatcccagcactttgggaggccaaggcgggcagatcacctgaggtcaggagttcaagaccagcctggccaacatagtgaaacctcatctctgctaaaaatacaaaaattagttgggcatggtggtgcatgcctgtaatcccagctactcgggaggctgaggcaggagaattgcttgaacccgggaggtagaggttgcagtgagccgagatggcaccactgtactccagcctgggcaaaaaaaacaaaaacaaaaacaaaacaaaaaaaacaactacagagcagaagctagaaaaaaacgagtcttgagtcaaaacaagcgtctgagattcaggggagattagaactgctcttttggaacttagtgtctgagaggacatatgtgcagacatgggaacaggtcaaggttcttgatgggacatgtgttgggggagggaggaagaaagggaatcggataatgacaggagtagctttccccatctaggtcatatatccttgtagtgaattcttctcctacgataagaaaagttgtgactttatagattatctatacatattcaaatctaagtttaaaataaatttgaaatcctgccaaattatctttggattgtcactatttaataaatgtaattttaaaaaatctatatctaaacataggacttatatgaatgggcttcaaggcatctgtgaacccctgaaatcatatgcaacattgtgtttctctggacttcatgagatttaaacccacaacctaaaatgattaaggcccaatgaataattaaaatttgagaaattaagccccataaccagggaaattttttccctcataaaattagagctgacagcatacaaacctgacataaacactgtacttacatcaagagccacagactgcttggcccaggacttcttcacttgatcatacataattgtgttgttgatgccaagtccacaaaagatgacaaaagcctaggaaagagcaaacctgctaattaaacattgcagcaactcattggcaaaatctaatatgaaagcaggcagccaccagggatgggtctgaaaatacaatcttgttgtacacagaggtaggccttggggaaataggcacattaaaattcttaattactattgttatataacaactttatagctcacactgcacatgaggaaaaattatgaatttaatgtcattgtagagaaactatttcatatgtttaaaaacatacttacactctgtttaagtgggttcttaatttatttaggttgtggactgattttagtaaatccattctatttaaccaaagcaacctcttttagttgctaggctataaaatactttggtaaagaaaccaagttaatgtaaccataaggtaaatgttaaggggaaggaggattgagttagaaccattaataaagaagctatgaggtattcttgattagagaaagataaccatgggttttcatgttggctactggtacagtctatgaggaagcccattcaaggctagcttctccagctagagcgcctggagtgaatgcacggaagcgtgtaaacaagagaaatgtgagggcagcacgcctggcagagctggctcagggtttcatgactctgaacacacacaaacaagacaagaataagaaaatagcactttggggaaaagagagggtaattctgtaataaaattaagataaaaataatggatggttacaaaataatccaattcataaaaaataggatcaaatctcacttaagcatttacatattccttaaatcttcctgttaattttgccctccatttaagtataataataattgactaataattgtttgtctttcaaatttgggcaagctgcaaccaggggactattgatgactccacttggtttataaatttattttcttacctcaaaaagtcgttgatctgcatcatcaaaaggtttcccatcaagtctgtttaacacttgagccactcctatggggaaagagtggattatgtggtcatttttagtactggacattgtgtttctctaatagagtagccacagctaactctatgccttttttaaggaactgcactcagtttaaactctggtctctcaagtgcctgccgatttcatgagaataaatctgaggtgtaggacaatgcactctctcttcaaggctgatttatttagactagatctcagtagttcggagttctaccaaggctttaatctgattctagatgactagttacagtaactctaatatattgcccatatattatatatacaactgagtatatatgtagctgaatatgtgtgtgtattcagctacatatatatatatatttcaactgaaaatatatatatatgtgtgtatatatatatatatatcatactctgaagcacaatacttgaaagaggcagtatggcactgtgattaagaacataagctttggacttagatgatctgagatcaaatttcaactccaccatcaggtgtgtgaccttgggcacgttacctaacttttttagcactcaatttcctcatctgtaaaatggggattaaaatgttaactacctaagaaggttatgaagattaaatgagataatgttagaatgttcataaagcatttagcatattgcttcactcagagtaaacattcaagaaatgttaggaattattacaagcaataaaagttgatataatacagttaaccttcaaagcaaagttagttctgtttcctgctaccagggggtacatatagttctacaaatcttaatttatgagtgattactttttccaaacttcacctctagtattataccagatgttttagggcatgacttcccaaatacacaagtttaacaagaaaaatcaactatcttgaaaaccactagcctgtgtccccatttagtacaaaagaaaaaaaaaaccagctgtaattctaaagtatgcttgtatttttaaaaacacccaacttcccaccagggaggtaagtcatcatatgcaagaagacatatatatataaataatgaaacacaaaactattagcatgtaaccaggcaaactacggttctaattttgaagtaataagggatgtttacttttaggattgaaatgtaggactacgagattgccacggaatatcaacaggtaacacatggtgtttcttatggactttccctttaaacataaatttatttaaaactctgtgcatgatgtagtttaagtctttgtactagaggcttagatcccaaaccttagaatattctttatgttcagtaacataccaatattcttatgcagactaagctgatgaaaaacattatctcagaattcatatcttaaaaacactcacagaatactaaatcctttaataagcagcagtgtcttagactttaacaggcaattttagggggaagcagagaaaggcaaatggatgcattagttaccaaatgaattagtgttcttacgtctcttaggaaaaaaagtcacatttttattgtgtttcaataatttcaactaattcctccatccttcatgacttctctatttcaaccatgaattctccttgcctgggcttctttcttgaatttgatgctttcctaattgagtttttttgaggagaaggaaaggagaatggaggaagagaaaaattggaagctgcttttgcccatgattcccttattgtgaggaaaatgtggcctatttcagaactgcccaggcagaaaatgcatgctcagtatatgtccaatatagaatgttatttcttcctttgcctttacaccatgtataaaaagcacagatgtaaacacattgacatagtaagaaagtctgcactaggagttaggaagcctgaattttgttcctgaccttgctattaactttgtggccttcttgaagtcatttctctttctctctttctctctttctctctctctctctctctctctctctgtctctgtctctctctggctttttttttcactctctgcctctatttccacagggtgagataaaagagttctattggttgataactcagattctctacgactttaaaatttattggttctttcaatttaatacatatttgttcaagttgtggataatgttgattcattaggagcctgtgcttatgaaattatacgagagtgtgagacatagtttgatgagtcctggccataaaaagagggaacacataaaaaagatatgggaatattttaaagcaaacttctgtttctttattcaagaagtttaactatttaggtcatctcttaccaattatttggtggttgctattccaaatagggacacaaagaacagatcttatgtgaaaaccagatatctggtctgcctaggaaacaagaaagaagttaattaaaattgaatattaactattcatttttgatttacattttttccatttttcataacagatattcaaaaataactttttaaagctattttatacactgtaacctaattttgtaatgcataaactcactcacctgcctccttcatcacaatgaacatcctaaaggaatcaaacccaagccaaatatgaatcaaccaaataaatccaaaaccaacatgacctccttcaatccctgcagccatagagagctggacataaaactatcttgatcatgaccacaccactagacaagaattccagcaactgtttctcctctgggtatttaaagcattttaattaaaccagtgatcaatttttatctttgactgggtgcacttgttagtaaaacatgtttgtgcctataatgctgtcatatttacatttacttttaatactctatatttttactgttactatattattatgtatgttgtcaaatctagatacaaaaaaggtaagatagaggtagaggtttgaatattttccttctgtaccccaaatatgtcaggaggtgacatttaaaatacagaggtataattatcaacatcaaacattgagtaacaaactccatttaatattaaaaacagtggtccatatttgaatggttagagagaaaccactaagagtgaaagggtcttagggagttaatatgaccttgattttcagtgaggtcaatctattgttctaatacaataggagaaaacaataagatatgaaggttttggatcatggatatggagataaaaagatattttaaaatattctttgttgaaggcaagagccacatattttaaacacttgaaactaaaagttaatttacatacctaaattttatactggattttttctttttgacatttctctttgagaagttaattttccagatatcttctattcattgtaccaatatgttagtttctctttttcaatgttttttgaagattaacatgcatgtagaaaggccccaaaattgtaagtatacagcttaatggatttttacaaaatgaacagatctatgcaactaccaccaagatcaagacatagaatattatcactgccccagaagccacctccaaacccctaaattcttgtacatacttagtgcatatatgcatttctgataggcatatacttataataaaattgctgagttattcacctgttcagcttcaaaatatatattttaaagtttttgcaaagtacttgtaccaatttaccttctaaccagaagtgtatgagagttccagttgatttatatcatcaccaacatttgatgttgtcaggcttttaaaaaaaaattttgacaattctgatagatatgtggttatatctccttgtgaaagtaatttgattatctctgatgactagggtgaccataaatcctggtttaagtctgttttcctgacataattattaataatatgcctttcattctcaaaagtgtctaaatttggacaataaatttataattttcctacttatgattaatgaagttgagcaacttttcatatacttatcatctatttctactctcttccatgaagtgcctgttcagaactttggtcttttgtcctgttgggttgtctgatttttaaaaattggctcgtaaaagtatcttctatattctggataagagccctctgcaagatatatgtattacaaatatttttcttattccatggcttgtttttccactcttttaatggtgtcttttgattcagaggtccctaatatgatataggcaaatatttcaatttttaaatttatggtcagtatttttttggttttgttcaagagatctttctgtattccaacctcatgaagatattcttctgtgcttttcctagaatccttactgttttaactttcacatttaaatttataatccaactgaaaatgattttcatgtataatatgagctaggagtcaaaatttcttttttttttgaaatggatattcagttgatccagcactgttttgagggaaaaagcaatacctctccccatcactctactgtgccatcattttcattaatcaactgtccatatatatttggatctgtttctggactctctattctattccattgatctaggtatctatccttatgccaataccacactgtcttaaataatacagttgtatgataaggctcagtatctggtagtgcaaatcctccaactttttccttcttcaagattgtcttgactatttttgacctctggcatttacatataaattttagaatcaatttgcagtttatacacatacatatacattcctgggatttttatcggtattttttgaatctatctgtttgggggagaattgacacctttacaaaactgagtctttcaatccataaatatcccttaatttatttaaggctcttaaaatttctcttagcaaagtttggtagttttccatgtagtgttcttacacataatttgttttatttgtatcctgatgtttaaaaacttcatgttattgtaaataacagtagtattttattttctaatgcttgtaattggtacataaaaatacaatcgactttttaatattaaatttgtttccatcaatcttgctacattcaattattaactttaatgtcttacctgtaaagtgttttggattttcttgccacatgatcacgtcatcttatcctttaattcttataccttttagtcatgtaattttagattatgtgatttttccttttttattttgttaatagagtgaattagattgattgatatttgagaattccagatgcaaaaacaaaaacgtaagcataaatcattcgtccagtgtactcttccaaaaaatatttatttaccaccttctatgcaccagacacattgcttagtattgaggatagaaaaatggattcaaatagtcattacccttgagctactcacagtctaggaaagatagaaatattgagataaaataagtgtccaagtagaggatgttcaaacactattggaaagacaacaattcactctgtttagagaaatcaggagcagcccaagaccctttacaatgagtcttcaaagacaacagtgatgatgataagctcacatttgctagatgttcactctctgtctggcattccgctcagcactttcttatgcattattttatactttttacaaccaccccatgaagtaggtactgttatcatcctctcttatcagatgagacttagggagattaactgccttgaatgagagagactggctcaaaggagcacagccaatggcaaacacatccatcaaagttatcttccaaaaaaacaaactggttttcttcccctccctaaggataaaatctgaattaaggcaataccagtaagcatgaagagaagaaagccaattttagaaaggtataatctacagacttaggctagccacagcagcactaggatggctgggtctgctttgttttgctgtgggagcgacacatatcattgtacagaccattgggtttgaggcagcaccaagtagtaaacacaattgtctctgccaactctgggacaacagtagctcctgtctaacgtttcctacgaaatctgggcagctgaaggacaggtcacaatgggcaagaagaaaaggaacatgcagtaagaaagacaatttagaagctggtggtgagaaaaacaaaccttaggctgttcgccagttaaataaaagagaattttgtttacccatcacttttaaagtactacagttccccaaaagagtttttttttttcttctgggaaagtgggagtatgcactctcccatccccatggaggataacattgaggtttctggcttgagtaaaggtggaagagttcttgaagtggggaacacaggaaatttgagggaaatgatacgaactccaaatggacacacattacaagtgagaggggctggagataccaatcttggagtcaccagtcctctgggttaattgcatgggtaagatttaagttaattgcatagttattgcaagagagaacttgtccaacaaaaagactaaaaactgaactttggggaacacaatatttagtgctggaagaaaaaggtgacatcagtgacagggatggacaagaactccaaagctcatgctcttaacctgaaggctttactgcatccataatgtgtgtgaacagatttctacaacctttccggaaataggtttattgatgtgtatccagagcctaaaaagtataaatacatactctttgacctatcaatttcatatctaggaatttatcctgtggtaattatcaaagctatgcacaaagctttacatgtaaaagtgtgaaccacagcattatttatcttagtgatttattagaataacatgaatattcaactgaaggcagttggttaagtaaatcatagcacattcacataacagaatattatgcatctaattaaaatcatgctatagaagaatagttactcatatggaaaatatttaatatattaaatgataatagtgtacatgcctatgggtatacaaaagcatattatatacattgaaggatcctagaaaaattatgaccataatagtttcctttgaatttcttggctattagaattttaaaattattgctcctagtttgtaaattttagataataaacacagataatttgtccataagggaagaagttattttctaagtagaacttagggggagcagcagtgtccaatgctatagagaagtctaataagataaggactgaaaatggcttactgaatttagcaacatagtgggatcattgaaggcaaaaatggtcaagggaagaaaggatgtgatcaggaataaaagtcaagtggttagtcctggaagagaggaaggccataatgagaaagcagagctgcaactattcagagctggagtcttgtatgagctgagcacaggagaagaggtgaagcatcagagaatgcagagggtgtctttaaagtgtttccactgtgtttgagggaaggaggtgaggctaaggaatggtgatgatcaacatgcttgatgagcccaatcaggtgggagaggagaacaaggaaggatggcagagtgtgaggagagtgaatttttccattttaaaatcattaatgaaatcccctaattgcctatttgcggcagcagctattttttctggaaaactgtgctaatccaggttagttcatgtaaccatatgaaaaggcaaggcccaggagtccattttatcctctgcaggggctggaggaaaaggagaagggagatgaaagaagcacaggatgtctaacgaataaattccaaacagggagaaagagtaataagcaagtatgaaggaaagaatcattcctgttcaccagataaccccaactctccatatcaaatcagtcaatggagctcaaaaatgcccatcagccacaccaccccaacgaagtcacccaaagtttcaatgcctcaattttatcattaatatttatctcctgcacaccaaaatggtaacattggttatcttcatattttggcctcacagctgattctcatctttgtgctttttcttgttttccaagttgttttatgaaaatttgtgtgtgaaagggtttcaaaatttgtaaggagttttacaaatacaaatattgctaatattgaaaggaacaactgccaaaaaaatctgctttattgttccacatggtgccttggtcattcttggtttaacatttacaccattagagtctcaaaagttagacaacatgagacaaagcagcctttctagaaggcaacagttaaactaaatatatttctgcgagtgcttagttctttccaagcaaagatatgtctacttaaaaatgttaactagtttctgtcctcatggggcctttccaattaatggatctaattaaagatggtttagctcttggagccatcaacatgtacttgttatattttctagcctctcaaaggtggtcaaaggaaatgttaaataaattggtgataatataatactatttattaatgttcagtgtatttcctttctctagaaagatacgtacaactttaacaataatctaaagcaacactttctccccaaagataatctagtggtgagaaattctagtaaccagacaagctgagggagccaatgttcccagtcagtcccttgatttccatgaaataatagagagagaactgagtttggcctatcttacctgcacataggataaatcctaatggtttgtagaatagtgcctgtatatgattccttaaattcctgaaaaataaatgattgtgcttggagctgaggcattttctccactgcccatgcagcaaagtctgttggattcttagaactgtgggacttgtatttgttttcactacccactgcttccccattctatattttatttaagtcttagtaatccccctaacttctaacctctaaccttcctttcccttctgctcaactgtaattcttacgttcactgtccaatctacccttcttctcaggaaaggttctcaaactggttcacactaagtaacagaaactgagagaagattgacaagagcaaatgaatttcagctgatccacagagctttgtctcttaatgtttccaattttgcacatttccctttgcaacagaagcataactgatagaccagaaggtgttacagagaatagagaatgacctgtcctgccaggctagctctcagcagccactgtgggggtgcgggagtgctccaccacaaagatctggcaggcaaaatgggctttaatgctctaaatcagagaatctcagagcctggagccccattatccttaagtgctacatgacgaggataagtaatattgagttgtctataataggctttaaaaaaatcagaggaaaaactttacatggaagaattgcatgggactgaagagctacagagttcagatcacaccaccttagtgttaattgtgtaactctgggcattggccttccatggcagagaagatctaggtactgatggatttcccacgtctcctgaatttgtaacaaataaatggaccaccaaatccatccatgcataaggcctgccctactttttagttaatttctgacattccctttgctgaatgaaccttttctatttaaatgttgagtccaagtgttcattcttattgtaggcaaaaagcaaatactgcatgtgatggctctgaaaattctctccataactacacaaatggaaggaaatactgaattaaacaatggaatataataccttagactgactaaataatggcttgttttgcattagtgtatttattttaatgcattctttgaatctaataagaagagaagggcagaaagtgtcacagatgatatactaaagtgcaactaactacagaaaattgaattccgaggcacaatgccagttgaaagcaaggacagaatgattgtaatggtgaggatatttgtaaatagagtatgcattctaagaagtcacctaatacaagaggcggtcatctgcaaatgcagtttatgtacatgctattggggcaatctcagacaatgctcctagttggaataaatcccaagaaacagaggcaaaggcgaatagaaaataatccatctgaattccccaaagatacagcaaggcaagttgacttgtttagatattatattatttcaataatggttttagataattgtttataactttaagaagactcaaaataacctggtaaaacataatttcatataagatatagtctaagattttagaatatctttaaaatttttcatgattataaaaataatatgaacacatgaaaaatttaaagcacaaataaaatcaaaagctctaacctttccatctttagagatagcaattattaacaagttggtacaagtccttcctcaccttttcttataaatatgtattaagttcatgtcaatatataatatatttaatgacataaagcatattcataaattacacatagataatatatttgacaatattgaacaatattcaacaagaatgtctattatttactaaacatggttctaggtgttggggatacagcagtgaaaaacaacaacaaaatcctcaccttcatagagcttacattttagtgatagaagagagatggtaaacaatacaaagataaatgaataaattatatgttagaagatgttaagatgatagggaaaaaacagataagaggggtaaggagtaccaagggtatcaggccttactgtcaggtaacatttggacaatggtcttaaagaggagaggatatgagccatgcagatattgggggaagagtatttcagctgagggagtagccagtgcaaagcccctgaggtgggcgtgtaagtggcacattataggaacaaggagactagtgtggcttgcatagtatgagtaagggatgggggtggatgatagggtgccagatggtgtatggcattgtagatctctgaaagaattgcaaatttggcttttactgcagtgaaataaggagacactgaagagtgtgtgagcagagttgtaacataacttaaaatttaatagcctctgactattgtgttgagaaaagagtatagaggggcaaagtggaaggagagggacagtttaagaggatttgtacatgaaatagtacagggatgatagtaggctggatctcggtggtagcagctgagtggtaagaagtggtcagattctggataaattaagcaattggacttcctgatgaattcatgttcaacatcagagaaagggagaatcatgcctatactttttttgacataagcatcctgaaggattgtgttgcctcaatagagatatggaaacagagagaggagcaggcttggggggcaggagactgtggcctgtgctttagacatgttaagtttaaaatacctattaaaaatatgcatatactgtttatgtatatacccacatatattattctatacatacttctatacattattttaaacatacttctctgtttacttttttcttgtagacattttaaaatatcaggatatatagattgcttcatggggtagacattgtgcatggactatattttagtctttattagggtatgataggcaaaattcttttttttttaagatggggtctcatgctatagccaggctggaatgcagtggcatgatctcggctcactgcaacctccgcctcctgagttcaagcaattctcctgcctcagcctcctgagtagttgggactacaggcgtgtgccaccactcctggctaatttttttttttttttgtatttttagtagagacagggtttcaccacgttagccaggaaggtctcgatctcctgaccttgtgatccgcctgcctcggcctcctaaagtgctgggattacaggcatgagccactgtgcccagcctataataagcaaaattctaagatggcctctaagaatcccacctgccaccacccccaactctggcttcctacatatcttgaataatcctttcccttgagtgtggacagggcctgtgaatatgttagcacggtcacttccctggtgatgttacgttacatggcaaagacgatgggataatcactcctgagattatataagccactccggacatgaggtaagcttctgtcacagccaactggagtgagattctcccattggctttgaagaagtaagctgccatgtgatgagagggccacattctaggactcaagggcaatctctgggagctaagacagaccctgggccatggccggcagaaaaatgagagcctcaatctacaactgcaaggaactcaattctcccaacaatctgaatgatctttaaaaagaacgccaagatccaaatgagaattccacacggccaatatcttaatttcagccttgtgagaccctgagcagagaacccagcaatgccatgcccagacttctgacccacagaaactgtgagataataatcagtgttgttttggctgggcgcggtagctcacgcctgtaatcctagcactttgggaggccaaggtgggtggatcacttgaggtcaggagttcaagaccagcctggccaacatggtgaaaccctgtctctgctaaaaatacgaaaaattagccagccatggtggtgtgcacctgtaatcccagttactcgggaggctgaggcaggagaattgcttgaacccaggaggcggaggttgcagtgagccgagaatgagccactgcactccagcctgggagacagagaaagactccatctcaaataataataataataataataataataataataataataataataatcaggtgttgttttaagtgctgagtttgtggtgatctgttttgctgcaatagaaaattaatatacataataaccctgacaatgtcttcagaaacacacatggataccctgttcccatggagcagatgactgataaagctacaaaacctaagaacagatgacccataaacatgagggtttcttgtactactataaataaatataatattatattgagtaggtcttttctgtcttacattcttttcatagaatcttgtaacagaataaacagtgattttcataaggtcgcagaatttaaagctcacaaatgtagttctagctctgtgacatataatcttttgtcataatttttccacccataagccaaagagtctggccttaaaaccatgtatgctatcaagcccagcaggtgccacttttgagagccaactcaaacaggcattcagaaggcaaataatcactatggctcacctgctaagtctgctctgttcaccacaaggagggaactccattaaatatttaagacaatcactaagagaacacccagcaggcaaacaactatgattacttgccccatagccctctcagcaggcatctgacagcacttgggatggggtttacatcacattaaagacatccctttgtagctcctatcaaaaggaagaccaacagtttcaaaactgagatttcaaaataaggatcattctcttgctgcatatcttgggcagagtttctaaggacttccctgaattttatcaagataggaaagacacagaaattagaaatctagtttcccttcataccttaactgtatgcctaaagcaaagcttgatagagtaaattatctcttactaacagaaaatacccactggtgtcatgaattcccaaattggcaagcttcctatgctagtctgaattgaacaagaagctatcaaatgcacacaagtgggtgtattgggatcagcaccagcagttatcaatctgaagaattcacaatatggtccatggggcaagtcattcataagttgctgctgaaatatttcattcacataatagggaacacctccctatcccaccaacactgatcaggaaaacccatttgggcttaatatgaacaaaaactaagcctctattatattaaaccacagaaattttgaagtttatctattactttaactgatgcagggattgtaaatgtagtcatcagggctatgtttgaaatatacaagtgcaactggctttagctatgtcttaaggattggtgcggctttagctatatgtttcaaggattggtgggttgcataggcttgggcagtacaggtattacagtaggtatctagtcaggaaggagcacggcaggagaggccccccctgacccctccacgaatgtcaggtgaccatcaggtgatggtcaggtggttgttaaactgtctctctaaaataataattggccacagccagtgccaacaaaaggcagtctcctgatagatagaaaaaccctgaaactagtgatcagtagtgtgatggttaatactgagtgttaacttgattggattccaggatgcaaagtattgatcctaggtgtgtctgtaagggtgttaccaaaggagattaacatttgagtccgtggtctgggaaaggcagacccacccttaatctgggtaggcaacatcaaatcagctgccagcacagatagaatataaagcaggcataaaaatgtgaacaagtcagattggcttagcctttcagcctacgtctttctcttgtgctggatgcttcctgccctcgaacatcggtctccaagttcctcagctttgggattcggactggcttccttgctcctcagcttccagcctattgtaggaccttgtgatcatatgagttaatactccttaatactcacatccatctatctatctatctatctatctatctatctatctatctatctatctcctattagttctgtccttctaggtgactaatagaagtcgcttcctgataagatcttgggagttgggcaagcagactcaagcatgtgcattaagagacaaaatggaagagtttaactggtatatgaccttcgagaaacattccgctggtatgggaagaatgcctccagtaagcatgcagacaactccagtaaacacactatgtgtgctccccttccaagcgctagcaggccactatgcatgcagacagcacactccaagggaagagccagggagaaggaatgaaagatcctggaagtatgtcaatgcataaaattccaagtcaaagatcaaacagcgcacttgatttctcaagtcacctgcttggccctcctccaagtgtactttacttcctttcattcctgctctaaagctttttttaaaaaaactttcaatcctgctctaaaacttgccacagtctcttcttctgcctaacgcccctcagtcaaattctttcttctgaggaggcaagaattgaggttgctgcagacccacatggatttgccaccactaacacagccagcccccacatttaatcatctccaatgtgcctaggaaacctggtgcctggatgtctggccactcttatcatactgctgggtcctataagggaggacctggtgactatatctgcacagtttataagatatttatgtaggactttacatgttgcaaactaagtgatatgtccaagactcctcagctcttgagcacagcagataggacaaaaaagtaggtatgctggccatgagttcatgtacctgtgaggaaggagaaaggaagaatgtggtgactctgttgcctaggcagaccctcagcagctgatgctctccccaagaggatgctaaaggaaagagcactgaatcaggaaccagaaggcccagagtgttttctgtgatctgccttaagaaagctgtgtggtcttggcagaccaccagctccccaagtctccatttcctcccctgtaagctaaaaaatatccaatatttctatttactgaaagttgatgtatccatagtatgaaatcccagaatagggccaatccattttggggcattctatcccagtttctgatgaattggggtcagtaaaaagaattcattgccagaattagccactgagctattgagaaatttagaatagatattagtgatagaggcaggaggcagacaaaggcgtagacagatagagaaggatctctggagaatttccaacctgccccacaagtgttacaccagatgttttgtgcagataagggaacctgcacagggggcttacctgggcatgcccacggcagactagaggcccacatgcactgggggaatggtgtggagccaccagaaattcgggcctaatgcagaggaggagcctggcctcttcagctggtgtgtagtggccctggtattcaatttgggaggtggaaacctgcttgcaggaccccctctctttgctgagaggtttcttttcacttaatacattccaccctcctcacccttcaatgtgtctgcctgcctaattcttcctggtcatgagacaagaacccagattagctgacctaaggagcaaaaaaatcctgcatcattttggtggcctctacggggacttgtcagaagggtgagtaaaatgcagacccaaacatctctctcacttttgtttctgagctttcttgtcctcagactttttctgaaggcagaggaaactgcccccttccccaccccatcattctcaggcattggaaatgtcggcctcagtcaaacccagtcttttccatggattttccttcatttttgggggaatgtattggcacctatcttttcttttacaatattaggggtgtttcaccctcaccccaatggttgcaggcatgtgcacaggacagacaggtgagcagtggctccctgccccactcccctcctgtctggggcacacagcctgggcctggggtggctagctggccagtgttccccaccaggcacccacgcagtcttcccttcccctggccaaggggtccagctcagtgggagtcccaggaaggagacagcaatgaaaggtttctctccctgatgaagaaacccattgcataagaataagaggtttctcccccaggaatcttcccaggcttgcacctaagcttttttttcttccttttctccaccctgtaggcagttaatgcagccttgcagatatagggagcttttctatgcaagagttttttttttcattttggaaggcatcttgttaggccaggacccaaattcacaagacaccctttttctctcccttgttggaggagaacccagctcctcagctttaccttagcattcagcttatgataaggaggcagcagccagctgctggctgcagtctgtcaaggtctaaggaacgcaaaggttatgacaacagtggagacagggtgtatgtgggtgagtacgatattcccaccctctaggcccctgtgttaacgtgagtggaagctgcactgacacctatcgatagcaccctgtcaaggttgccaggacttgaagatacaaggacagaagaaagaaaagaaacacctcttctttctctgcctcatgtaccccatatttgctgggaagacaaaggaattagggacaccttatcctgtcttcctagctgggtaaccattcatctttagtctgtacctctctcaaatgcatcctgaggcaggggggctccttagagaaaatgccttctttttcctttttcctcctctgtcctctcttcacagaggggtaattgtgtccccctactacaggatactcccctcggatgcatcctccaaactgggaaaagttaatttcccagaccttaaactgcttggtctagaactgagctgagggtgagaggtgacagcgtgctggcagccctcgcttgctcttggcacctccttggccttggcgcccactctggccacactataggagctcttcagcctgctgctgcactgtgggagcccctctctgggctggccaaggctgaagccagctccctctgcttgtggggaggtgtggagggagaggtgcaagcgggaactggggctgcgcatggcactggcagcccaccacaagttctgggtgggcgtgggctccgcgggccctgcattcggagcggccagctggtgccgccggccctgggcagtgagggacttagcacccgggccagcagctgcagagggtgtgctgggtcccccagcagtgccggcccactggcgctgcgctcaaattctcgctgggcctcagctgcctccctgctgggcagagctcgggacctgcagcctgccatgcctgagcctccccactgccgtgggctcctgtgctgcccgagcctccccgacgagcgctgccccctgctctgcagcacccggtcctatcgaccacccaacagctgatgagtgtgggcacacagtgcaggactgatgggcagctctacctgtggccccagtgcgggatccactaggtgaagccagctgggctcctgagtctggtggggacttggagaacctttatgtctagctaaaggattgtaaatacaccaatcagcactctgtgtctagctcaaggtttgtaaatgcaccaatcagtgctctgggtctagctaatctagtggggacttggagaacctttatgtctagctaaaggattgtaaatacaccaatcagcactctgtatctagctcaaggtttgtaaacacaccaatcagcaccctgtgtctagctcaaggtttgtaaatgcaccaatcattgctgtgtctagctaatctgatgcggacttggagaacttttgtgtctatcttggggattgtaaatgcaccaatcagctccctgtaaaacagaccaatcagctctctgtaaaatggaccaatcagcaggatgtgggtggggccagataagggaataaaagcaggctgccggagccaacagtggcaacccgcttgggttccctaccccagtgtggaagctttgttcttttgctctttgcaataaatcttgctgctgctcactctttgggtctgcactgcctttatgagctgtaacactcacagcgaaggtctgcatcttcactcctgaggccagtgagaccacgaactcacctggaggaatgaacaactccggacgggaggaacaaacaactccagacgcgccacctgaagagctgtaacactcaccacgaaggtctgcagcttcactcctgaagccagcgagaccatgaacccaccagaaggaagaaactccaaacacatccgaacatcagaaggaacaaactccggacacaccatctttaagaactgtaacactcaccacaagggtccacagcttcattcttgaagtcaatgagaccaagaacccaccaattccagatacaaggggaagggaatccagaaacctgacgtgccagcaaaagggtaaaagtttcttttaccagttggacttttggcctctccctccgtgtgcaaaccggtaaaaggaatggtaaggatcactgtttatattctctgtaaagttttgattaatgaaaaaggatttatgagtttggtcttaagctgtagccaatctggtatgctttgcatgtctttctgtatggttctatcagaaagagaggtactttaggacaggatgtgggtgtaggaccccataagtccacttttcaagtcagcccagcaaactggtcagtaacaaactttgctgcaggcttgcatcttgtttacatcctggggagcatgacctgtaactacgtgggagtgctttgttttagtctgacattttacaatggtggctcaggttcaatcctggcttggagaatgggtactttctttctttctttttttttttttttgagatggagtctcgctctgtcgcccaggctggagtgcagtggcgcgatctcagctcactgcaagctctgcttcccgggtttacggagaatgagtactttcaagttaatagctgtgtgacttctaccatttgctgattttcttcccttccatgaacaacttctagattctcttcttaaatcttcccttctctgagctacccttaaagattctagatgttgtaaaaactgcttacctcctgctttgaaaatacttcgtacactggtagtaaagtcataaccttaattgaggcttgttggtttcacctgtgaggttacttttggtaaagttcaaaagccagaaatattggctgcttgacatggctaaagtcaggtaatacgggatttaaaaggactttcttaaggagtgctcagcttaattaaaagcagatacccaagtatgtttaaaggacctttatggtttttttcccttcttgaatcttgtttttctggaaaaaggtttcttctcagttgattgaattatttttctccattttgtcttgccactcttaaggcacacatgagaggccctaaaataatttctgatggcctgtgactccttggcaaaaacagaaaaggcaccacagatcccattttgtgagaaacctgttttcctcatggaacctcagaaattagaggcaggtagatccctctcaaaatctgtttttgtcttccagccatacctgtttgttaggccctagaaaatacaagctttcctagccttgctcttaaagggctccacccagaggccaataatccaattagattggcaaatgaaaaatcttacaactactagattttcttctgtctgtctacataatcatatatgtgttatgtgtgttatgtttataaagaaaagagctctaattaattggtttgaaggaaaataagcacttaaatgaaatatttttttaaaagaaagacaaaagctgtaatactttttagtatttagtctatcgttccttctccaaagaggtaattctaactgccattagaataggggcaaagacggatcttaactgcttcctgctgacagggggcactattttgggaagatggcagtcagatctcccccagaggcctagctaagtgtccccagtaaaagggagccatcgtctgtggttctggttgcatgaccgtttggagttcgatggcctacaggggagaagagactaacttctctgatataaaatcagtcctaactcaaccacaatggaaaagtatataaatgttgacatctgtaaatcattttcagtgctccagtcatataaccaagttagtagtgttctaccttaccagaggagaactgaagaactttgaactgtgaactttcccaaggaaaggtaagtcaaatttcaaatttagtgtataaaaactgaggagaactagagggtagtcagtgttaggatagccaagggagcagctggaaaggcacccaacgcagactaggacttcatttaaggatttaggagcctctaacctcaagaaggaatagaaaatacatggaaaatgtagcctggggaagagagttctaggcagctacagggaggtggtaagtttgggaatataaggttttcctgcagagatctgcaaagatgatctgactgaagttgtaaattagactttgaccccagcctccctgccatcaccatgtcctggccacagacaatggagacagcacagggcaggattaagattatgggctgtggagtttgagaggtagtaggactgaatttttgtctgcctccagagccatagagcagctctcaatttctgtaaaatgggaatgatgacatctacttctcagggttgaagtttaactgttcagttgttatcattactaacctatcccctgctttgtagccagtgtgatcattctaaaatataactcttgcttctcccccatttaaaactcaatggttccccattgcacagaacaaatactccaatttcttaacatgcctttcaaagttttttggtgatctggtccctgcttccctctccagtttcatggatcatggcccttcagccacattagatcatctcacttccccaactccccatgcctgctcagctttgcctggaacacacatctccttacccttcctcaccaaaaaaatgcctcctactcttcagacttcagctggacaatcttcaataggaaaccttgtatttaatgaatgtgtatattcaatatgtatatatgagtatatatatagagagtacacatatgtacatagagacattatcagttcatgtgaatttatctgtatgatactctacactaccttagaatgtaaacttcaaaattgttttaatatattctgtatatcaacacagtgtgcctagataattaacattaaacaataatgccaaccaatttactgtttcttgggagcaatttttataaatatggtagttgttttagggtctattgggaaataactttgttatatacacttttcattaaatagttcatagtttaatataaaatatacccaatcataaacgagcatcagactaaggataaccatcttgctacaaatcatggtagagtcagacaagtttttctaacttagagtcaacagtaggcaatgctaaaaataagatcacaggggaaggatgcaaaagaattgctggtaagtattcctttttgtgtttcaactgttttcaacagtgcgacaactgaaacttaggattgcaaccagaggggctcctcttacctctgcatcaaagcgcggatcctggtaggcatcactgatgttcactggaaggcctgttgaagcaaccagctcagcaatgctgttatttattagccagtcggagtatgatgatttctccatgctttctttgaaactatcagagcaccaaggtaggcaggaagaaaagagagaaacgtaagttttcttgaaaggaaaccctataaactacactaatatcaggataatctgtccttattaagaaaaaataagtgacattagtcacagaacaatagcaaggtaattatcagtagctacttcgaaatgacttacctgctataatgtataataattaaatccatgggcagaaaccatagattccctatgattcagagagactctaggctgtatttaggtcccaaagctggcaaacacatgtaaggaccaaaattaacaataagacaccaacaactaataaaattccatcaacttcccagcttgccctttttaattgaacagactagatgttttggcacaaggaagaatgaaacccaagtagggaaaaatcaggaagtaaattgggaatttaaaaaattacaaatgcagcaaaagaatgtatctagactatggtcttttaattagtaattatttgaaaaacaattttactatcttagtcattattttgataacattaatattttaataacttttagtatcttagttaactattttggtaattttagattatgtttcttaacaatagcccatataccacttacaaaatctcacttaaaaggctatttaatgcaacagacccttaacattaataattaaaactattttcatatttaatttgaacaaggaattttatgccaaatgattttttgaactttcccttgtatcattttcatgacagacactacataaacagaaatgctgtaagaattagttaatatccctcattcttctcctttccatcttttcttccacaagtatatattgagcactgccaggagccgtggagatacaaaattgagaactgttcaaattagtattggcaaggaaaattttcctggaggatgtctgatttgtcgcttggcaagtgataactgaaattatgtggatggatgcaagcatactagggcaaggttttcaagctgccttatgtggaaccctggatttcatgagatgttaaatgagtatactacagcaagaataatcatcactctattgactttttaatctaaactgcactatatgtaagaaaacactaaatgtgcacatcgtctttgttattatgcaataatgtccctgtgtaaaattatgccatgttgagaaggcaggaaactgcatggaaaggccattggatgcatgagtgagtgggacacatagacattatttaacatcattaatatatctcatctgtaatgattgctggcctgtgtctgataaattcagcatgtatttgtaatgttattcatcccttattgcatattaaacattaataatacataaactttattctctatggctctctggctgaaaaatggaagttttaataaaaagctgagtcttgtagttcttagatggcacctaaatcaaagaagtaaaaagactgagtacttcaaagagaagaagaagctttattttctaaaacaaatcaaaacaaaagaacaaaaaagtttttattttctttttgctgttttatatgcatctcatttcatgagatgaaattttatgttgtgctgcaatgaaagcaaaatctaggagaaacaagataatgcacctcacacaaagatctaaatgacttagtgaagtcatttctaagtttataaaagggtatgggctaaattctgacctttcagggattaattggcttgccagttcattctgcactgtgtactttattccacattttaatttttgaggtgttctgtgatcacaccgtttcgaagctgctgacctagagtgttctgtggagtgtgggaagcagcgctgcagcaggagctggggagaggtctgggcacagaagtaaaacggttgggtagggtggggctcaaggaaggagccagttttaccaataagtgtcaacaatcttcaagctgggtctttcaggatgagaaagagttcaacaaggagagattggaggagttagaaggaaacagcaggaacaaaagacacaaatgcagcagagtacgaagtgtgttcttggcacaatgagtaattgtatggtgggaataaaactgaaaaagaggccaaggctcaaaggtgaggccttgaccaagttgctgagaccttagttataggcaatggagaactgtttaagaatatggagcagggaagtgacgtggtttaagatgtgattttagaaagcttaatccaggtacaatgagcaagaagaactgggtaagagacactgaggatgggaagaggtcttgtaaaccacagaagtcatgcaggtgggaggtgatggtgctggtgactcaagaggtactgcagaagattccacaggctctgtggccagatagcagtggcttacattttgttcccgactgcctgtggccctattagcagaacacagttgttttaaggagtggggagataggggaaagatgacagatattctgtaagcctgggacatgttcatttttgaaagtccaggaacaaaatcctatcagtcctcaggactgaaaactctaatccagagttaggataattttcacggagaataaaatgcatgagatcactcagggacagaacacgtagggaaatctatatctagggaagggaaggaggagaaaagtggtaataaagggggaagggagaaagagaagaaattttaaggaagaaaaactgaaatttattgccatctactgtgggccaagggtcaggccagatactttacccaactaatttgttttgtcctcagataaatcctgtgagatggatatgcttctctatattttatagatcagaaaatggagacctaggatgctcaataactttcccaagtggagatagaattttcacctaaatctgaccccaacatcctaaattatagtatttttcctgttgcctttcagaaggagttaatggatagcgttatagcaagaatagtgggttgtcacctaagaacaaatagggaggggcagtccacatcagagagagtttaaggaagctgctaaagataataaacacttcactgtgagactttagtcacaggaacagggaggaaaaaccattggagttgataattaagagctttaggtccctacttacagaattcccaaagaagatacgatgacaaaaacacttactgagcaggggctcctgaaaaactcactctaaatctaaaacatgcttagaatgtggcttggttcagtatgcatactgaattgaaatcattgtaaaatcagtgaacagtgtagaaggaatattgactctgtgcaaggcagggttgaggccgtttctaaagtataagctatgatctctgctctcagggagtttgctacttaactggggagatgagaaataaacacactgacatataaacaatataaaaattaaatgcccacttcaaatttcaaatgaaaaatttttcacatagatgtgttgataagttaccaagtcaactgtaccaatcacgagtgctgaagacgtccatggagggagaaatgacttcaggtgttgtaatctagctaaggcttcagagaggaggtgagattcaaactgacctatataggtcagtgcaacagtgcaaacagattttctgaaaatcacctctgcatttcttcagtttaatgttgcacaggaacataaattaaggcctgagtgatcagatcctcagagagacagataggaaagttgatttgtcacttggtatttacatcactgtcttagtccattcaggctgctagagcaaaataccataagttgggtgacttataaacaacaaatatttatttatcacagttttgagactaggaagaccaagatcaaggcactggcagattcagtatctagtgccttcttgctttagttcagtgtctagtgccttcttgtcctcacatggtagaaagaatgagggatctctctggggcctcttttataaaggcactgattccattcataagagctccacccccatgacctaatcacctcctaaaggcccaccccttcataccctcacattagggactgggtttcaacgtatgaatttttgggcagacacaaacattcagaccagagtaatcacattctggcttacgcaccagctcaattttggaattccttttttttttttaattaattaattaatttatttattttttattgataattcttgggtgtttctcacagagggggatttggctgggtcataggacaatagtggagggaaggtcagcagataaacaagtgaacaaaggtctctggttttcctaggcagaggaccctgcggccttccgcagtatttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggcaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcagccgggcagaggcgctcctcacctcccggacggggcggctggccgggcggggggctgaccccccccacctccctcccggacggggtggctgccgggcggagacgctcctcacttcccagatggggtggctgccgggcggaggggctcctcacttctcagacggggcggttgccaggcagagggtctcctcacttctcagacggggcggccgggcagagtcgctcctcacctcccagatggggtctcggccgggcagaggcgctcctcacatcccagacggggcagcggggcagaggcgctccccacatctcagacgatgggcggccgggcagagacgctcctcacttcctagatgtgatggcggccgggaagaggtgctcctcacttcctagatgggatggcggccgggcggagacgctcctcactttccagactgggcagccaggcagaggggctcctcacatctcagacgatgggtggctgggcagagacgctcctcacttcccagacggggtggcggccgggcagaggctgcaatctcggcactttgggaggccaaggcaggcagctgggaggtggaggttgtagcaagccgagatcaagccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgcgtgcctgcaatcgcaggcactcggcaggctgaggcaggagaatcagacagggaggttgcagtgagctgagatggcagcagtacagtccagcttcggctcggcatgagagggagaccgtggaaagagagggagggggagaccgtggggagagggagagggagagggagagggagagggagaggctggaattcctaatggtctactataatgcagaatcgtaacactgagttagagctttcaaaagcttgcttctcttctttacaaacaaaaggtaattttatgttatgattaggatcatgagttttggcatacctcaatcaaatgtcccctttgctgatttctagcaaagtgatcttaggaaaacttccttggtaaaatgggtataatactactactgtagagattaaggtgataattcatgcaaagtgctcagcatattatttagcccatagcaaacattttctaaaagcatcacaacttttaaagcaaattctgcacatgacagtacccctttatacatttcagtgatgtggtgttgtgagtttaatcacaaaggaaagggcccaaattatttctgcttttggaaggacacatctaacttttagggtaagctctttcaaaaagttcctacagctcatcacctccccctgatttatgagggaacttttattcagtatggttttctcttttgcaattggttgctgttgggacagaacatggtaagatcacagacacagccacgtttagttgtgcaggttctgccttgcacacggatgccctataaaagggagaagtgggggtggaaattagtctaactgtgcttgtttgcttgaagttgcatccacctggagagggcaccttttcctaattctcacagagacatttgtatgggctttcaatggccctccttcaagcttttcttcaacacatctgaaaattgggcatgtaatctcaaatggagcaccatcagtgacaggaaactcactacctatcatatattacattatattttgtggcagctcagtttactttctaatagtcatcatccttggttccaagttccatggtttgtggccacagagcatggacctcattatctgacagccctcaaaatatttagcaatagttaacatgtcacccatgatcatccacctaacatcattcttctcccacctgtctccaattccttaagttactcctcttgtggcatgccttccttattcgtaccatgccagccctagatgtaaccccccttgttaatagtcctttggagtatgaaagccagtccagtccacagttctctccatggggtctgagtaggatgaagtgggtatgaccacctccttcattctagaacctatttctagcaacaaacatcaggagtgatagttcccaataggtcttatttttgataagtttttggaagtttaaattaatattaaccaactttcttgagtctaaattaaccaactttcttgagtctaaaaactcccaccagagatatcaaaggccaacaaatccaatactaagattttcagtttgggccagaaccaagatagagactcactgctgtttggaaacacaactacaccttgattacaaccaggcctccaaagcttatgggtgcaaatcagttcatgtcaactcagtggttcttagctgccatgtatataattgtaagacgacagacacctccaagtccttccctgacctccaacctttggggatacttattctttcattcaaggcccgttgttaaagcctactgcttagaaatcacttgagggagcctgacccgtagctcccagactgccaaagcttcatagaagaagggaagaatactgtctgccaagctctatgcagcatgttggtgcctgagccctaatgccatattgcttgtgcccacgttgtcactagtttcctatttaaacagctccttttgcctttgcccatacccctctctgtagacatagagggcagggctgggatgcccattcacattagacgagtactcatgtaccaactcattctttcagcaaaaagacaaagacccttatcaatctcctcatgcaagtgaatgtctagtgtgaatggtgtgtttgtgtgtgtgtgtgtgtgtgtagccaacacattaactgtacactggtgcataacaagaaaaaatggcatagaattcttagcaacatttatttgttgttgaagactaatggttgattgagaaaccattcaaatgtttctaaagtttttttttaaagcaagtcatttgtccatgtttaatttcacttgtccatatttaatagcttcatacatttaagtcacaacactattttgatccctacagtggggatattttaaaaaattctggcttaaaggaaaaaaacagcagacagtaaaaatatattgatataaatgtttgagaaaagtaaaagaaacatagttgacacctgaacttcagtgaaacttccttaaaaggtcatagttaaccacttaatagcttattttaactctctacaaagtagacctccctaagctcgattcacttcagcataacactctaattgtaaagaaatcctttatcttgttattttgctagaaaaaggggtataagaaaatgtaggtttttaagtgagtttcacgtaaagggctgtagtttagattcttctcagtggtatcttgcttccaaatgtgagactcaaactgacttcaaagagagcttcatgagctcaaatatattgactgtggagggataaaagagaattgccctattacagaaaacacgtaattcctgaaatgtggctgcccctgaagtgagggccggtgaggtatatataaacctcagggctgacaagttgcagagtcgtgtaggaggtaaatcaatacgagcaaagaaaaacaagacaaaataaaataccccagaacaagtgactcaacatctttaattgtctgaaagtcctggcttagctgaaggttcaaatacagagaactgtgtgaaaataaaaagactatcttcagcattacttttccaaaaaaaagagtctccacattagaagacaaaacatcttaataaaataatgctaatcattagactgtgcttgtgttcatgtttctcttctcaacataacagtttacttagatgtcttcattagaaactctcaagagtctttcaagaatgacaactagtttggcctctactaagtgctggacaggagtgagccaaatcttgcattaagcgaacaataaggatcttttccttgttgttgaaagaagctggcacatggaaacccatccttacacggatgtcagcccagcctagcccctacttatacagaaaggggtatgggcagaagccaaaggggtatactctcagggagctcacaatagtgatactgaattgtgataaatggcctaatggaaggatgtggaaggatgttggtctaagctggtctttagaggataagtaagagttcacctggaagagaaagaagataaaaacaattcagtcaaaactatagcatgagtaaagctttaaaaagtgtggggttttctccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaataccttttatttatttatttattattattattatttttagtagagatgaggtttcaccatgtagtcccagctactcaggaggctgaggcaggagaatggcgtgaacccgggaggtggagcttgcagtgagctgagatcgtgccactgcactccagcctgggcgacagagcgagactccatctcaaaaaaaaaacaaaaaaacctaggaatccaacttacaaggaatgtgaaggacctcttcaaggagaactaaaaccactgctcaatgaaataaaagaggatacaaagaaatggaagaacattccatgctcaaggataggaagaatcaatattgtgaaaatggccatactgcccaaggtaatttatagattcaatgccatccccatcaagctaccattgactttcttcacagaattggaaaaaactactttaaagttcatatggaaccaaaaaagagcccacattgccaagtcaatcctaagccaaaagaacaaagctggaggcatcatgctacctgacttcaaactttactacaagggtacagtaaccaaaacagcatggtactggtaccaaaacagagatatagaccagtggaacagaacagagccctcagaaatactaccacacatctacaactatctgatctttgacaaacctgagaaaaacaagaaatggggaaaggattccctatttaataaatggtgctgggaaaactggctagacatatgtagaaagctgaaactggatcccttccttacaccttatacaaaaattaattcaagatggattaaagacttaaatgttagacctaaaaccataaaaaccctagaagaaaacccaggcaataccattcaggacagaggcatgggcaaggacttcatgtctaaaacaccaaaagcaatggcgacagaagccaaaattgacaaatgggatctaattaaactaaagagcttctgcacagcaaaagaaacgaccatcagagtgaacaggcaacctacagaatgggagaaaatttttacaatctactcatctgacaaagggctaatatccagaatctacaaagaactcaaacaaatttacaagaaaaaaacaaacaaccccatcaaaaagtgggcgaaggatatgaacagacacttctcaaaggaagaaatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggagggactgtaaactagttcaaccattgtggaagacagtgtggcgactcctcaaggatctagaactagaaataccatttgacccagccatcccattactgggtatatacccaaaggattataaatcatggtgctataaagacacatgcacacgtatgtttattgcggcactattcacaatagcaaagacttggaaccaacccaaatgtccaacaacgatagactggattaagaaaatgtggcacatatacaccatggaatactatgcagccataaaaaaggatgagttcatgtcctttgtagggacatggatgaagctggaaaccatcattctcagcaaactatctcaagaacaaaaaaccaaacaccgcatgttctcgctcataggtgggaattgaacaatgagaacacttggacacaggaaggggaacatcacacaccaggcctgtcgtggggtggggggatcggggagggatagcattaggagatatacctaatgctaaattacgagttaatgggtgcagcacaccaacatggcacatgtatacatatgtaacaaacctgcacgttgtgcacatgtaccctagaacttaaagtataataataataaaaataaaagaagtgtgggattttctgtattggtatagtaaataatagagctgacgcttaggatacacggtggaagtggtgaataaggctactgcggaagaggccaaccaatatattgtgtggtttcatgcacaagctttgtatcccaaactacatccatacagatgactctttctgtttttcgtttttaaaatgtctttttttttaacttttaagttcaggggtacatgttcagggcatgcaggtttgttacataggtaaacatgcgtcatgggggtttgttgtatggattatttcatcacccaggtattaagcccagtaaccattagttatttttcccattcctctccctcttcccaccctccaccctccagtaggccccagtgtgcactgttcccctctaggtgtccatgtgttctcatcatttagctcccacttataagggagagcatgccatatttggtttcccatacagatgactcttctctgtatcagcagcccctagagtccagagttccctatgtatatacctaagtactttctggggacttcctcctgagcacctcaaagttgccattttcaagatcgaactaacacactacccttgatgcactagtggtcattaatgaagagtgtgaccattaactaaaaatagaggattagggtgggactgaaagtttcaacataagcacaatctattttctcattaccaaggaatgattgtcagttgcccttctgacagcttgagtgttacccagtgaggggtaggagccagagaggcaaagagtcaggaactcaaataactatttgggacagatttctttttaatgctttgcaaaccaaatattgatttttgatctatatgatagtatttgacattttgtttcattgactagaggtcaatctgaggttgggttcacaaaaagaaactgcattccttacttttttccccctcagctcagcctgtctatccctggagcccttcctgaagcctccagctgtgcaatgctttttgaagttgtcttttaattaggagattagggaactaagtaaataccagtgggactcaaagctaggacctcagcaggaaagtctcgaacacccaggacttgggacattaaaaatcttttaatggcttaagtatatctttgaaggttattgaacaagtcttttagtcatataaagtaatgggagagagtgtaattaacaagcagagccagcctgtcagctcttaccctgtggtaggaaaagaagattctctaagttgcaggagttcctaaatttatcatgatctgttagtggagtcgcctttaatgtcttgcctgaggacacttcatcacacttttattcctctcattttaagcattctgtattaacagaaattaacacatggtgaccaaagaacacattttctatcttttatttcctcaacttctgcaattagaatgatgagatttatcagccggtgtcactgtgcagttgtgactatcagatgggtgtcagatgacattgctgtaagtgattggtatctaccatctagcatcatataatgacaattgcctgcttctgtcacagctgaataaatctgggtggtttttttgttgttgttgttaatcttggtccaacatttcctgtcagtgagattacagataattttattattatctctaatttttagtttccataatggaaaacatgggaaataaaactcactttgcagggctgtttggaggataaaataatagaatgttgaaggctgcatagcgcatagaaggctctcaataaataccggctctttatatcacaaagatttttctttaattaaaaacaccaaggtgagacatgctctgtttaactgcttaacttctaggacagtagagagatgttaaatgtttttgacggtggcatcattatcagatttggagaaatactgaggagaaaatgtgccagctggcaaaactgctgatactagagcagtcaggattctatcctgctggaggtttcaagtagccccacaatatctctctgtgagggtgctgtggatacctccatacatctctagattgagggcacaccttcccaacaagtcctgcatatatatatatatatatatatatatatatatatatatatatatatgtgtgtgtgtgtgtgtgtgtgtgtgtgtgtgtttgtgtgtgtgtgtgtgtatatctatatgtgtgtatatatatctatatatgtatatatatctatatatgtgtatagatatatatgtatatatgtgcatatatgtatatatatgtgtgtatatatatctatatatgtgtatatatatctatatatgtatatagatatctatatatgtgtatagatatatatgtatatatgtgcatatatatgtatatatatgtgtgtatatatatctatatatatgtgtatacacacacacacacacagcaagaaagggagcagattcaatttgttaaaatattaattaaagcatgttaaatgagagacctactaaagcaagacagtcaaacataaaaaccaactgctaaggtttctaaattgccataattctgtttactgcatagtattaatctgagggacagctgacctatataggctactttattatgcttgatctcagtacttattcacatggcttattatcatggaacatttttatagctttcattctcgtctgtgacagttttactagagtgacaagctcattggtctgaaataaataggggtaatgagagcatttgagtcttcatattcaatgccatgaaaaagaaaagatggaaattacatatgggtaagaggtaaagattagatgcttgaaaaatacatttccaaattcattaagatgaatttggaagatacacaacttcattaccaaggcttcctttccttcattgatgtttagctcttataattaatatcatgcaaatggggcacagacacatacttcactagtgccaaggagtatatttacaaaatagggttatttgtgggggaaaatatggaatcccagaagtatcaaagcaacatgattccctgagagatgtgcttaggtcaagcctatagtgtttcagtggatcaccccaacttcatacactccgcatattttttagcgaaaggcggcagagaatatctgggtaactttgtaacaatgaagcttcctggtaaatgaagtggctttgataccaagaggcagactcagaattcaacttctggcaccagtcttgtcttccattgagctaattcagacctgctcagccacctccttgccagaaagggaatagaaatgagcctctaaggttatctggatcacttgcttgtcaattgacaacattaaatattggcaaaatgaggttcagcaacccttaatatgctagagagtagtcaaaaagaaagtccttgtttaaaggaagttacatagcaacacaaatcttgcttacattccaagacgacaggtcgtggtagtgatggtgctgttttaattttttaatgttataaaggttttcttcatttccttgacattgaaatatgtagcatatttttgtttatacaaaacacctattacatccttcctagcagaggcacagtagaagaaagaagatccatgcagaagaaaacagaacaaatatgaaatattcattatatactgtggaaatattttgtctcatatcagtgtgtaagtttgacttacattccctattaccttggacatagagaaataaaagaaaaagtaaagagaagaggaaagaagttccagattggcagagtagatcactgaaaatttgcgcctccataaaagcagcgagaatactagcaaaaattgtcaaaatcaactttttcagaactctagaaattaaccaaagacttgcaataatccaatgagtatttattcaactgtagttgaatctcaggaaaaacagcaagatctatggctttttaatttaccttatttgcatctccctctatccatctctggggtagctgtgaaaatcagcagcctagcagccacttgcagaggaagaatgagtttggaactccccaaaagctctatccccagagaattgtcactatttgacctgtttggcagttccatggaaacctccattcacagaacttgtctttatttgacctgactcagggcttgtttattgagaacagcctttacccccagggatatttgtggggaaaagtcagcagtaattgtttaacatggcaattgcttcaggtggtgataacacttgcagctaacaagaagctgagcaaaaagcttaatgagataagcttgggaatgagatgctcccagaaggctttgaaaagcttgtacatattcatagacatctagaacgtatgcaacacacacacacacacacacacacacacacacacacacacacacacactactgtaagaatgtctgggaaagaactgagaaggctctcacctctagcagattttgaagctctgtgttaagtggaaaatgaaacctaagtaaaatccctgtcagaggattgaaggcatccctcatatgcacatagagctcctcagcaaaggctggaagacttattggttcaggcttttaaggaaatctctgtcccattagctgacaaccaagctaactgagcagtaccttcagttgccaaaccctcccaaaaatacagacttcaaagaattagttctggcaagtcactgaacagcaaatagcagtaacaacaataatagcaacaaacagaaatgacaacaaacattagatcgtggggtgaggggatagacttgatttccagagtttccacattacattatttaaaacattcagttttcaataaaaatttataagacgtgcaaagatacagtaaaggatactccatatatgaaaaaacagtcaattgaaactgtccctgagtaaaccaagatgttggacttactagacaaagtatttaaatgaactattgtacatacattcaaaatactaaaggaaatcatatctaaagactgaaaggaaaatatgagaaggctgtctcccaaataaataatatcaataaagagaaagaaattatttaaaagaaccaaacagaagttcaaaaattgaaaagtatagtaacagaaataaaaaattcactaggctacccaacagcatgtttgaaaaggcagaaaaaagcatcattgaacttgaagataggtcaattcaaacatctagtctgaggaacagaaagtaaaaagaatgaagaaaaatgaacaaagtctcagtaacatgtgggataccatcaagcatacaaacataagcataatgaggattctcagcaaaaaaggagacaaagggtcagaaagaatatttgaagaaataatggttgaaaacttcccatacttgattgaaataaacattaatctacacattaaaggagctcaataaactacaagtaggataaactgaaagagaaccacatctagacatattataatcaaactgtcctaagacaatgacaagaaaaaatcttgaaaacaacagcagagatgtaactcattatataaaagtaaccctcaataagattaatatctccatgatcagaaactataaggctagaaaacagctgaaaaatatatccacagtaccaaaaggaaaagactatgaaccaagaattctatatccactgaaactatacttcaaaaatgaaaaattaagacattctcaaataaacaaaaactgagaaaatttgtttccagtagacctgtcctgtaagaaatacaaaaagaaaagccttcaggctgaaatgaaaagatactagggagcaatctgaatccacatgaagaataaagagaaccgataaagaaaattttataagtaaatatgaaagatagtataaatgtatgtttgtaactcttttttctactatctcatttaaagacaatggcataatgcaaaaattataaaactgcattgataggcttatcgtatgaaaagatgtaattagtaggacaacagtaacacaaatgaaggggtagggaacaaagctatatggagcaaagtttttgtatactatggatacaaaagaaggcagtaaagaaggaataggggaatacaaaggacagaaggcatatagaaaacaaatacagaaaaggcaaatgtaaatcctactttatcactagttacattaaatgtaagtggactaaacactccaatcaaaaggcagagatcagtagaatggataaaataacatgatccaattttacactgtctacaagggacatactttagattcaaagacatgactgggttaaaataaaaaaatggaaaaagtatatatattataccatgcaaacagtagcaaaagagagctgaagtagctattcatatcagataaaacagttttttttaaaaaacggttactagagataaagaacaatattttataatggcaaagggtcaaaccaataagaaaatataacaattaaaggattccctatttaataaatggtgctgggaaaactggctagacatatgtagaaagctgaaactggatcccttccttacaccttataaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacagaagccaaaattgacaaatgggatctaattaaactaaagagcttctgcacagcaaaagaaactaccatcagagtgaacaggcaacctacagaatgggagaaaatttttgcaatctactcatctgacaaggggctaatatccagaatctacaattaactcaaacaaatttacaagaaaaaaaaaaaaccacatcaaaaagtgggtgaaggatatgaacagacacttctcaaaggaagaaatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttagtgggagtgtaaactagttcaaccattgcggaagtcagtgtggtgattcctcagggatctagaactagaaataccatttgacccagccatcccattactgggtatatacccaaaggattataaaacatgctgctataaagacacatgcacacatatgtttactgcagcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattctcagcaaactatctcaagaacaaaaaaccaaacaccgcatgttctcgctcataggtgggaattgaacaatgagaacacttggacacaggaaggggaacatcacacaccagggcctgtcgtggggtggggggatcggggagggatagcattaggagatatacctaatgctaaatgacgagttaatgggtgcagcacaccaacatggcacatgtatacatatgtaacaaacctgcatgttgtgcacatgtaccctaaaagtataataaaaaaataaaataaaataaataaactttaaaaaaatccttgtacaacaaatattcatagcagcatttttataaaagccaaaaaggggaaaaaaacaaaatatccatcaattggttaatggataacaaaatgtgatatatctatacaataaaatattatttgatattaaaaaaagaaaaataacaattataaataagcatacacctaataacacatccctaaaacatatgaagcaaaggttgagagaactgaaaggacaaatagataattcaacaataataatagtggagccttcaacatctcactttctataatagagcaactagacagaagattaacaagaaagtagaagacttgaacaacactataaaacaactagacctaacagacatctatagagcactccacctaatggcagaatatatatatattttaagagcacaagaagcattccctaggatagcccatactttaggtcaaaaaacaagtctcaataagtttaagagggctcatatgataaaaaaaaaaattctccaaacacaatgtgatagaattagaaagaataaccaaaaagtttgggaaattcacaaatattggttagtaaaacaatacttctaacaaagtaagagttaaagaagaaatcaaagggaaattagaaaatactttgaatgaaaacaaaataaaacataccaaaatacactggatgcagcaaaatcagtacttagaaagaaatgtatggctataaatgcttacattaaaaaggaaaaataaggaataaggtctcaaatcaataacctcaccctccaccttaagatactagaaaaaggagagcaaactacacctaaagcaaacagaaaggacataataaagactagagggagaataaacaaactagagaacagaaaacaatagagaaaatcaacaaaacaaaaatttgttttttgaaaaggtaaaattggtaatcctttagctagttttgccaaaaaaaaaaagagagaagtctcaaatcactaagataagaaacgaaagaggggctttaactactaactttgtagaaataagattataaaggaatattatgaataatggtatgccaaaaaattaggtaacaattatagaccatatgttaggtcataaagcaagtatcaaaacaactcaaggagaattttaaaattagaataaacttataataattagagaggttaaattaataattaaaaatatttccacaaagaaaagctcaggaagagatggcttcactggtgaaattcaccaaatgtttaaagaagactcttttttaaaatgtcagtccttaacaaactcttaaaaataaaaaaagtggagactgcttcccagctcattctatgagggtagcattgccctgacaccaaaaccaattatatcacaagaaagctatagacccttataaatatagatgcaaaaattctcaaaaatactagtaaactaaatccagcaatatttaaaaaggtatgcacaccatgactgaatggcatttatcccaataatgtaagattggattatcatccaaaaatcaatatatataatatactattttaatagaataaaagacaaaaatcacatgattatctcaataggcaaaaagcatttgacaaaatccaacatgctttcatgccacttaacaaacattcaacaaactagaaatagaagggaacttcctcaaactaataaaaggacacttaacaaaaaatgcacagctaacacagtaatggtaaaagactgaatgttttacttttaacaccaggaatcagacaaggatattggctatttaaccacttctatttaacaatgtactggaggttctagacatgcaatcaggcaagagaaagaaataaaaaggcattcagactgtaaagaaaaaagtaaaattatccctatttgcaggtgataaaatctcatatacagataattttaaggaattcagaaaaaactattataataaacaagttcaacaaggttacaggacataagatcaatatacaaaactcagctgtatttctacacactaacattgaacaaatcaaatttaagaaaataatttcatttacaataatatcaaaaagaaaaaaacaggaataaatgtatcaaaataagtgtaagtcttttacacttaaaactacaaaacattgctgaaagaaattaaagaagatacaaataaaggaaagacaacttatatacaggagttggaatataatcttgttaagattgcaatactctccaaattgattgacagagtcaatgcaatccctaaaataaactcagctactaattttggagagattgacaagttgattctaaaattaatatggacatacaagagacctaaaatagtcaaaatgatcttcaagatgaaaaacaaaaagtcaaaggactcacacttttagattttaaaacttacttcaaagatacagtaaccaagacaatgtgatactggcatgaagacatacagattaatggagtagagttgagagtctcataaacctatatatctatggtcaattgactttccacatgggtggcaagacaaataaattgggaaggaatagtcttttcaacaaatggtgctggaatactggatgtccctgtacaaatgaatgatattggaccccttatctcacaccatgtacaaaaatttaacttaaagtggatcaagggcctagatgcaaaagctaaaataatcagctcttagaagaacacatgggcatatgtattcatgcgcttagattaaacaatcacttcttagatataataccaaaagcacaagtaacaaaaaaattataaattgaatatcaaaatctaaaacttttgtgcttcaatagacaccatcaagaaagtgagaagacaactcagaatgaaggcaaatatacataaatcataaatctgataagggacctgtatacaaagtataccaaaaactccaagactcagcaataaaaagaccattaacacaattgaaaatgataaaggacctgaatagacgtttcctaaataagacatacaaatggccaataatcacatgaaaagatgcataacattgttagccattaggaaaatgcaaatcaaaactacaatgagatgcctctccaaggaactgtaaagtatacttactgcaatgaagaagtacaattatctctatttgcagatgacataattctggaatctcctaagattccaccaaaaaactgttagacctaatatatgaattgagtaaaattgcaggatacaaaatcaacatacaaaaatcagtagcatttttatatacaaataatgacctaactgaagaagacatccagcaaacagtcccatttactatagcataaaatgatactgagaaataactttaaccatggaggtgaaagatctgtacactgaaaactataaatcactgatgaaagaaactgaagaaaatacaaataaatggaaagatatcctatgctcctggattggaagaagtaatattgttaaaatgtccatactacctaaagcatatccagattcagtacaatacctatcaaaattccactggcattcttacagaaacagaaaaaaccatcctaatatttgtataaaaccataaaagaccccaaatagccaaaacaatactgagaaagacaaacaaaattggaggcatcacacttcctgatttcaaattatattacaaagctatagtaataaaacagtaagatattgacataaaaactgacacacaagccagtggaacagaatatagagcccagaaataaatccaaaccatgtatggtcaactaatttatgatgaaagcaccaacaggacacaacaggaaaataatggtctcttaaattaatggttctgggaaaactggatttccaaatgcaaaagaaggatattggaccattatcttacaccatacacaaaaatcaactcaaaatgaaaaagacctaaatataagaccaaaaactataaaattcctagaggataacatagggagaaaagtcctggacaatgccttggtcatgattttttgaatatcacaccaaaagctcagtccacaaaagcaaaagtaaataaatgggactacatcaaatgaaaaagcttctgtacaccaaaggaaacaaccaacaaaatgaaatagcaaactatgtattgggaacaaatatttgcaaactatatatctgacaaggggttaaccattcaaaatttataaagaactcatacaactcaaaagtggaaaaacaaacagcccaatccaaaaatgggcaaaaaatcagaatagacatttctccaatgaagacattaaaatggccaacaggtacatcaaaaggtgctcaacattatcaacatcattaatcatcagggaaatgcaaattaaatccattgtgagatacacctcatacccattagggtggctactatcaaaaagtcaaaagatgacaaatgttggtgaggttgtggagaaaagagaactctttacactgttggtgggaatatagattggtacaactattatagaaaatagtatggggtttctaaaggggttaaaaatacaactaccctatgacccagcaacccctcttctggatacatacttacaagaaatgaaatcaccaccttataaagatatctactttctcatattcattgcagcattattcacaagagcaaacatatggaaacaagtaagtgtctattgattaatgaagggataaagatattgaatattatcaagtggtacatatatataatggaatgttattcattcctaaaaaagaatcagatgttgccatttgccatgacatggataagcctggaggacattacactaggtgctacaggacagacacagaaagaaaaatattgcataatctcatttatatgtggaatctgaaaaaaattcaaatatacagagagaacaaaacagtagttactaggggtagtagtcagtgggaagaaaatagggagatgtaggtcggaggatacaaagtagcagatatgtaggatgaacaagtctagagaaataatgtacatgaggaccctaggtaacacaattgtattgtatgtggaattcatgctaaaggagtacaatttagctgctcttgcaacaaaaacaaagaaatgggcaactgtgagatgacggctatgttaatttgcttcactaaagtaacatttttactatctatatgtattccataacatgttgtataccttaaatatacataataaaacttatttaaaaaagaatttagcaagtagaaaaagtggtagaggagagaaaaatgatggtccaaatatagaagtatttgatgtgaattgtggcagagtttcaaagaaaataaaattacataatacgtgaaaaacaaagagacaaattgcccagcaaggatatggacacatcatgtacttcagaaatggcataaagggagataatcaattatgagatagcactcttcaaaggataaatttttagatccaaaatgatcttaagtaacatgaactatgttttggggtgactaatggatgggataacctatagtgttcttttattatatgcttgttttgtacacacgagggatgccataaacaaaatgagttcccttttgcattactacttaaaagtaatcatacgggtcattttccagtggtcattcacttcttgctactacacaatgcttaggcttagaattctgagcctgaatagcaccctaattgcaaaaagcatggtcattaaaaacaaacaaatcggccaggcacagtagctcacacctgtaattcagcattttgggaggccaaggtgggtggaacacctgaggttaagagttcaagaccagcctggccaacatggcaaaacccaatctctactaaaagtacaaaaattagccaggcttggtggcaggcaccttaattccagctactcaggagggtgaggcaggagaaccacttgaacccaatagacagaggttgccgtgagccgagactgtgccactgtactctagcctgggcaacagagtgagactccatcccctgcatcccccaaaaaaacaaaaaccacaatgaaatgctgtgtcacatccactaaaatggctataactaaaagaaagaaataaaaataaggattgataagcatcaaaatggaaccctcattctttgctggtgcgaatgtaaaatggtatagctactgtagaaaacagtctgacagttggtccaaaagttagacacagagttaccacatgacctagcaaatccacttctaggcctatacccaaaagaaccgaaaatctatgtgtactcaaaaatttgtacatgaatgttctcagcagcattattcttaatagccaaaaaagtagaaacaacatcatcaactgatgaataagaaacatatgatatatccaaacaatggaatattattcatccataaaaaagaatgaaggaataaagtgcatgtacacatgaatgaatagtgaaaacattatgttaagtaaaagaaaccaaacacaaatggtcacatattatataattccatttataagaaatgtccaaaatagacaaatccattgaggcagaaagtagattagcagttgctagggccttggaggagggaagagaggggagtggctgctaatgggtagagtttcttttttggagtgatgaaaatgttctggaagcagacagcaatggtatggttgaacaaccttgtgaatatattaaaaaccactgaattgaacaccttaaaatgttgattttgtggtatatgaattacatctcaagaaaaaaaaacttaaagataagaataattagcataaatatgataattacgctgccaagtaagattaataaaaattgttttggatagttgaacaaatcaagtgatacttattgagtagcctaccaagtgctgtggccatggagatgccctattcacatctccctttaggagaacctcatcaggaagtatagctgattgacacctccatctccacgcctctgggtccaagcctcccctggagctgttccccgtcaatgactgagcgtgatgagggcaggaactgggtcactcccgtgaaagcatgatttctccaactggcaaattctgctcgggacttcccattggccaggcagtgattttttccaaaccacactgtgaccaaagactctttatattcactccttacttgtctctcttcttccacagagcactgtggtcaaatgctctccccatctactgctgatcctgctctctttagctttcacatttgtttctcctgaaaaaccttttgctcatctaatattggcatgtgttctttggagagcagaagtgactcatgaatgtatgtctaagaaggaatatagtacaagacttgaggaatgtagctgaaaggccttagtaggactgaatgtgtctgcatgtgtctctgggattccagggatatattgtattcgcttgtactaaacagatgtataaaagacttacataaacaaactactctccaaggtgcctaattcgaaggataatatatgtatttgagtgaagtagttcttgaaatgcttgggaaataccagtttcatacaatcatggtacttaataataaccaatataggtactgactgaggccacaaacactgcatgggcaaatcagacaaggcctgtaagtctaaagcagtgtttttcacactttgggacactgcaaagtgtaaatcatgaaatcagttttgtgggtcatgacagcagatgttttagttttgtttttctttccttaaaagaatagataagaatataggtgcatagtaaaggtaagtatagtttcataaaatatttgtcttagatgtgtgtgtgtatacttgtgtgtgtatttatatacactacctaggtttggatatttttgtcacggattgcattagaaaagatttgaaagtcatgatctaagggacacacaataaagttggcacagtcagaatttacataaagacatttagtaacattctttaaagtaggaacagaatttctgattcccaaaagcttcaccagggttgcatgcttttgagtgataatgtccaagtggagtgagtcacataaaaccttctggtgcatagaggtgctcctccaggcccagaatcatattcataatctgattaggtactggagatcacctcatgtaacccaggtacatctcagagttataaaatgtgcaatatgggctgggtgaggtggctgacgcctgtaattccagcactttgggaggccaaggtgggcgcatcacgaggtcaagagattgagaccatcctggccaaaatggtgaaaccccatctctactaaaaatacaaaaattagctgggtgtggtggcgggcctgtagtcctagctactcggcaggctgaggcaggagaatcacttaaactcaggaggcagaggttgcagtgagccgagatcaccccactgcactccagcctgggtgacagagcgagactccgtctcaaaaaaaagaaaaacaattgcaatatgattgcagggtacaatcatagtacactccggaataaacaaaatcctcactcatcatacttcgtctctccaggctaatacagtctcttccaagtttattcctgactgtatcattgctgctggacaaagacaaagggtggtaacccagacatctctcgagtcttgctaagagctccttggactaactatagagctcatccagtggtttgcctcactagagctacgtctcatgggagtcaattctccttaaaagaatgataggatttgggccatggtggctggaaatctaaaggaagagtcacagagaagtcaggaatggttgcaaaccattgctagaaggggtaatctgttttgcaaaactagattccacacagatgtgtaaaggaaaagaaaataaaagtcaataaggcattgaaacagaagattcactcttctaacctaaaaaatgcaatgcacaaaactaatgttgagaaaagtcacagggctgtctcatcttaaaatttaaagaaactctaaactctcgtaggtgcttctcaaagttgaggtatatgtactctctgggggaaatcatagatgagctaagggatggaaaagccacaggaaaaacaaagcggctctagggtcatattatgtcattgaatctatgagagcatcgattgtaagatggactgttgttgtcagcccactaaaagaaaaaaatgctatgaggcaatgcattatcacttaaaatattttaatcttattttaaaagatatttcagattcaatataaattctatcatataccattcttgaaggaaaatgtaaaactatacaagttgattatacacaagggaaaataaagaatgtcactcttctgaatcaattctcaattcagagtcgtcagtgttcacagatcttatcctctaagccatcaggatattaatgatgcagcatgtatctttaaaagtgctctgctatcatctccagaaatttcttccaagctgctgacactctcttgtaagttttgaggccgtcacttattgaacttagtagaagataccattggagggtttttagataaaaccaaactcatattccttcctaaagtgatctttccttggtttgttggctgcaattttaagggttgctaatgtccagtcttgccactagaaattttttcactgtgcagatacatgtctaaaaatgcaccaacagctaacatcactttgaaggttaagtaagactcctggccatctttccacatggctgtacaccactcattcatcagctcacctgtcattcatctctatgtgtgtgtatgtgcatgcatgcatgagtgcacacacaaaagataacagcattgagttcaatctcattttcatctgagaatgggttcaaactcacacactaaaattgcattcatttcccatttctgcataacaaattactatacatatagcagcttaaaacaacacctatttattatctcagagggctggaagtcacaagttcatcatgacgtgctggatttgctgctcaggctcttataagaccaaaatcaaggaattgacagagctatattcctctctgaaggctctggggaagaatggagctcattcaggttgttggcagaattcaactccttgcagttgtatgactgaggtccaggtttccttgacatttggccctgtctatatttaaaccagcaacatttgttgaatcctgctcgtgcataacatgtctccgacttttcccttctgttgagccttttcagcttccttttgtgtcctcaactgggagaaggctctgttttaagggttcacatgattacatcagactcacctagacaatccagaataatctccctattttaacatcaattgattagttatcttaattatctctgtaatctctttggcttgtaatgtaacgtgaatatatgacaagtggtgaggatcttgggggtcaacattctgcctcccacacttagtttgatattgttcaaaatgaaatatggtgacaagttttgaccacctgacaccatgcatgacatcacattgaaatgctgtacattttgtcatctatgttctcagtgttaattgttttagcactcttggcattggcaggtatgtcaaaggacacaggttttctcagcatttcctatttgactaaattcctagtttttcctaaatgaattacatgtcactggatgttaagcagtttccaatcagttgaaaatttttgacaaattgatgttccacaccttaataacagtcctgcatcatgcacgagtttagttatatcagcctcttgttttgaaatttatttcacttattataagagctttggcaatttctcctgccttcagttgcataacttgacatgtgttaggtgacccgtgtagatgtatttcagtaaccaaatatagcaccacttcatcttcttgagagtttcttccttcattgttgctttgaaagaacatacagaaatgggaccagttttccaaaaacaaatattttcatcactaatatcaaatttacactccacttcttatttctacgtttttctgcaaaacaataacttttcatttcaatgccagaccacactgtaatctcattggacacacatattaaccagcatttaagtccaatctatgtagtaccaacaacgtacaatacacaattgaacagataacacaaacagctctgaccaagtttgtacatgcacaggcaatagctgtgtcaccaactgtcactaagacatcactggtagtaagataccattctgactttcaacatgttaagtgtgagaaaaagtgccttaaaatcattgagcaactactatgtgccaggcattgtgctctttcagcaattctactgaattttcctggtaatctacttgcaagtaataaacgtaatggctgagaagattagtgccagggccaggctaactgggtttcaaatattgcctctgtaacttactgtgttaccctggacatatttcttaattcttatctgtaatataggaaaaaaacgggataattcatgtgcagtacttagcacatagtaaaactcaaaaatagtgtcatgttgtttctgttgtttttaactgagcttaagagctggctccttttcttcccatatgctcatgaagcaaatacctgtattctcccagttagtgaaaaagtattcattctggaaatagaacctcttttagttctaattccttattgttctaaaatataccagattatctcatcctgccttgagtgtactggttcactaaaggacaggagccatcaatactcatgaccagggaactcggagaaaatacggtgtttaaaaaaggaaaaatgtccacataaaaggtttaacattcaggctacttaacactctgtcctccaccttttcttttgtgcatccctttccctatatgcacttggatctctgtgggttaacatctaacaaaggtttaggaattaaaaggtctgtaaaaaatggggtacactcggggttgtttaggggctaggcaacagactatgacacctgggggagaaagtgagccttcttcccatttctgcacaaatgacccagcctgtcccaggttcgtgaaggtcaccagtgcacctaaggtagtgctggggagctgtggcacagcactggtgaggagtgcagttatgcccgtgggaattccggagtgggcaaggaagcccacatcatagaacgctgctctgtcatggccagagggagaggatttatgggtggtcacttggaagaaatgatgagtcagtagtaaattattattattattattattattattattattattattattattattttaaatcttaggcttggcatggtggttcacgccagcacttttgggaggccaaagcaggaggatcccttgaggccaggaatttgagaccagcctgggcaacacagtgagactcctgtctctacaaaataattttaaaattagccaggtgtggtggcatgcacttgcagtcctagctaattgggaggttgagatgggaggattgcttaagcccaggagttcaaggattacagtgaactatgattgcaccactgcactcttgcctgggcaacagagtgagaccctgtctctaaaaaaagaaatcttagaaactccaggaatacttcaaggatggcttttacaagggactagggttcttatgttacactacataggagaaatgcttaagcagccaaatatataaattataactattaatgtgactctatttatttaaagccatagtctggaggcctggtgaaatctggttatgtttgtattatatttttaacccactcccaccactgttcattgcccttgagatccttgaggacagagactgcttttaatttttaaaaaatctctgtagccctatcacctagcagagaactcagcacagagtaggtactcaatatatgactgttgaaggaaggaataactgcctccaaacaacaaatttagaataaacagatagaagttataggaatataattcaacataaaatgcctttctaactactagaatcccttataaatgcaagaagtctatcatgacatagtgagaatcctgtcactagaggtgttgccagtgataccctggaagaggagcacacttcatggagggagatggattgaatcatttccagctcttgaattgattggtactcattgcatggagaccaacaggagactagctatgacaaagcagtgaaagacactaagcagaagtgatgagtcagcaaaactggttattatttaaaaatggcttcaaggactatctataaaaatcagcaagcctcaaaccagagttcatcagaattgaaataataccctgaaacattgttacaaggagccatagaaattgtcttctaaaaactacactattataactctgactgatgttcagaggactaaagtatctaatagacatcatctatagtgatgatgttaaatgatgaaaggttaaaggaaagatcagactgtgagatcaagctgtgatttttagactcatagcccatttcaatgtcccttccatgtcactggtgaagtaaattctggagtcacttgtcttggttcctttaacttccaataaatgactgaaggaactcagatctacacgaggagaattactggacaatgatggaaaggtcttctgagataaatgaacattctacattaatttaaaagccataaatagaatgatgaataggactatctcataatgtcaaagttcaaaggcacttttcaaatgtctctttaaagaaaacctgacctttctttctgtcttttattatcagaaagtttgccaagagcagtctaggtcttgggtcatttcattttgacatggaagttctctcaggattaaaaataataaaaaaacagaagtatttaactctgaagtgaccatgagaacatgttcagcagtataaaaaataacaatattgaagcattaggacttcaaaagttgtgttttaataactacataaagcttcccctctcatatatgagagatataacttatatgaggtcatgaatagctaaagatatcagcatgaatagagatttttctatcgtatttcatgttgttttataacattctatttaggaaaattgctgagtatactactagtaactttctatgctaaatatcttggttaggtatagattagctggcattaaatatagatgtgaatataaatacatttttatgaatataaaacctcttaccaaagacctctttttcccatttcaatttccattttaaggtattattaacagtcagtaaaattcacccttttttaggtaaatttctccaagttttgacaaatacagttgtataatcaccactgcaagcaagacacagcgtggttccatcacaaccctctacccctttgaagtcaacccctctctccatctcctgtccctggaaatgaactgatttactttctcttcctataattttgatgttttaagaatgtcctgtaaatgaagttatatagtatgtagcaaaggccccttttaaacttcatgcatttgataaaaaataatttactttttatttttacttactggtttctatttcctgaatttaaaggcaataatggatataaaaatcaaattactcttgagtattacatcttgaaataggtaattacccagagggcctttagaacatatagacctttaggacttcacttctgcagtactgaatcagaatctctcagtgtatgttctgagaatttagtttctactaaactttctaagcctgattctgattgacccattagatttgggaaacattaacctgacaggtattcactagatgagatcaacaagcagattttaaatgacgtgtggttatggaatcaaagttcagaggttgggagagtcttatctaagtgaccttgtccttggtggctaccacttgctggttgcagggcctcaaacaagttacttaaacttgatgaaccttggctttctcctttataacatggggggaatgcctacttcaaaagattgtttgggggattaaatgcttataaatcatttagcatactacatggaacacataacagtcaaataatggaggttgctcatattttagtatcaatatcttcatcattgtcatcatcatcatactgccctgagtgctttacgattctttctccatgtctgcattttggttaatttcactattttttaacccttcctctagaggcaaccaaagagaatttttgtagcaacacagctattattcaaggcagtaaaaagctaagagaaattcactgattgcttgcaatcttcacttctaccctgttatagcctcaaagatgccaatgagaacaagaagtgaattactggaaactctctcagtcttttttccaagcggatgttattggccaattatggacaaacaagagggaggaagagaaacaaagagcaaaaataaagtaaaaaattaggctgtctgtacagctaagatacatctaaaattttactttttttattggaagatttagtcaaatatgtgatgtgaaaagaaactgaaactgttggcttaatgaaaacaggtttgctccagtactattccatattaacttacctaaataacttggattcaaagttcaggagtcagcagagtatcttaagatttatttcaaaacattacaaggtggccgggcacagtggttcgcacctgtaatgctagcactttgggaggccaagacgggcagatcacttgaggtcaggagttcgaaaccagcctggccaacatggtgaaacccagtctctactaaaaatacaaaaattagccaggtgtggtggcatgccctggtaatcccagctactcaggtggctgaggcaggagaatcgtttgaacctgggaggcagaggctgcagtgagccaagattgcagtgcttcactctagcctgggtgacagagcgagactccacgttaaaaaacaagacaaacaaacaaacaaaaatttacaaggttcagggaaaagaggaagctaaaggcaacattttaatcctattacaagtactaaaagttggccctaaaaactgattgcaagctagatgtatatgcatttatttatttatttatttatttttattttatttttttgaggcagagtctcgctctgtcacccaggctggagtgcagtggcacaatctcggctcactgcaagctccacctcccaggttcactccattctcctgcctcagcctcccaagtagctgggaccacaggcacccgccaccatgcccggctaatttttttttgtattttgtagtagagacggcatttcaccatgttagccaggatggtctcgatctcctgatctcatgattcgcccgcctcagcctcccaaagtgctgggattacaggctgagccaccgcgcctggccgtatatgcatttatttttaagatatagttttaatttaagccctgaaatacagaagagtcacgatatttggttgtgcttgctaatataaagaactactactatcttctaagaattatgcaatgctgctaacaccaaggacaaaagaacatcaaaagacccatgaaccccacaagccctacctgttctcagcatcagcactgcactttggggacatcaattcaaaggatttggtaaatttcaccacctgtcgcatagaaagataataaatccaggtcaattaaagctttattgccgtttaaaataatgtaataaacattttcatctttataatgattataatacttggagattatagagagatttttaagtggagaaatcccaagacagagtagaagaggagaatcccatcctacatcttgtatcttatttcttacaaagcatacattgtcaaagttttaatacatttcactaaacatgtacatatttttacaattaggtgtacaatgagctatggaggtcaggtaaaggaaaatctcatttgaatacttaaaaagaaaactgttcttttaacaacccaatcaacagcaataagagacccaggtagggacagaacacccctcaaagaagatgccctctgtcaaccccaggctcctgaagttagttcatctttaagcttggctcatcattgttctcaggtgagcttcgtggtaccaccacctaaagggtaaagaggaagccaccttattcaacaatcattcttgtgtggacacttcctctctcacctctccagtgaaagtagcataccagtgcgagagttgaccaaggcttatgttgagggggaatttatggaacagaaaatgtcaatgtagtttttcttattattagctaatattgagtttacactgtaaaccaggccctacagcagaagcttttttgattatttctttattataaatctaaagtagagaattttatactcagtctatagatgaggaaactaacccctaatttttaaaaagacttactcagtttcacacaattaaataaggcaactggcatgaaaggaattctctctgatgctagagtgctagctctttcaacactacaaatgttgagtgagaaatgcactatttctggcccttgtaggggtggacggaaacctttccttctaccctctgaaggtttgctgaaataaactgacaatagacagattaacaggagaacaagcatacaaatttactaatgtgcagaagcacagaagccatataaagtatgagactcaaaggagggccagatggttgaagcttaaatagcatcctctttataggggagacggacgggggatgtaggcaattttgaggggtagaaaaaaatttcagaggaattaaatgagcccaaagaacagacaatgaccagggacaaagtttctctgagctctggaggaggtggcagcaagttaggggtggaacttcactgcaaacaaaggttatctttttttttttttggacaggttctcactctgtcgcacaggctggagtgcagtggcccaatctcggctcattgcagcctccgcctcccgggttcaagtaattctcccacctcagcctcccaagtcgctgggattacaggggcgtgtcatcatgcccagctaatttttgcatttttagtagagacagggtttcaccatgttgaccagggtagtcttgaattcctcaccccagatgaggcacaagccttggcttcccaaagtgctgagattacaggcacgagccaccgcatctggccaaaggttatcttattatgcagataaagtctcccgggtaatctctcagagtgccctcagaagaacagatggaaagtctgtctgggcatggggacattcctcagtcttcctttctgtgatatgcgaataatattctctggttaataaaatttcagggaggggatggaagagagttccatcttgtacttgtgaggaggaacaagaaaaggttagaaagttcttggctctgaggggactcagttccaaggccttttaatttcctttagatcaacgtgctcagtatgccaaggcaccatgctttgaagtctccttttctgagccccaataccctcttttgacaagatataccacatgatagaaaaacaagcccctatagtgaaaggagtccatctgaatgtcatagaatgcttccaaggttgacatttagattttccttagccgtacgcagtcatgcttcaaaggccttttaaattaaccacttacaaggaattgatgagcacctgagaaaatgatttggaaaataggaatagattaaatatttaaaaaagctttatcagtgaggtaatgaactcaagctaggcaaatgcaacattagggaaaaaatagaaaagaagggctcatcacaaagaaaattctgtgtgaccagatgaatgtagggcaatgacaatagctcaactgcaaggaaatacccttgacaactatagaacatatttcatttcatattgtaatatgaattaagcctctacagaatcactcattgtggcaaattttattttccaaagatggtcacaacaatatcttctatcccatattcttctcttccatgtaaccctgccactttcctaccaagtggtaggatctacgtcctctctccttaaatccggtgggcttctgaaagcttcaacaaatagagcatatggaagacatgctacatgccttccaaggttgttgtaaaatgcaacacagcttctgccttgcctgatgaaatatgtgtgcttggagccctcggtcaccatgcaagaagtgcaactaccctcaggccactatgctgaaagggagccaaaccacatagagaggacattttcctgcaaatgagggatttttcacacattataaacaatcctttatgcatgtatcaatgcttacaacatcccagaaggtagattttatcctcattttattgacagcaaattaaggcttagggggttaagtggtttgctggaagccatgcaagcaggaaattgcagaaccgagatttgaaccatgttgttctgattccacagctccagtgatcccacttctcactgctttaataagcaagagcaagtgttattgcagcagcaaattatttggacatgactccttcaaaaccagaataaactctactttatttactaattctacaaatatttattgagtacctcctatatgcccaaatttgagtaaacacagactaaaaagtaacttgaagtaaaacacttggcttggtataagattaatcatattatcaataaactgttaattgtttctgcatttcaaaattgagcaggacatttttttaattcctgatctgataaatgagattaaattctccaatattaataagaatgcttcatttggcctacttcttactattgattagaataatttacagcgtggtaagagtagatgttaatttctgcaaatctgatagcaatacaaataaattttatccaagtaaagatgcaaatgatttctgtgcaggagaaaagaaaagctcaatggttacaattgtattatcctgactggtagtaaccattttaaaaagctaatctagcaatcttatgctggcattctttcagtgcctattttagaaccaactttgccactctgcggtttctctttttgatgagttaaacaaatctttgatacatgcttgctttagatttctgcaagagttaagtttttaactttttgaaaattatctttcaatacaacaaatacgtaccgtcttatgtgtcaggcagtgtagtgtacaatggaattacaaatgtgaaagtaaaagaaaataaaatctctgcagttatggagcttgctttatggtagggagcttaatttgccctggctcctcaaaactagtgctccctggaaaaaataagtgcacttctggtttcacatcttaagaaaacaaatgtgagaaatgtccagagaatgaaagaaaataaagatcttttaaaaatattttttccatctgaggaatagcaactgagggatataagaaatggaataggaaataatagcgtttcaaagccatagaacctgtagatctacagagaatggataagatatatacatctcttaatgaaatgacaggatgtttgaactcttgtaaaagaagttggagaaactactaaaaggaaaaaacacttttttctaaaatgttagaacatcttactccaacataaattacaagctgaaaagaaaaatagggacaaaacttttatttgttttgttttctaaattcatttttaatgtataaggggaaagtcaaggactatgtatcattcaacttcagcattccatagaatgcattagctgtgtcctccagtaaaatggcttatggtgccatgatcaaagtcagacactgtattcatgaaccacgattgaccttgtatgtaggaaagaactgaaccttccctaaagagaggtctggcctttgtccttggctcctgagagataatctctaaacccttgtaatgcctgattaatgtgcaaagagtaacagtgtgatttagaatgggggcttcaagccacaccaacaatatgatttgggtgggagctttgggacacatggtatcagttgaccactggaggaaaggagtcagaggtcagccgcatgggcaggtcaaccctatttttgtgatcaagccccaataaagactctagacactaaggctcaggccccggttggcaaaatttcatgcatcttgtcacacatgatagccaggagacattgacactatccatgactccatgagcagagtccacatgtggaattttcctagactctgccccatgctaatgttaatctgtatgatttcctgtagtaaactgtaactgtgagtgtaacagctttcaatgagttctttgagcccttctagcaaattactgaaacttagcatggtcttgggaactccaaaactcataaatggtgtcaggaatgaggaaagtattgtagactatgttccctaactttacacttatatcataattcttaggttcctgtgtctttagaagaaaaatgaagatactaatcttcattagtgtctttagaagaaaaatgaagatactgatgtttactgatctttggttaaatattgattatccagtgtgtataaagtactggatagcacagggagataccaaagaaataataaataaggtctctaaccttttaagacttaacatttgtgatggttaattggtatgtgtcaacttgactgggctaaggggtgcccagatagctggcaaaacattatttttgggtggtctgtgaagtgtttctggaagagattagcattcgaatcaataaattgagtaaagaagattgtcctgagcaatgtgggtgggcattgtccaatccactgagggctcagatagaaaggaagaggaagggcaaatgtggtctctttgtttgagctaggacatccatttttcccctgtcctcagacactgggactcctgattctctggtctttgaactcagactgaattacatcaccagctttcctggttctctagcttgcagacagtaaactgtgggacttcttagcttccataattatgtgagccaattcctagaataaatatctttatctctatctatctatcatctatctgtctatctatctatctatctatctatctatctatctatctatctatccatctatctatctagtctcctattggttctgtttctcaggagaaccacaactactgcaacattttaaagaagaaaaatttaaagtgcaaggtgagttgacctctgaggttagattcacagccaaattgaccctgagtcatcagattatttggcaaggcaatatacatgtggcattagtccgtgatgaggcagcaagatgaacagttgagaagtaacataattctggagatgtaaattcatctgccagcctctcagtcctcaaaagcaggagtgggcaaaggatggcccatgggccatatctggcctaccacctgtttttattaataaagtttcattgtaacaaagccatacttattaatttaagtattgtctgtgcctgctttctactataacagtagagtgaatagttgcaattgagatcgtgcaggccacaaagcctaaaatatttagtagacagacctttatttttaaaagtttgccaacttctctggtgtagagccatttctaggccagatcagttatttttgctaaattgttaatggctaatgataggttaatgtattaatattcccatgtaatatagctatattcagaaagaggattcttggagacataatcttttaatttgaaacagtattgcaatgatagaaattttaggcaccagggtaagtggtaagagatatactcgaggatatatccccagttggcaggggacagttccactccaattaagcctgttgtccagggacaattattaatagtgcccactttcacgctcacaagtgtctttgaatagcaaattctaggcaggcaggccattggctgctcctcaaagcatcagacaacttatatttttaaaaagaattgaaaatataatgcattcaaagagaaaattgtttatagtcagatacctgggttaaaaaataaaacagcaaaaacggcttaaatatttggatataatttaacgggatatatagaatgacattgcagaaattatgaccaataccaaataggtgaaggcataaataaaatagaatagaatttatgctttattcctgacttggaccaattatataattcttagttttattaattttaaaagtttactatctaaatccaactttgattttattatacatttactaaatgaacatggattaaataaattaatatacacacactaagtaaaaaagagaatcttataagggaaatatcagaagtggtttctaaatcaatgacacaaaacaactggtttcaagcttcctttgctgctgatcagccctgattattgcaccctggggaagggagtgtacctgccaagtgaagtaaacaaaacatctccctgcttgttctttggaaaagctccatggacagaagtctttttgatttggatatttatcaagtgctagttggtctggcttctctctgttcttttaacttaaaaacaagttaaaaaaataaaaactatactcaaatagatattccgggcaccaaaataaaaattatctactaagtaatcatgatttttgttttctaattttctgaatctctatttttctataagaggactactcaaaatggcaaaagaatgaattaaataggccaagtgtggtggctcacacctgtaatgccagcactttgggaagtcaaggtgggtagataactgagatcaggagttcgagaccagcatgaccaacatggtgaaaccccgtctctattaaaaatacaaaaattagccacgcatggtggcatgcacctgtaatcccagctactcagcaggctgaggcaggagaatcgtttgaatctgggaagtggaggctgcagtgagccgagatgcaccactgcactccagcctaagtgacacagcaagactctgtctcaaaaaaaaaaaaaagaaaaagaatgaattaaacaatcatctcttactatgcttcttaataaatctcttacttatgccaatttactctaatcatttattcatgcagtcagcatttatcaaatacttagtgcaccaagcactgctataggctctataaacaccaaggggcacaaaccatatcctatccttgagaaactcacaacacagtacagagaagcaaacagttcacaaatgtttcaccacaatgtatgtccaaaatgctaccagtgcacagaggaaggtgttaaggaagtcttcatgtgaactgtgtgacaagcaggaacgctctaggctgacaagtgggggaagtttcccaggctgagggaacaaatcagttcgttctgggagaaaatagagaactctcaaaagagtttaactgaacataattcaataaaggggcaagctatagaagtgtgggtagggtgaaaagaagcccataaggaatggtgaggcacccaggcactagcaactttggaaagcagttaatactcctaggtctgaggttacacaagagggagggaggggagaagggaagggtgattttgagatcctggaggtgattttgatatccatgtgaagagaagccatggaaagatctagccaccactagaactggtaaacaaggaatgaggaaaataactacacccaatgtctttcactcctctggcccttaaatcttctgctcataccttctatttgtcaaacccaactggcagccagaggacaagaaagcccaagtggtgtggtaagcaaagatcagccctcaagggcactgaggtaaagacagaaagaccaaccataggtagttggggagtggagaggttccagagagtagccagtagagttgacaatgttgaactttacctgagctctgtgctcccccaaaatagtaatgataaagaaatctccctatcactgttccagaattggctatcctcaacagaccactctgccctagcacatttcaaaataagacatttctccatccttcctcatgactcctgtaaggctcatgaatgatgtaggtaactcccttgtctatacgtttctgtgaaaccccatctttttctttgagatgttcaccattaatgagcattctccctattgcaatagccagatgaaatgatcttcattgtctggtgcattttgtctttcactgggactatttgcacaaagatatgcatcttttgtgttaataggctagtacatgcttaggctgaccatggggaggtggggtagaggtgaagtaaaggatagagcaaggctgaggaccagagaggagaaccgcaagttaagttagaagcagaagtgatgggccttgaatgttgggtagtgtgagcattattatacaagcaatagacaactaccaatgttttgaatcataggagaggccagtgcatgtttaaaaagaagcagtaattgaaaagaagagtgccctctttgcaagcaagaaatgagtcaggagaaaaatgtcctagtgagagatcagtaaagacacagtgaagaaggtggtagaaagagtgagaaggaagggctagaaatgatgtttcaaggtagaagcaacagatcatagacacaagtgaatgtagaatagtgagaacgacttagaaactactctacagtttttagcttgagttacttactaaatggtgatggttctattggctaaataggaaatatcagaggtggagaagatttgggatgggatgtaatggagatggacagtggggttaggggttcagtagttgaagattatataaatatatatatgcatacatatgtttatttaacatataaatgattaatgatgtgagttgatttactatattgatatacagttattaataaaatgagttaatatgtatgaacaagtaatatgatacattaatgatgtgagtgtgtgtgtgtgtgtgtgtgtatatatagtactatatatgcacattttttcagttaatataattggccctctttatccatgggttctgcatccacaaccaaatgcaggtcgaaaatacagcattcagggcaatgtgaaacctgcagatacagaaggctgacctttcatatctgtgggttctgcagggctgactgcaggacttgagtgtgcatagattttggtatccatgcgctgtcctggaaccaatacccaacagatactgagggatgactgtgtatataacaataatagtttgggtaatcatcagaggatttttttttaaatactctccactttgcacactagaaaaacacttggagcaaaaatcaaactgaatttaagtgggcttctttatagggagaaggaaaatcaaagaaggaaaggtagggaaatggaaagtaagtgatatagaaagcaaaggctgaggcaatttttgcaactcacttgagaaggagggcactgaattacggactgccccagaacaatcggaggatgctcgccccatctcttccccttgagtgtaggattcaggaagactgtctagttcattggcttaactgtatgtacatttacataaggaccaaggagctaaggaggatataagaaaacaagtgtgcctagctagcttatgcttcacagttttgtaaagaaactccagacactagccaggtatttataagcttagttagaaagtacttcgtagagttcttaacaacgaaatagctgccagccatcaagatgatacatgagaagagaacacttgtaaaaactaggacttgagacagtgccttaggacataagattaaaatgtctacattcactttccttgactacacacaaaaataaatagaaataatagtaaatgcatgagctggaaagaactaagagaagtgataggaattgcttagacaggttcataggatggaataacagtaagcagggaatattcagttcaaggagctaaatagttcctaatgttaacagcagcagccagctatggagcaatctttccttcttcccagtctaatggaaaatgccattgacaaaatcacttaaaatcaatggactgaaacacttaagagaagcaaaagggtgcaaaatattaattttgtcaggagaaagggctagaacagcattcctcatttctatttttggcatccattcagtaaactgaacagtttacacctgagtgcctagcttaaagaccacaaatgcagtttctaaacacagagttaagatcttggtgaatcaaagcttctacaaccagaattaattttttctcccttattcccttcaaatataaaggccataaaacataaatttgcaataagcagtttttttaagtattagaatcacaaaatacaaatagaacttttgttttcaggaattattctaataaaatagaaataaaacttacttttggagggagaaacttttattttcctgaatgatactgttttgttttctaattataaaagtagtgtacagaatgccagtagagatggtgctataagttcatgcttttacacatctgatcttttccaaaaacagagcaaagactgataaaacacagaggaaatcagaaagacatttagagattgaaaggaagagagaagaaaaggagagggaaagggaggagaagggaaaggagggaaaagatctctaaagtcacaagcctgaagacatgtaggcctgctgaactccaagtccagaaacaggctggcagtgatggtcggaatttcagctcctgctggggtgtgggaaacaggtgacccagcttcaccccaagaaactgaaccaagctgcctctagcttggtgtaatattactacatagcaggaaatctgagccaccagaataagtcttggtttttgattaggggtcaggaagctgggcaaactattagacaggtaggaaagagggcaagagagaaagaaagaaagcaatggcataagcaaacaaaaacactctcccatccaaatcagctgcaatcccaaattcaaaaacacataattaatacaaacaactaaatcaacaacctacataattggacaaaaaatactgaagaatctgttaagctaaaaatttgaacacacccataatcagagattgatagatgaagaatagaaaagtattaagaatatagatgacttggacaacatttcattcttgattaacggggtcttaggaaacgtcggctggacaagccgttaaaaaagaaaaaaaaaaaagattttcctcagctgggtgcggtggctcatgcttgtaatcccaacactttgggaggccaaagtggaaggattgcttgagcacagtggtttgagaccagcttgggcaactagtggaacctcatttccacaaaaattagctggatgtggtggtgtgcacctgaagtcctagctacttgagaggctgaggtgggaggatcacttgagcctgggacgtcaaggctgcagtgagctgtgatggtgccactgcactccagcgtaggtgacagagtgaaaccctgtctcaaacaaacaagcaaacaaacaaaaaggattttgctccctgagagaaaagagagggatgtgaaaagaagtttctctttcttctcctggacacagttatgtgtggacgtgctgcctagtgcactataaagggaaaagccagctggtgatggccaaccactgagacaaacagagggcaatggacagagcctgggtccctgatcacatcatctggctgctgcgtcatccccagaaccacctcctggagacttctagtcatgtaagttaataaatgttctcagtgtgaaagccacttgcccttgaatattctgttacctgcaggagtcacccaaattgatccataaattagatacatttcaatcaaaatctatacagagttttcatggaatttgctaagctgctattaaaattttatggaagaatgacaggtcaagaataagcaagccagttttaaaggggaacaacactgaggacttggcctatcagatatcaaaatgcattacaaaattacagaaattcagatagatactggtgcagaaataaacaaatagaccagcaggacaaaattgtgagctcagaaacagacccaggtatatatggaaactataattttgaagtgccactacaaagtggaggcaaaacagttctaagacaattggttatacacatactgctttataccccacacaaaaacattctagatggataaaaaagaccatgcataccaaatggatgtaaaaagatatacaataatgccattatagctaaaggtagataaagatttttataacaaaacccttaaagcaaaaatcaaaaaaggaggttaataaatttgacacattaaaattaaaatattccacaaatatacctgttgagagaggcaatccacaaaaccaagccatgcatgtcaggactttaaggccctagttcagttctcaggattgtatttgcagtgagcaaacctgggagatgaagtaacatctttccacagacaaacatcaggcttgataccactccacagaaaagggatatatttcccaagcacagtgttgtaatacgacctcttctgtaatatgacccagtgcatgtgcatgcccatacccacctgttgcacctgtggaacttggagaacatggggaaccagcaccattgttatggtttacaatataaggtttacatttgtatctacaagtatatgctccactgtttttagccttacttcgatatttaaatacattcaatactcaatacccatcttacttatcccaacttccccactcatcacctgcttggctagatttcaaactctcatacttttcaggaagggcttcttagaactacatttgctgtgctcttctttgtatatttgaaaatatctctctgcaacttgtgtaattgtctatgagtttggctttaaattttggatttaaaattatagggtcacattttctttccctgaggactttgtagatattgcccattgtcctccagcacaggagactgcaactaggtagtctaacatcagaatgaattttcctgcaatagatgctttgatttttttgtgtgtaaatgcccatatgcttttttcaacatctttgaagtctattaacaccaaatgtgtttcagtgctaagcagtcggtatcagttttgcctgaaatggtgtgttccttcagtctgtaaatccaagattgcctttatttcagtaaaatgtcctagtgttataattttgaatgttttttttttcctgttccatttgccatgttctctttagagttgcccagaatacttagtttggacctctgttattctgattccatttttatcattctccttttttaatgctttattattatccattttattttcaattttattatttgtgtgcctaaaagtattttagaagtattatttcttcttgtttttaatctagtattcctttctgtgcagctacatatttttcttctactttttttcaagttctaccaacccagtttcttatcttttatactgcttatcatttattccttaagcttttgtatctctttcttgaacaactttatttttcctgagagatcttattattttttatctcatttcatggaaaactttaagcatttttctggtgtgtgtttttcacttggcttttgttttcacatcccttcctacttctttttttggagtatctttgcatgagcccctgctagtggctctttgttgtgtgttagtgtttaaatgaataatggatggggagggtgaagtcaggggaatgatttagggtggctgcatttgaatttcagtttattgtctttgagtgtgttctcaccaacactgctctgagcagccatttcagcttctgcctggtgagaagtctcctgtgcttactgtaaagtccaatatgacatagatatttttgtgtaatgaattagccttcaaatatcttcatctggccaagataagcagctgcagggtgacttgccatttgtgttcctatttatcctgatacatcaacagccttgtttccaggatgacttgtctgcaactttccttgttccactcaccctggccacaccttctgccaatctatggcagcaaggaggactcaagaaacatccccgagcctgcccaggcacctgctcttactgtttcaagcaagtatacatgacttattttggtgaacattgtgctctacccaagatggctgaagggaagtaacctcactcagccttttattaaatacttcatcttatctaatttctactgaattaagtagccctcccaaccttatatggggtggaagtggagtgatgacttgtggcatggggttatgagaacttcttttgtggattatggagtctgcatgtcttgtcctgggtccagattggtctttaattgctaaaagataaatccatttagcaaatcctctctcctgacaccctgacttttaagtttgttctcttgctaagaggttgactacctgccctttccttccatgagatgataaactcatgactccttctggaagagaagatacaagaaaatatgactcaaaaggagaaaattcaaagctctgtcaatttaatagttgtgaaaatgtaatctcatttatgtacccatgttctgataaaaacagcttctttttatatatgttgtttctcccctttattattcacctaaaattatatcaaagacattgtttctatgaatatagtcatatatcattgttttaaaacactacatagaatttcattaaataaacttctattgatatttgaattatttacattttcactactataggaatgcagtaagtatccttatatactcattttggtctcatctccatccatttccttattctaaattttaagaggaggagttgctgggtgcaaaggttacccctttttcaagttaaaatatattttcagctattcgggaggctggggcaagagaattgcttgaacccgggaggcggaggttgcagtgagccgagatcatgccactgcactccaccctgggcctccagcctgggtgacagagcaagactccatctccaaatatattttaccaaacttatgaccataaaagttatcccaacttaagttcccatatcagtaatgagaaagtcaattttctaatgcccatactcacactggttattataattattttcaagctttaccaatctgatggctgaaaaaatcatagagctgtttgaaagtgcttattctcatcagaattgaatgattgttctaaagagcctttacctacctagtgaataaaacatattaaccagtatttttgcatttgattttttaacattgaatctttgattcttctgaagtttacattggcattacagaaataaggcaaaaagctgggtactcatttttcaatgttataagacggcaaaggattatctagaacagtggtctgtaaacccttgtctgctagtcaaatctgatctactacctatttttgtcaataaagttttattgcaacacagccatgctcattctttatatgtattgtctatgactgcttttgtgttataatgggccaagttgagtagctgcaatagagactgtgtgacttgcaaaccctaaaatatttactctctgggcatttacagaaaaaattgccaatttctgatctaagaaatgtacttagttccttcctctcactggttaatacagataaaagactccagatttagtgaaattacatgttaacttgtacctttctctggtagagatacaagtcattctctccaaaagaaaagataatcttgaagattatagtttatggcttagttttgtctttaaccagtattgtttttaaccttgaaattgtatcttaacattgcccataaacacctaacttttcaagtgctctttggactggttttaacgtcatattggctccctcatacattaatgagtttaaaaaatcttcaacttgcatttattttatatttatatgaatcataattttgccttttataaaattatatttttataggtatgaactagaaatccagcttcttacggtttttttccaaattgccagccatttgcttccaaaacattcatagaataatacatcattctccccatctatctaattgttatatatgtggattgaatacaagataactaattagagaatataatttgcatattgattatagatttaaaagttcacagatacagctatacaaaaaagtaacatattctttttctataactcaactaaatttatctgcttaagcctcaagtctgcttattggcagaagacaaaagagattactccagttaaactcagccacttcaggttttctcagtcatttcagatttagactcatttaatactgaaattttcaccaaggagacatgcacctttctgggtgcttggaggagacatggctggcctgcagtcacctgctcacccagactggcctctgttctgagataagaaggccttgctggccctcagcacagtcattcctaacactggatatgcataaatatccacagcccctccaggactaggtcacaaccctgtcccttcctcatcctgacagccaggcttcttcaggccccagccctcatctgttaatgtctgccaggaaatgggaaaagttgcatttgcctctcatgctcctttgggactctagaaaagctgtcaggctctcactgcctcttactgcctctgacattgtcacctcttttttcctgccatgatgcctgggggaagtttcaactccccccacctgctctccaatgcccaccaccaccactatacggagaattgagtctgggagcaaggttaggaagactgacaacctcacatttattattctcctctccacctctcctcccttagtccaggcaatccaagaatgggatagtctagggcttcatctattctcttttcattctactgttttgttcataattttaggttctgattcattcaagcctttaggaaaaagttttggttttccagaataaccctgctataaattttatattatttatttattcatctatttattgattgattgattttcggaggtgttgtttcactattttgcccaggctgtccttgaactcctgggctcaagcaatcctcctgcctcagcctcctgagtagctgggactgtaggtgcatgctactgtgcaaagccctgctataaattttaaaagcccgttttggaacctaaaaacccatttagctgttcctgtattatgagtaattcctcccctgaagtaacataccacatgcttactgtcaagttggggaggggtgtggacagggggacttcccttaaccccttgatatcaatctttttttcctgaaatttttgttttatgttatgtagataactattggttataacacatctaaaaatggaactagcactttgcataaggaaaagctctttggtgtttatcataaataccaggggcatcagaggtgatgaagactgtctaagaagcatcctgctagtgatatgttcattgataataataaggaaagaaaggtcataagtaatatggaaaaggtataattgtggatttgcttggtaatattgagatcttatatggattcccttattattataaaaatatacctattattgaaatatttccagtaaaaataactttgtcaagtttgaaaatcttctaatacagtagattagaagggtggtcattcttgctaatcttctaacttggactagtttttatggtgtggtctaactctttggcagatgaccaaaaatgtacagatgatggaagttgatattgaatgtgggggcagagataaacagtttcctgtttatcctggcttcttctcctgaatgtggtgggactgtttctagtatcctttctataatttctactgtacaacttgggtggtgcacagaactgtgacacctacaagcctaaaggtttgagaagcctttggtgagaagtgtattaaaggaatgcctagtgttggtaagttttctgctggggatgccacataaatagatacctttaccccaaacttctcccaccacctccacaggcagcagacttgccaaaaagtcttcactgcttctggaataatactgagcagattaatattttttttcacctggttcacttttaacctttagagttcatccgtatggtgttacaggagctcattctcactataaactaaaaataaaatcctactctaactgaacagaccccctcttggccaaggggacccaagaaaaaccttaaaaactgaattcctggccataaatggaaggaaagtcgaatagcctcctcattattcaccctccgttttggagttcatacacagctgagcagcattaatgttcaaatagagatcataagactcacgaaacagactctttgtggcaataatataccaaattataaacaagacctaacaccatgtaaggcaagggttaagtcattcctgcaggccaccaatcttgctacatagcatccttatcttaatttaaaacattcctttctgctgactctaagttctagatagagccttactcctttaatcaactgcaaattaaacaatctccaaacctacctgtaacctgtaagtccctgcttcaagatatcctgcccttcggaccaaaccaatatacaccttccatgtattgatttatgtctttgcctgtaactcctgcctccctaaaatgtataaaaccaaactgtgatccaactaccttgggaccacttattcaaggcttcttctgtttgtattttccctgggccactgtcactcatattggctcagaataagcctgtttacctatataacaaacttgcacatgtatacttgaacttaaaattaaaaaaaaaaaggagtgagtttcatatttcaagagatgcttttttggaggtgctctgagggacttgatgacagagaaaactttcaataataagtctacaaaatacacaaggtaacagaaacaattatccatttaaaaaatgctattctgggccgggtgctgtggctcacacctgcaatactagtactttgggaggccgaggtgggtggatcaactgaggtcaggagttcgagaccagcctggccaacatggcgaaactctgactctactaaaaataacaaaaattagctgggtatcgtggtgggtgcctgttatcccagcaactcaggagactgaggcaggagaattgcttgaacccaggaggtggaggtttcagtgagctgagatcgcgccattgcactccagcctgggggacagggcgagactccacctcaaaaaaaaaaaaaagctattctgcctttaaaaagaataacattttgtaatttcaaacaacatgaattagcttgaaggatgttaagtgaaataagccaggtacagaaagacaaatactggatgatctcacttatttctagaatttaaaaagttgaactcatagaagaaaaaagtagaatggtagttgccagaggctaaaagtaaaagtgagtagacagttgttggtcacagtgtacaagtttcgttagatagaaggactatgtttttgattatacatatacattacaaattatacattaataattatcccacaatatatacatgtatcaaaacatcacactgtataccagaaatacataaaattattatttatcaattaaaatttagaaaattagaatttaaaaaatcaaaaagccaaaacaaaacaaaaataaaatattttatggagtttggtttttccatcaatatcactttggagggggatgggtaagaaaagagaagaaatgatgaggagtggttcagaattttctgccccaacattagtcttagaatgttcagcagtgatagcaaagaggccttttgaactttcagtagaataccagccagcgctgttatcgtttgtaccatctactctatctagatggtgtattttgatcactcctcttcctactttataccatgaagatactgctgtttctactgctccctccagctctgccccaacattctatatcaacttccatcatctatatttttttggtcatttgccaaagagttagaccacaccataaaaattagtcgaagttagaagattagcaagaatgaccacgcttaactggtttaagttgtttttatatctgtttacaagtgagctagcaaacagtgagtttgcctgtgtccagattccagcctgcataccccagaccctcacccccagccacttgctcccacagggaccttggggtggttcaggttatcctggcagccaaagccccaacagttgccccttcctgcctttgtttaatgggggcttctctgtggccctgaaatctgccaggtattaatgagcacccctaccacttcccgttcctttaaggggctttagagtcaggcagtggaggtgactggcaagtcacacaaccttctgagccttatttcctcatctataaaattattataggatgatagtaacacctaccttataagataaggattaaaagaatgcaaatgtttcacaacgtttctggaaacactccataagtatggcctattggagtgtgtgtgtgtgtgcatgttctcccaaggttcagctgagatttatacaatcacaggatactttccaggctattgtttgtgtaaaccgcactgactgaaacagaaataaccccaatctctgctaaaatctggggaaacactcctaaacattttagacatatacagattttaaaagatactcaatattgtaagtcttacaatacttattaaatgtccaaaatttaccctaaggttcctattctttgaggaaaacaaacccaaaggcaaagggaataatcttttctaagtaaagtgtggcaaaataacattctgtcaggtattaaagcaaataattgctacacaattcccgatctttgaagcaagttctcagcaaaaatattaaattgctgccaagggtttagacatttaactttcaagaatttagattgatgatgattattatttcaatattgttgcttatctacccagcagatttccccctgaaagccaaagggcttaacaaaaccagaaagctggccacaaattgccacggtgaggcagccctaaggctctgaacgagatgtttccctatggagcagcaggaacccctgcagggaagtgaacagcagcccccttcacctggtaaggctactttgtgccagaattcgcaggttaacagcagctgtgaaagaacctggaagcctccacaggacaaatctgctgcagggaagggcccagcttcggttggccattccattctgctcgagtccagtttgtctgggctccaagagctaagggtactgaatctccactcatttgtttgcttcctccttgccttaagaagaccatggagcattctctggactgaaatccaccccccgaaatgctgagggccttacccttcataggtaaataaaatgtgagacagacacttgagtttatcttctaatggagctgtgtgaggttgggcaaatcactgaaccccttagttccttcatctgcaattacaaaggcctgggttagatctctaaagtccctgttagcttaaaagtctatgtttctaagttgactgcaaaaagagaatgaaatacacataaagaaaataaaaaacttgtttgatgaaaagttgccccatggttgaagagtcacgaagagtgaatcaagtcacaatttcacaagtttaattataaataaactcaactttattccattcacacagtcttcaactttaaaagataaaagataacttactggtgattcgatgtcctctaggagtaaaacagaacagcgttcacatttcagcagagtttgggcccgatgcattattttcttgacaattttctccaggtcagtctgttcttcaaagaggtcattaaccacctctagcaaagcctagaaaagatgaaatagatgtatataagtggatgtaaaactgaaaaaaagttgcttttcttcttaaaatttaatctttgcttcaataaaatatagtaaatctttttgtgtagctaattttaaaaaattttatgattgttttgacatatttttatctctcaattttagaacacatgcttaaactgcaaaatacaacttgagaatagagctagttcttgtaacaggtgtgaagataagtaattcaaaacctaagctattggaactctagattattttgagtcttaaaggatgctgattataggggtcacttgagaggcaggtgtaaccaaggcagctataacccttgtttctcttgactatagattagccttcttccttaccaaaattgtttggtaaaatgttgaaaattactaatgagcaccagagaataccccttccctcttcactgttgatcttcattacagattaacttccctcttactcttctcacacaaggactccatagccataacattgccttaagatggaatgttaaatatactcttttaaattggaaagaaaatgaaaaccagctatgaagaaaacaagctgtatagaaaagaaaacaaactgtaactaattatattgctataactcatacaccggccttgtatagaaaatgctgaaaccctattaaatttctttactttgtgcctgtagaagcaggagcttaacttttaactttggaacatttaccccatttctctggagtctgtatctcccgaattggccattcccagcttttcacttgaataaactctttaaaactagattctgattattaatatttcagtttgacacagggatcatataaccattagctacaggcatttccacttttctgtagtgatttttctgcaatgcaactaggtacaaacccaatattttggccgggcgcagtggctcatgcctataatcccagcactttgggaggccaaggaaggtggatcacaaagtcaggagtttgagaccagcctggctaatacggtgaaaccccgactctactaaaaatacaaaaaaaatttagccaggcatggtggcatgttcccgtagtcccagctactctggaggctgaggcagaattgcttgaacccagggagcagaggttgcagtgagctgagatcgcgccactgcactccagtctggacaacagagtgagactctttctaaaaaacaaacaaacaaacaataacaacaaaaaaacaaaaccaaaaaacattttataaataatgaatacctccaaagcacatggatttcagaaacttacaaagcagcttttcctcactatcaggaagaaacaggttcttggtcaaacttgagacattttcactaatacacatcccttacataactctgaaagaattagagaggtgaatgctaattaagtttcagattcttaaatatatatatatatatatgtaatttacatttagtctttgctaaatataaatacataaattacatatataatataaatatatataatatatacatacccttcatatatataaaatatatataccctccatatacaaaaatatacatatatacacacatacatatgtaccctccttaattcctctacccaagaggaaatactgctttatcccaaactgtccagaagaacatttagatatttatatatcaggaaagaaaacacattaatttttttttaaaacagcagaatgaaaagcagacaacttagaaaaaaatcttaagctctaacttgaaaactgtgtacttatttaaaaattaaattgtagtaacccgtggttttctctagctaagaaattagctgcaatttttttgcattgaaataatgtttgtttgctcaggtcaggtatggatttgtgaaaaataaaaaataaataataaataatatttgtttggaatttttaatggcatggatgtttccagagatttaagattagtaggttatgtacaggtggtagacattatgcttctctcagagagcaatcagaaaattacatagtcagtgaattgcccagagggcacttgattcaacagaatgtagaaagaggtgcaatctcaagtctgacctctcacaaaaggaattcatgaattgtcaaattcacatctattcatcatggtgctgatcatcatctcagggacatgactaattttcaacttcaataatgaatttgatttgtcctgaaattatttgaaatgtgacaatttcttctctgaatctattcaggtaaaaaagcatttgagtagctgggtgtggtggctcatgccaataatcccagcactttgggaggccaaggcaggcagatcacatgaggccatgagttctagagcagcctgggcaacatggtgaaaccctgtctctactaaaaatacaaaaaaattagccaggtgtggtagtgcatgcctgtagtcccagctactcaggaggctgaggcaggagaatcacttgaacctcggaggcggaagttgcagtgagctgagatcacgccactgcactacagcctggatgacagagtgagactccatctcaaaaaaaaagaaagaaaagaaaagaaaaaaacatgtgaatgagttaagaaatccatgaaatgagtccagttcaatgagcaattgaaagaggaccaaatatcctgggtagggttattgaaaccaccattgcaaaattataactgggctgacctaaccagctccatcttgcttctaatctccaaactgtccttgttcatttctgggcataggctgaactaactttgggaggaacacagtttatagtttattgtttaaaacaaagatgacaatagccctttcccaaacaaacctccttcttccctggggactagaatgccttcgaaggactaacaaattagccacaagatcagaaattatggcttaggagtcatacagctgactcttcctaaactgcttctcagatcagtgcttgagatattttgcagaccccgtacctgatggatcagctggcaccacccagatcgataaattggctcatctgatcttgtgaccccccccatccatgagctaactcagggcaagaggacagtttcaattccctatgatttcatctccaacccaaccaatcagcattccctactcactggccttcccccacccaccaaattatccttaaaaactctgatccagggagactgatttgagtaataataaaactccggtgtctggcacagctgaccctgtgtgaattactctttctcttttgcaattcccctgtcttgagaaatcagctttgtctaggcagcaggcaaagtgaacccactgggtggttacattatctctaaagaaagactgaacagagctaaggaccatattgctccatgatcccaaagcaaacaggaacatcaaaaggtgaaaaaacttttaagtgaatcttgatatttggcatttggacagcaaatctctgtaaggggtcaatgaacaataatttcatgtttagacattaaaaatgagacaattgtctcagtaattacaagcaaaaagccctgttattaatggggaaaacattatttctttaatcatctagactatttcttcagatggatcatattaactgaacaattatttaacttttcaatttgttgtgattgcatggagagagcctctgggatccatatacaagaatatttatctcagaggaaaaattaattgtgccttgagtcttgcactgacaaatcacattacagtaattttattgtttctaatttaaaattgctttattaatgagtgatggaagttttacaaataacaatgcagactagctccaggataggagaaaaagagaagaaaatctaggataatatctgttaggcctctgagcccaagctaagccatgatatcccctgtgacttgcaagtatacatccagatggtctgaagcaactgaagatccacaaaagaagtgaaaatagccttaactgatgacattccaccattgtgatttgttcctgccccaccctaactgatacgatatattctcccccgcccttaagaaggtactttgtaatattctcccccgcccttaagaatgtactttgtatgcctatcccaaacctataagaaacaatgataatcccaccaccctttgctgactcctttttcagactcagcctgcctgcacccaggtgaaataaacagccttgttgctcacacaaagcctgttggtagactctcttcacacggatgtgtgtgacaatatccaattcaacagataatggaagtattttacacagttgaataggccctgcttcttgatgtcacttgccttccaggaaatgagtatctgcattttgtccctccttctagtgaccttcttttgctcctggatgtgtccttggagctttccattctcttatctacatattcttccctaaattaacccagctagattcctggctttaaatagcctttatatgctgctggttcccaaatcttaatctccagtcctgacatcttcccagagctttagactcctgtatccaactgtttacttgccagctgtgccagccaagagtctctttcactcatttcccatatcagcaagcccccacagatttcaccactgattttggaggaaatctgtcacttctcactgccctagtcccagccatattattttttgacttcaatacagttctttcctaagtcctctcactgctccagccttctccctccctccccagccagtttattatctccagggaggccagagtgaactctattaaaagtaagtcagactcagctcaaaatcatctaatggctttccattgcactcagaatgaaagccaaagcccttgccatgcccacaggcttttctaccatctggcctgcctccacgtcctcattttattttttttccctttcactcttcccctttctctctgctctctaaacacactgaccaagctttctcctgccccaggtcctttgtgtttggtattccatggccagaaatgctctccgcagacctttatgtggctttgctccttcttttcattcaagtttctgcttatagatcatgtccttatacagacctttttgataaccctctaaaataaacatcctcccaactcagccttcctcaaccctttatccctttatctcactttatttttccttgcagtatttattgctacctatactatgcaatttaaaaaaattgttttcttatctaatatgtattgttctcatgaatagtaagctccgtaagggtagggatttggatagacagcatgtgaagggaactacataatcaatacttgttgaatgaataaattaattgtgccatacacaagaatgcaaagattaatcatatatgaagcttcacttaaggagttcaaaatgtagttggagaggcgggccctcctcaaatatcataatacagtgtgataagtattcataatagaatagtggcagtagatacaaggcaaaaccataagtgaagaagggaagattaatcagaaagctgagctgggtcctgaagaatgtgtgaggcacatgatgtggttggaaggagttggattgacatgaggcattgaaggccgagggaggaatacggctaaaggtatgatcaaatgaaacagattgtttgctggaaattggggactatattgctggagttccagatgaaagcaggagcacggtaagacatggggctaaagatgaaaagaagatcaaaacagagaaaagatgtggtatgtcatgctaaagaccatggctatattagtcaactatgttcatctgtttactgataaaaatatccataaatcataataattagcaaatgaaattttaatcaacttgatggccagattaattagggtttcaaacctttttgaacatcgttttgttaaatatatttctaagttgttacagtaatcttcctatatttaaaattagaatgagtataatataatttaatctctatttgataatgtagcattttttgagtactagactttgccttttttgcaacttagatctatagctcctgaaggtataaaagagctctctaagtgtttctttataatactgtaaaacagtctttgcattattgttccaagtatctagtgaagggcactttcagaaaccctttcaatccaaaaatggtttcaatccaaaaattgtttcaattcaaaaataaaatctgggaagtgggggtaagatcatgtttgtaacataacttgcttcttaaaggaacttagttgtaaaagcatcaccaaattgtgttattgcttcaaagccataagtaagcaaggatatatctgctgccttatagtatagatgtgatattaatctcctttttttttttttttttgagatggagtctagtctgtcacctaggctggagtgcagtggtgcgatctccactcactgtgacctccgcctcctgggttcaagcaattctcctgcctcagcctcccgagtagctgggactacaggcaccaccaccacgcccggctaatttttgtatttttagtagcgacaaggtttcaccatgttggccaggctggtcttgaactcctgacctcaggtgattcactcaccttggcctcccaaagtgctaggattacaggcttaagccatcgtgcccagccaatttcatttttaaaagaagcttgtaccccttcccccaaataacaacagataatgtgtatccacttccatttgggcttattgcttaaagtgtatcttcaaccacagccttgcagaattatacaaataaaaaagattcctgtactattcaaagatcattcattggctgtttttaaaagacataatgacttacagaaaccagaaagagagttttgaggagtgtcaacaatgtttttatttactcactctgcttctttcatattctttccttgaggcagcaaagagctgagcgttagatatggcgattccacaaaatggaagatacatctgcataacctgggacaaagagagtagtaagaacattaaaacataagaacattgatacatcccttgtagactaaattgcacacttcttctatatgcctgattgtaatactttatttgcatctatagagattgaatacagagagttgttgatactagtattttaacttcattatgaatatttttcaaagttaactaaaatatgttgtaaatcaagctttaactagagaattcacatctatgaagacataaagtgaagcaacagattatgagggctgtgacataggaactgtgtctaaagcagcttgtattatttcttggataaaagaaggataaataagtaaatgaactgtgatatacctggaatttaaggcatgtgcccatactcacatttggaggtaggcaggatataagtcaattctttcgttggcatatggcatataccatatgtatatggcatacaattcacatctgtagcagggatttcagcttgattctagacctatctgctaccagttttaaacatgcctgtcaggatgggcccagtgggaactaggggtcagcaggcctggcagccttctgcgacagagttctaattgtgtctgccactgtgtagacataactggacacaaatcatactggtgggatgcttctgcagaagcctgatgaggaaaggctgggagcctgtaatggagaagtcctcctatgggcagaaacacccagccgtgatgggcctacccctaacaaagactttctcatcatggaggtttaggcatagggatttttactactgccttgcactctcaagaaattcatctccagaatctctgattccagagagatagaatgctccaagtaaaaactgaaagaactatttccctaaattcttcgcaatgtagatgaaacaagtgacatacttgggacttctctaaagcaagagggaaaaaagcatgtttatatcatagactctatgtctctctgtctctctctcacacacacacacacgcacgcacgcacgcacgcacgcacacaatggtgccctaggaagaggtaacaagcgctggcaaaatagagcaattcctgctgtaaccagcagagggcagtgcagtgcccgctgtgggtgagggacgacagcagcctccaccaactcaggaagcacttgtgaagcacccaggacatccagaaaagaatcacctggagtgcaaggcaattatgcagaggacttgaggtacacaaaagatgaagggcaattcacattccctatcgctgaatttcctattaaaatctttccttggttacctgggcatgatcaactctgacctagggtcctggaaagaatttcagagccatataaaaactaaagctatgacctcatttttaaagaagatagagaaacaatgggatccgaattaagaagacatacaaaaatcaatgatttttgcagatgttttggggataaattccttccctggattttcacatgttgccttctggaactagatgttatttctgttaccccctactctcccctttcttgctactccccctcataccttagaaagtctgtccataagccaagataaagctgttggcataaagctgccagatattccattagaatttccctgcctttaggcagaatgggaccactttcaatatcacctacacatagagcaagcactttccttgtagttttctggaggttttgtttttggctcattgtttttttctgccatggagacaatgactataacggggataaaagcaaggaggagacttattttaactttccactacttatttgttttatttatttttgccttcaggggacaaatttaaggtggttggtaagtcaagcaagtaagaggagagtgatcaaatgaagatgtgaaatgttttctaatatatcataggcttgcttcacttcatttgtaattccaatatttactgagttccaggtattatgttaaattaaaaagaatctgaattttaaatcaaataatctttgttctttttacagttttgctgtgtgaagtgcaacaaatcatataagctcttgaacctattttcttatctgtaaatgccaggtttatggtcttttttagttctaatctttggtgattcaaataatgcaaaacatcattaagctgcaatattctatttactagagaaaacagaattcagtaaacatgcttgcaccttattcaagaaaaaataatttataatagtaattgccattggctaagcccttctgtcattgtgtcaggcatgatgctatgtgtcagggatgatgttaagcattgtatatgcattacatctgttttatattcacttatgttttaccattaatcccagtttgcagattagaaaactgaggctttaagaacttacccaaagttcttgggagataattctctatggatattttatgtttctgtacacgtggcagagagaggcactggctgtatctttctggaatgcttatacaatgaacagccttggaagatagagatactgtctcctttcagagcaaagaacagaagtgtttactatccagtataataaagacaatatctccctctagacagaggtcaggcaggctcaccgttcattataaaagatttgggttgcttacatttcaggttcctctgctgtcatgcaatctactatatgtgctattactggggtcagggaaccagcaaaaatgctgatgctcaaactattgctattgttgtgagtaataaactgtttttttgtcactgatccaggagtctcatgtcttctgtcagcatccatgagactgtggcagactaacttgctagcctgcatgtactgtatagtaaaatcagactctttacaaatcttaacaatgtcacctagatagcaaatggagaagcttaatttagaatccaagtggcctaaccctaagatctaccttcttaacttctacattctccagcttcccaaagtcatacatatctttcatacaattaatatgatagtctggttaactgcaatgcaagatagatgactaagactagcactccattattccagtgtatgagcagtcacaggagactgcagaagcaggaagcagttctggtagagcaggcaaaacccagtttccggagataacaaggcaaccattctcagggggcaatttgtctagcagatggtgtaagggaaatcctaggtagagagcagaccacactgataggcatcagagtgtggttatgaaggccagagtagaaagttggggcagaaaagaaactgagcctgtcagcaggtagcagggccctcgcctccaggtggagctttaaggatcagcttatactcttggtagtgaaagggagggaaatggcagaagaaaggaaggggcccatcaggtatgaaatgtgaggcactatgttttaatgagacacagaactgctcacagataggggctgtggcaaagctgggcccacaggtgagggtcctgtggtgtgcgtccagctatagcgtggaaaatgaatcagggaccaggaaccaggctgtgttccacacatggctagagaggttccagtcttagcccagtgggaacactgcagtgtccccggaagcctaggaacagcccaacatcaaactgtcagtcaatcacaaatctcttcatcctcatccaatcttgtttctgttaaacctagtttttaatctaaaaatttagaatttgcaaatactttttccaagtagtataagctattcttcatgaatagtacaatgtactatcaagaaagcatgcaaatcagatcggtattagttcttttcatctaccccactgtgtccgacaaagcacccctcaatttagtcctgacagatgaatggtatttacttgtcacaacctcaggaaaagcaacaccacaatcttcctccattttacacatctagcaaatgtcactttcatgaaattttctcatacaaatgtaacaaactccttatatcacaatatacttccaattcttatcctttagtggagatgaaaaacaacaaaaactctgccattttaagccaattacaaggcatttaacatggcattttgaatggcaaaagagactcctgctgtcttgttttgtgtactccaatttttcaagttaatgctcctataacagcatccaaacaaaagcaaatggcaaaatgaacacccaactcactgtactgggaatgcacagatcagctcaatttaacaagagccgcccgactgccttctcccgtcaggccctgggttaatatgcagcccgtacactaaattgcatgacaccattactattttcaagtttaccactagtttcagctacatccctgagaggattactagccagctcaaattccttcaatattttcacaaaaatacaggctaaagttcaaatttcaactccctgttaaggccttccaaatgttggccctattggacattactactattgttattattaatgtttgtttagatttacccacatgtgtaccagttttttcctcctcattccttccaacacctccttccttctttctgtgatatagttttattttttttccaaagacaatcctttagagtatcttttagcattggtgataaatgcttttagttttgtatgaatatgtttattttataatcaatcttaaaaggtaaggtagttgggtatgcaatcctaggcttacacttattttctctcagtacttaaaacatattattcccttatcaagtgcaactgatgctgctaaaaagccagctgccaatcaaaatcttggtagattatctgcctttgtctccggtttcttttaggtcttctttatgtcattggtagccaatttgtattttgtcagcctcaatcaaaggcttaattgaatcatggtaacctccaatgtatatattggccaaacattactgtggatggagacaatattataccttcatgactcattgcacactgagagagaatctttgttaatgtaggaaatgttctaccctgtgtcattcattggcatgacaattcagccctctggggtcagactcaattgcacaatgtatacgcatatgacagtatgatctatggagtttctaaagaaatgtgcaggagaagcaggcaaatacatttttgaaaagaggcagtaagaaaaactgaagcagtgtagaaatagaaaatgaaaaacaaaatattttaatcttttttttcagtcccagtgttacagatgtctctctctctctgtctctctctctctctctatatatatatatatatacacacacacacatatatatattgctctattctgctattctgctctttctgaagtccctcatttccaaaaaaaccaactaatttggccttcactatgtagtttcagaatgccaaaggtctaaaaagccttaatgactaagaagcaaatgagtctgtacacgcttgtgcagcacttttcggcttgaaagcactttatgaacattggctaattaatctttacaacatcccactcagaaagagagttaaactgaaaatcattaaacagtgtaaaaaagtcactttagccctggaaactcattaaactatcactaatatgcatagaatttgagcactgggccttctatcaatgtacacaaaaaaagacagtaggtagccagccttttcaaacttgcaagccacagagaaaggctattaaagccccattgtgtggtctggtccaattatacatcattgaagaatgccgggggtctacactggagaatcttagtgaagggggccatcccgttcgtggaccctacttgtagaaggcaaaacagcttgaagagccacatcactgtcagctaaatgaacaggtgaaaaaaaggttttcccacctacagataacacctcctccctttgtgtagattctgaaaacaggactcttaaagtcacttctgccctcaggcagtaactatatgataaagcttcactgatttggagcccactgatttggaactggggatgttttaagacagttgtgattcaaatgctgaataaactcttcaagtagagtaatttagaaaataacatatcaaaatatgaaagcagtcacattattttcatacgatgaaatactttcagagcatttttaggaatataatattaaaaataatttttaaatgagtttgcagttttccagagattccagaggaaagccctgcttccagaggtatagcttcattcactgcaattttgtttctacacaaattcaataaagatgaaagatggagcttttattttaagaatcagaatcataaatgacttttgttagttcataccaaaatatatgaccttggctaaggcatgcctttttccaccagtgttccgcccttttcaaagaaaacagtctccaaaagatacaaataaatataaaacattgttttaaaaattgtaatggggccaggcgcggtggcttatgcctgtaatcctagcactttgggaggccgaggcaggtggatcacttaaggtcaggagttccagactagcctgaccaacatggtgaaaccccgtctctaccaaaaatacaaaaattagctggccgtggtggtgtgcacctgtagtcccagctactcaggaggctgaggtaggagaatcacttgaagctgggaggtagaggttgcactgagctgagattgtgccactgcactccagcctgggtgaaagagtgagactccatctccaaaaaaaaaaaaaattgtaatggaatagatgattcaattacatgtcttttgaaattgtccactatgagaattgacattctgaagaatagggtgggggacttcattcacaaaagacaagggagaacaagagggcaaataaaaaagaaggagaagctttgttttttggagacagaaacaaggacaagataatggatcagagatgtggggagggaagcaaggaaagcaaacccaaggtgggctcctcactggtccaaatttggggcagaacacatcctaaagcgtgaatctttacaggctccccttctcctgtctaggcgtcctcatcactcttcttccatgttcccttcttaggacagggaaattgaggtgcttctacttctgtccctgagtattaaagctgggaccccagggaggttggaatgagctcccttccactactctagcccctctcctacaagctagtgttggctaaaatatccccaggaggctatccaggggcagagatgctgaattcagttcctggcaagtagcctagtagcatcaacatctattctctttgactttttagaagctctggtctactgagtgcttgaatcatgcaggtactactcatatcactcaataaccttatttctatttggtcctatgtccacccccacaactttagggaaataaccttctcatgtctgggggcagtttttaattcccaccctcttatttccagaccctcagggaaaaccctgaaggaatctattgcaggacccatgtcctttctaaaataatttttttttctgatcatagatttcaagagaaaaaaaatacccatatttctgccactcaagggtaaccattattaacattttggaatatattcaagttttcttctctctttttcctttcacataaagccaaataggctaatcctatacataatattttatcagcttttttcactttttataactagctattacctattatgaccagtttctatggatgcaaaatatcccattgtatggtgcagaaacataaaatttatagagaaggaaagtagattagtggttgcctgggttagcagcagtaacaggatttgctgtaaatgggcataggggatcttattggtagtgggttctaaaacggatttatggtgatggttgtacctctcataatgttactaaaagtcattgaattgctcacttgaaatgtgtgaattttatgatatataaaatatacctcaagaaagttttaaaaattaccataaatactctgttcatggtatggattaatgtagtttacttagtcaatcatagaacgttggacatttaggttgcttccaattttagattaataattctggggttaaacatcctagaaattaaatctctccgaatcccattattattttcttagagtaaagcgttgatattggaacttactttattcaacacacaacttatatagcgcttttctgtaccgggcaatattctaaatgctttactaatattaattaattgagggttgtgtaccctttaaaataatccttaacaatataaacacatttactttttgctaaaagaaaacagtagagaaatgcatagagtaaagtaatgacagttcccccttaatttcctgtcccactacccactcccttctcaaggtacaaccctgctagcatttgtagtgtgttcttctggatgttttatggctacagtcacacaatatctagttttagggttgtttgtaaacataagtgggatcacactatgttattttcgataccttctttttcacttggcaatatatcttggaaatctttacatgttaattcaaagagaacttacttcattcatcttaatgtctgcagaatattctagggggtggttgtatctgttactagacattgccattgtttctaatttttctttattacaaataatgctgctgtcaactttcttacaaataaatcttcatgcacctggacaatacttctgtttgacagtttcctaaaagtggaattttaaggttgaagaacatatgctcaaaaaatcttaattactactgccaaatcatcctccaaaaaggctctaccaatttatactcccactaacagtaatcagaggattcatttaccccaactcatacaacactgggtattaccattcttttaaaatcttgtctatccgacagataaaatcagtactcatttttgtattaactgacatttacttgattaatagattgaacacttttcataatttgttggttgtctgtattttaaaatatggcctcttttgcttattttgtttattttttagtggacattcatctattacttattgctcagtaagtaccctttatgtgctaagaatattaaacattttccattttcacaattcatgaatcttacttgataatcaaacagtaattgtcatctgtttgatataatccattaggcctacaagctatgagcgctttgtctaagatgaataatattatggctccataaacttggcctactctctctcacagtgtgaagatcttttacaaagatatctgcctatataactctgccaaggttatttttataagcaggttgacctacatatatcatcctgcccatttattccatctgcctttgtaactcacagcttctgcaaaaagttgttttgagctgctgtttgatccaagcattcttgagttttagttattaagatcattatgattccccacttacccagcacaggtataaatgcaggaagctacacaatagagtaacttagtcaaggtgtcaaggtatcaacaccctgaaatgctagaaaaatcttattatatcacaatgaacatacgaacataaaatttcctcttacactattttctgatgagaaatgcctaagtttttctttaaatttgaaatacattcacattatttcctcctattagtagcagaaggcttttcttcactgtctcgtttatcaaactccttcctttttataattcctggttcataaagtacaggacattacataaaggcagaatcatatagcatgtggccttttgtgtctggctgctttcactttgcatgctgttttaagggtccatttatattgaagatatatcagtactttattccttttaaaattttgttttaaagaagtagattttttttagggcagttttaggtttacagaaaagttaagtggaaagtacaaggatttcccatagaccctgcccaacacacagtttcccctattattaacatcttacattagagtggtacatttgttacaactgatgagtcaataccgacacattattaactaaagtctagtctacaaagtctacaataggttcactctttgtgtcacacattattcggattttgacaaatgtacatgttcaccattacagtatcatacagaatagtttattgccctaaaaattccctgtgcttcacctgctaatccctccctccttctccctcagtctctggcaaccactgatctttttattgactctgtagctttgccttttccagaatgtcacatagttggaaccacgcagtatatatccttttcagattggcttcttttacttagcaatatccatttaaggtacctctacataatttcatggcttaatagttcatttctttttatcactgattaacattccattaactggatatacccatgtttgtttatccattcacctattgaagagcatctcaattgctcccaagatttgacaattatgaaaaaagctgctataaacattcatgtgccagtttttgtgtagacataattttttgactcatttggataaatatccaggaatgcaattgctggattgcatggtaagcgtatcgttagctttgcaagaaactgctaagctgtcttccaaagtggctgtgccatcttgcattcccaccctttcctatgtctgggttctccctgtcccttcaaaggaggagtgtttcccttcatttggtattgcttccaccttcactgtgtaatctacatctgcttcgcttcatgtcctcactccctgtcattttgcttacagttttgcagtcttcagaaatggctggcttgtggcctgtctatgacatcccaattacccgaacatgaaatacacctataatacattcttattttctgcagcctttaacacttgatcaccagctagatatgaaactttggcttccatggactatacacccctatttaatctttttctacgtttctgacactcatgttcaagttatattcccgggttcagtctttggtcttctaactgtccctttctacattctccctctaagcatttatttatttctacaatataagaatattacaaaataaagtgggttggctatgcaggaattaacctttgagcaagagtcagaaaagacaacaaattcagtactgccatatatttaaggcagctgagaagtcttcctccttctgctcttgaactttggtctgtcacgaattccctctgcctctgatttcactttcctacatccctaaccccacttctaatcagccacatctgctacctttcagacccacgtttcagtctctaatccagacacagcttgagctctgaaaacatttgcttcctctatcttatagtctaattttagtattcctggtcctagactgaactgaactctgaattcaaccatagtgaccgaacaggcaccaaagtcccttccttctatctgtgtcttctgtagttacctctggaacgattctcaaagtgggctctctagtgctgacattttctctgtgctctggcttcacatcaccaggtgcctagaggacatttcaacttgaaggttctttttattttattttattttattattattttaattatttgtttatttatgagatggagtcttgctctgtcgccagggctggagtgcagtggcacaatctcagctcactgcaagctccgcctcccgggtccaccgccattctcctggctcagcctcccgagtagctgggactacaggtgtctgccaccacgcccggctaattttttttttttttttttttttgtatttttagtagagatggggtttcaccgtattagccaggatggtcttgatctcctgacttcgtgatccacccgcctcagcctcccaaagtgctgggattacaggcgtgagccaccatgcccggccaacttgaaggttcttatactaccacaaactcagcattctgaaaccaagtttatcatctcaattccccttgtccttccaaagaaagagggcttccgcctccaaaaccaccctatatgtgccaaaaaaaaaattaaagttcaaatcacccaattccaaatcctgggagccatcattgattgctatccagatgtaggcataagcaattcaggagcttttgaaacttctgttcccatggccttgatttcccctgctccagcactgccatcactcaccatctctggtaatagttcccagatctctcaccattgctgcaacagtagccaagatcctttcatccttgcaatgtgacaagaacccagtaacctttgtttcccatccaggaaagctataaatttaaacacactgactatccatcccaatgtgctccattgtcttaactttttaaaatgtaaggtataaatatgtcttacacatattaaatactagtctttttcaaactacatttgcgtgagcattttcataccacatacagtatttttaaaaatctcattagaagctcatcagaaagtatctccaatatttaagactgtggcttagcattttacagacactgtggaagatatgtaataatctcaggaaaaataataaggaaatataaaattgctatttagagaaacacatgagacccagaggggattattctacttatatatcttttttttaatttccaaaataattcatcatccaaatgcaacactaatgacatggataataaaccatactattttttaatttccagtaatattctccagtggagtttaaaacagagaaggctatgaaaatatgcttagagcattaatatttaattaatgtaatagtaccctaaaatgaatattataagtgtaaaagccttgatataattcgtaagttgtatctatgcaactaaaacacaaaagtggtacctagtaaattcagggcattcttaatggatagccttgaagacaaaaagagctttaaagtttggcctaacaacaaacaaaactttgtgaagggccaatcatttattaacaaactggggtatcaatccaaaatagcagaggggaaactgtctacatgagtcatcagtaattcagcaagatttctcatttggtatcctagaacagtctaacttacaaactaagatgctagcttcaaagccaaaatactttattgcccctattcacagtttctactttccacccatattcagtctatctgcaacagagtctcagcctgtcctttattgcttcctttctcttcatggttcagctatttattttgagggctcaattacatacaaagtaagcagaaagaataaatgataagcctaaagacagcagaaggaaagaattaattaaaataaaagcagaaaatagtaaatgagaaaacaaccattagaattgataaataaatccagaaatagctcatgtagggaaaagcaataaggcaaataaatcactagctagtttaatcataggggaaaaaccccgaaaatatactaaaacagaagtgatcaaggaaatagagtcacagctacagaagaaaatgaaaagaactataatagacattttttgccataatctcaaacttaaatatttgcaaatctgatgtaaacttgtatattttaagcaaaatataaattaacaaaactgaatcaagttcttcaagaagacctgagaatttctgagtaaaatagtcaccacagaaataataaagaaacttgtaaaagactcattctcagaaaaggggctagtccaaatggcttcataggcaaattctttcaaatcttcaagaacaagaaaattcctatgctattcaaacaattccagaatccagagaaggagactctcaaatattttttgaagacacattatttattactgatagcacatcatgataaaaataatgcaaaaatcaaacctacagaatagatcccttatgaaaacagataagaaacattctaaataaaaatattagaagatttaacatttttttttttttgagacagagtctcgctttgttgcccaggctggagtgcagtggcatgatcatggctcactgcaacctccgcctcccgggttcaagcgattcttctgcctcagcctcttgagtagctgggactataggcgcgcaccaccatgcctggctaattttttgtatttttaacagaggtggggtttcaccatattgaccaggctggtcttgaatttttgacctcgtgatccgcccacctcggcctcccaaagtgttgggattacatatgtgagccactgcgcctggccagaagatttgatatctatacatacctgtatattagaaagttgaatttagccaaatattgaaaaatggaacatgactaagaatttatatttagaataaactgattgttcaatgtttcaagatcaattattccaaactttcatattaacttttaaagcaaaaaaatgatcatcttaatattctaagaggtcatttgataaaatccaatacccaatggctataaaatttttaataagttataatgggtattaaagattttttaatggaaaaacgtgccatatttctcaataaaaagatattgaatcaatattaaaaagatatcaattacctgtccaaattaatctataaattttattctagtgaaacttagaatgatatttttggaatttaaaaaaaaaggtaattctaaaattcaaatgaagtgaaaaatgtttaacaatagtcaatattaaatgaaacgagaaataagaggaaccaattgtaaggttatgatgaccaaaacagaatagtactaaggacagaataatcatgcaacttaaaggaacagaagtccagaacaaaatacataaaataagctcatatgtaagaaaaggatggtttcatcaataaatcgtgttgggacatagttcatcatttggaaaaaagcctaaaaattagaaaatcctttttgaaaaagcccagggaaattaaagatagaataaaaatatataactataaaagccataggggaaatatggtaaacatttacatagttcttcattgtgaaaggcctttccaaccataccctatatgtggaaattatatgagagacttcacactcatttaaaattgaaaacatctatatctcaatatgtaaaataaattaaaaagcaaaacacactgggaaaattatttgcaatgtttatgataattatgaacctctaagtaggaaaaaatcagaaaaaaaaatacctcaaaaatggtcaaaagatataaacaggaagtttgccaaaaagaaacacaaatagctaaaagaagaacaaaaagtgttcaggacactaattatcaaagaaatataaattaaaataacaatgagctatcagatttctcctactatattgacaaatattatcattaaaattaatacccagggccaataataatatgggaaaacaagcattctcatataattattgagggagattcattggtgcaacaattctgaagaacagttttgcaaaatatataaaatgcctttaaaaagtacaggccctttgtctttacaattctattcttagaaatttatttattatttattatcaccattagtactatttattatacttaaaaatagtgaagatggtaaattatataagtatattttgcttcaattaaaaaattgttttgggccaggcgcggtcgctcatgcctgtaatcccagaactttgggaggccaagacaggcgaagcacgaggtcaggagatccagaccatcctggctaacacagtgaaaccctgtctctactaaaaatacaaaaaattagccgggcgtggtggtgggcgcctgtagtcccagctacttgggaggctgaggcaggagaatggtgtgaacccgggaggcagagcttgcagtgagccaagatcgtgccactgcactccagcctgggcgacagagcgagactccatctcaaaaaaaaaaaaaaattgtttcaaaaataactttttttttttttttagtattaggaaagaaatcataatgtacaaggttttttttaaattgacaatatcccaaacatcgcaagatccagaaacgtagcatatttgtattaatttttccaaatttttgacagcatgcttttttattgcctctgcatgtaactataaattttaatattattttcctatagatatacagaaaataattccattttcattagcatattgatacaaatgagctttatattatttatgatgggatgcataatacatacaactttacccagagacacatttcctatttgcactactagtactggtttgtgtcctacaaatgcaggaattccaataaataatattttgcataattctcatctaaaagcaaaaaaaaaaaaagaaaaaaaacatgtttatcatggcatatgctgcatttttgagtatgctcctgataggagagcataaaacttctatttgaataggcatctatgaaaaaccacattttacgagtctgattggaagattttttttccatagactagtttctgacttcgtacatttcaaaccttgtttctccttcactatacatattcttccagacccacatactatagaccaccttcatatcaaaatgcaaccactgaccttgtatatctgcatcaagatgttgagtgaactgggatggtgagcaaaagaatattcagaaaagccgttcctacagcataaagctagcaacaactttccacaaaagggattgggaaccataaaaattatcctactaaactcaaaagtatctacagctggacttcttccctagctacatcccaagaatgtctgtggcctgatgaatggggaaatctgacagacaggaagctggaagggaaaaagaattatctcaaatgaatatcattaaaatatcttacttttgttaactttacaaaactttcctccttctcacgttcctttgcagaatgacttttttcccatctgacttactttttagcattcctcgaggcttgattctgagacttcctatctcactctcctctctttctaaaaaatcttatctacaacactggattaaattgacctctgcatgcatgactctcaagtttatatttctaacccaggttacccccttgagcccaagatctgtgtgtatccaacagcttactcaatattttcacttagatgtctcaaaagcacctcaaatactttatgtccaagacagaactcataattaaacaccctcttgacgagttaatgggtgcagcacaccaacatggcacatgtatacatatgtaacaaacctgcacattgtgtacaggtaccctaaaacttaaagtataataataataaaattaaaaaaagaatatataacaacaacaaaaaataataataataattaaacaccctcaaccacttatttctcttccaagaggagtatatcttagtgaaggcaccatcttgccacaaagggctgaacccaaaaacctggagccatgtcccatacctgacatcactgagtccggctaattttacctgttagttatgtctcaacattgtctgcttcctttaatcatcacttcccactccctcacccccactccaatccaagctacctttctggctgttccatggcttcctattgcttacagggcctacactcaaagcccttcataatctattcccaacacacagtggacttttcttgactcatcttccagcactcttctccctctacatttcttgtattccagtcacaatagattatccatgcccatgtacaactaagttgtatacctctgtctttgttcatcataattccctcattctagaaccttcttgcctactttgtgcatctgtcagactctacttattttacaaggaccagttcaaatatctcaataaaatctttctggacttttcgatttgctctaccattgtctctctgcattctcctcattccaccaaagaaatggcactttatatgcttttatagctctaatgcttttatagctctttgtacatacctctaatgcagtacttttatattaaatatttttaatttattaatttattatttattttcatttaatttttttaaaaaatacagggtcttgctctgctgccaaggctggagtgcagtggcacagtcacagttcatggcagacttgaggtgagaggatcacttgagcctaggagtttcaggttgcaatgggctatgattgtgccactgcactttagcctggatgaaagagcgaggctctgtctctcccccagcaaaaaaaaaaaggagaaagaaaagaaaagaaagtaagtacaggggtagggctagcttcagtaagtgatgaataagaccttgaatgaggtcattaaaattctgacccatcctccttttatctcagctgtccctcactctcattgacctaaattgggtcacgtggtcattgttgacccaatctctgaggccaaagaaaaccaatcctctagtagacttagccagaacttagccatatgcccatgattgagctttgagtagagctttgggctaagaggtggggacaagatagttctccagaggaaaatcaaatcctcctatcaagatgctgaatgtccaagataataaatgtacacaaatataaagttatttgagaaagttataattaaccttcatttcaggcagaattctcagtgttacctcacttatttagatttcataaaatttgaaatctacttctaaaaatattccggaattcttaagaatgttaggctgatgtttctgaacatccagcgcaatacctagcacagagtggtggctcaagcaatatgtgttaaataaataaaagaatcaattaataaataacacagtctgtaagaggtctaagataatgtataaaaatgtcatatataaagacatatattcaccaggtcaagaaacccagatatctgctttactctaaagtgtaatttattatttaatgagtaagcaagtcggacacagcttgtgttggcttaaagaaacatctgtagattttcgccacctccttttttatttttcctttaaaagaaatagttcagaatatgagccatggctttaaattcttgtcttcacttactcaaataaatgtaatatgatcacatatgaacccaaattgtactttggatttatattgatatattatagcatccatggccatgatcaaatcagagcctgacctaagctgacactacagaaatgctgactaccaagtagagttttgcctgagccaaaagcaatgatgcctgtttgtattggtcttaaagggcagaaattttccttacgaatatctctggcagactaactcttgcaagttagtttgattccatgacttctctaacacttattcatggccacgagagctagagaaggccatcactcaaggaatttataagatccagtgtcaaatcatgaagagaaagtgaactccttgatatcagagtcaatattttatttatttttctctccttctaaaacagggcacaatctctggtacaatgcttctcaagaaataattcttgagttgacatacacacatacacacaaatatatatctttatggctttatatgttgattcacattctgccggctgttaagctttctttttttttttttattatactttaagttttagggtacatgtgcacattgtgcaggttagttacatatgtatacatgtgccatgctggtgtgctgcacccactaactcgtcatctagcattaggtatatctcccaatgctatccctcccccctccccctaccccaccacagtccccagagtgtgatattccccttcctgtgtccatgtgatctcattgttcaattcccacctgtgagtgagaatatgcggtgtttggttttttgttcttgcgatagtttactgagaatgatgatttccaatttcatccatgtccctacaaaggacatgaactcatcattttttatggctgcatagtattccatggtgcatatgtgccacattttcttaatccagtctatcattgttggacatttgggttggttccaagtctttgctattgtgaataatgctgcaataaacatacgtgtgcatgtgtctttatagcaccatgatttatagtcctttgggtatatacccagtaatgggaaggctgggtcaaatgttatttctagttctagatccctgaggaatctccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttttggctgcataaatgtcttcttttgagaagtgtctgttcatgtccttcgcccactttttcatggggttgtttgtttttttcttgtaaatttgtttgagttcattgtagattctggatattagcccttaggcacaatcacttaccaaaggaaaacgtggggcagatcttcccatacacacagctaccaagaagcttacaaggcaggcgtgggttggggtagataaaggatcaacttttacattatgcagtcttttcttgtatacaatcttccctattctttgaagaagaaaaccttgaaaaactaaactgtgttcttttaggtcaacatggaagatcaaataaaaaaatgaaatcttttttcttcaggacactcgctggagttttcaggggaacctgagtgttgcagagggggagaatcaggacaaggctagccaacttttctctgcaagtgctaccagcctgggttctgtcacagtcacccaaatctccttcctccatttgaagaaaaataggaaagcagcaaaaattctctctaaatatatatcaacttagcaagataataaagatagtagaaaccaaaacaaataaacaattcctgtcattggaagcattatttgtgtaaattccacattagactcagcactaatcttattttgccaacatctcatagatagccattctcaatatatgctttaagctaatttcagaagtattttttcattgtctaggaaaaaaaagattcttgatttatcatctgtacttctactaaatttttttaaagttaaaaaggaatttatgttttccttcttgatttcatgatactttagggaaagtttatagcaaaatactagcttcagatgttcttatctgtatactcttactgtctcagaaacaaattctatgtctaaaagaatcagcttaaggcactggttcactgatacataactcagtatctcctcaatctttatgttataattcagtagatagaactcaaataagcaagtaagaaattaaggcactgagggcgaacagctctagggagtaaaatatgaagcacacaaataagagatacagcaagtttcagattttaaggtttgaaaggtttgaagaaaggattgcttctcagatatgttccaaagaggagttgataatttcatagtatttcatagctatttattgattttgcttaagtccaaaatgtggtacagataatattttatttattattatctacatttcctggttttttttccttctactcagtctcccactattcagatattttggggcctatgtacttaaaatcctggctcattctgaggacccgaaggcctggatcattctggtaatttttttactccacatctgcaaatcctaatcaatgattacctgcaccatgagaaaaatctcttcactggtctttctgcctccagtgtctccctgctgagatctcctcttctctctgccaccatttactccccagatctgatcatgtagtctctgcttaaatgtccccagcaactccctactgccttcaggtcagggcattcctggaccttcacaatctgactccaacatatattccactctcattttctcttggccttcgcacaagtgaccctgacccacacctatgaagtgaaatataaaaccaaacaatagctctcttcctttcaatcattaatttttaaaaatcaattattgccatgacagctagtcaaacttttcaggtcaacctttgcatttgaaatatattctctttcttggttatttagcattaaatttcaaaaaatttgccttaatgtaaacctgccacttgtcgtacttatgtcaaattagcaaatacttcctaaatgtccaatatccaatatgaatatccagcaccgattttgttctatggaaatgtgaagaggaaagacattcatttcttaactgttgagattataagagaacaaaactctcattacactccaggataccagactgttggttcacattgtcaaaggtgaaactcttccattaggtgcctggtaatgaaagagttaagagtaaagtgtttaacacaggagttccagaaaaacacattttccataaacctttgctgacaatatatcaaatcattggtaaaatgggacaataaaataactgttttagtaacccaatctttgcattagtttgtctacctttgagaaagaaatactaacattaactgctttcataaagcaaaagagtatctcaaatctctgacttattatttaaaatacaataatgccaagttcatcatatattattacagtggattttaaaagaacatagtccggatacggtggctcatgcctgtaatcccagcactttgggaggccgagatgggcagatcacctgaggttgggacttcgagatcagcctgaccaacatggagaaaccccgtctctactaaaaatacaaaattagccagatgtggtggtgcatgcctgtaatcccagctactcgggaggctgaggcaagagaatcgcttgaacctgggaagtggaggttgtggtgagccgagatcgcgccattgcactccagcctgggcaacaagagcgaaactccatctcaaaaaaaaaaaaaaaaaaaaaagccatgagatagaggaaacatcaattggtaaatctcatctaatgaatactcacaaagctttatgacaatcacttgacagaatgtaaagattttacttatgtgattctaagaataaactgtacactttggtaggctgaagtaggaggatcacttgaagccaggagtttgagaacagcctgggccacaaagtgagaccccatctctataaaaaaaattaaagaattagtcaggcatggtggtgcacacctgtagtctcagctattcaggagtctgaagcaggtggaccacttgagcccaggtgttcaaagctgcagtgaactatggtcttgccactgccttctagcctgggtagcagatggtgaccttgtctctaaatacgagaaagagagacagagagagagagaactgtagaaaactaatataagtgcagtatctccagttcctatataagttctgattctgactgaaactgaagaattaactttgtttaaaataacagaatagccaggcacaatggctcatgcctataatctcagcactttggaaagctgaggcaggaggactgcttaaaaaaattctttttttaattatctgggggtggtggcacatgcctgtggtcccagctacttggaagcctgaggtgggaggatcgcttgggtgtgggaggtcaaggttgcagtcagccatgattgtgccactgcactgtagcctgggttacagagaaagaccctgtctcaaaaaaaaataaatacataaaaataacagaatagtctatacataatcttgaagttaggttttcaatatttatgttccttaaagtgaaggtgtttgagaaccttgaaaaagtaaactgtgctcttttaggtcgacatggggggatgattaaaaaaaatgaaatcttttttcttcaaaagacttgctggagtttgcaggggaacttgagtgttgcacaggcgaaaaatccagacaagcctagccaacttttctctgcaagtgctcccagcctgggttctctcacagtcatccaaatctcctaatctcctccctccatttcggatggctcttccctccttcccacaacagcagtgtgcaccagcccacagggtgtaggctcataccctgttttgctcctggcacttcaagaggagttcacactctctggggtttagagaccatattttgagataccacttttttgttagctgagaatctccatttgctgggcaaaatgttcaggaacactgattcaatgtctctaagatcagacctaaacagatatttagtaactgcatgaatcctgagaagggaagactactatactctgagtaactgtatgctataactgtattttaagggctgcatcagtattttaaagcctgctaggatgaacttgaagcttcatccgtacaaggacaagactcttgttccagttcataattcccatgaagtggcttctgtggtctaccttccctttcaacatttggcattttcctgggtttcttttacagttaatctcaattaaattacttcaggaggctgtatgtgggtgaatgtgggggtgtgggaagagagagttaattttgtagttgaataaattccacttagaactttataaagctttccccccaagtctcacatcaagctcacagcacagaaatcatagcccaccatgttgcttttctttcagtctgctcctgtgtgggactctaaagacagcaataggatctgtaaataggtaactgctgtttgagcaataatcctaccattgtataagttatttacttaacaaaccagagttccaggataaatatgattataataaacaaaatacactccctgccaagtaacggcaatgaatcaccatttacaagtttgatagagtaagtgtgggctgttcattttgtcagtatctgtatgtgatttggcagttaatactttagatttctcattgctcaatttaaagcttattcttaattcaattgatcgattaattatgtgaaattcaacagccctctcacaatatcattatatttgtgctgctattcataaagtgactagtgtttctgaagctaatttttctgataaatttgagaaaacagattagaggctgttttacttttaaacaagttccttcagtgcatgtaggagacagactgtgcatgctcataaaatgaaaaggcctgtagccaagcaggcaagcaggtattagcagctgtacaatggctaccttgcaagtaaacaaccatattcaataaaaatacctggatgagttgtaaatgagcttaatacagattagaatagaccaaaaaaaaaaaagtcttggcatgattcccagtatgcatcctagggaagcccagggtaaaggcagaagcagtaatcagagttaaaagtagaatctgaataactactctgagtaacagagaatactgaatagtatagaaaactgaaaaacagcctccatggcccaagcctcttctatctggaaataagattcacagaagagtagaaaggataagaaatctcatcccacaactattcatagggaagctaccacatgcactgtgtaggacagccacggaaatggccaaacacagagaaagtagagacaggcattgactaacacaaggcccagggttgttttgggagccctggacaaatgcaaatgctcatcctgattaacacaccctgaatcccaaagaggatccatgaaccaaccgggacctactaaggatccaaagaggatggtagaatgcttagcctcaactggtctctgaaccttaattagaaaagccccagaactttcatatgcagggagtcttgcactgtggctccttagccaggatcacctccccttgggactcacatagtcacaggctaatccatagatcccacacttttccccaacaagaacatctttttgttatttttttccttatagatactatgttttaaaatctccacctatctggcagtaagccaagattgcgccattgcactccagcctggacaacaagagcgaaactccgtctcaaaaaacaaaacaaaacaaaacaaacaaacaaacaaaaactccacctatctctaattttcttttgttgtcaacgttctattttatttatttttaattgacaaataaaaagtgtacatatttatcatgaacaacatgttgcttcaaaacatatatacattttagcatggctaaactgagctaattaacatatgcattctcccacatatttatcatttctgtcgtgagaacacttaaaatctactctcagcaagtctcaatacattcaaaaaagttgaaatcatgaaaaaccatactcctggactacagtggaataaaaatagaaatcaataccaagaagagctctcaaaaccacacacttacatggaaattaaacaacttgctcttgaatgacttttggataaaagacgcaatcaaggcagaaataaaaataaatctttgaaataaatgaaaacagagacgaacatacccaaatctctgagatgcagcataagcagtgttaagagcaaagtttatagcactaaacgtctacctcaaaaagttagaaagatctcaaattaacgatctgacatcacacctagaggaactaaaaaacaggaacaaactaaccccaaagctagtagaagaaaagaaataactgaagtcagagctgaactgaataaaattgagacccaaaaatccacacaaagaaccaacaaaaccaaaagttggtttttgaaaggataaacaagatcaatagaccactagctagattaacaaaaaaaaaaaaaaaaaaagaaagacccaaatagatccaaataagcaaaatcagaaatgacaaaagtggcattacaactgatcccacagaaatacaaaagatcctcagagatgattacgacacctctatgcacacaaactagaaaatctagaggaaatgaatatattcttggaaacacacaatctctcaagattgaatcaggaagaaattgaaacacaaaacagaccaatatcaatatctgagatagaatcagtaataaaaatcctaccaaccaaataaaatctctggaccatatgaattgaattctaccagatgtacaaagaagagctggtaccaattctactataattagtctaaaaaattgaagaggagggattcttccctaattcattctatgaagccagcatcaccctgataccaaaacctggtaaagacacaatgaaaaaagaaaactacaggacaatatctttgatgaacatagacatgaaaatattcaacaaaattcaacaatacataaaaccaaattcaacagtacatcaagaaattaatttaccataatcaagtaggctttatttctgggatgcaaaattggttcaacatacacaaattaataaatgtgattcaccacataaatggaattaaaaacaaaatcaaaagatcatctcaatagatgaggaaaaagctcttgataaaaatccaacatcccttcatgataaaaaccctcaagaaattaggcattgaaggaatattcttcaaaataataagagccatctatgacaaacccacagccaacatcatactgaacaggcaaaaactggaagcattcctcttgagaactagaataagacaaggatccccactctcaccactcctattcaacatagcactggaggtgctagccagagcaactaggcaagagttaaaaaaaaaaaaaggcatctgaacaggaaaagaagaagtcaaactatctcttttcgctaatgatatgattctatacttagacaatcctaaggactttaccaaaaggctattagaactgataattttagcaaggtttcaggatgtaaaattaatgtacaaaaatcagtagcatttctttacaccaataatgtataagctgagagccaaatcaagaacataatcccatttacaatagccacacacacacacacacacacaaataaaatacctaggaatacatctaaccaaggaggtgaaagatctttacaagaagaactacaaaacactgtttaaaaagatcgtagatgacacaaacaaatggaaaaaaattccatgctcattgattggaataatcaatatcattaaaatggccatattgctcaaagcaatctataggttcaacactatttctatcaaactaccaatgtcatttttcatagaattggaaaaaactaggctaaaattcatatggaaccaaaaaagagcccaaatagccaaagcaatcctaagcaaaaagaacaaagccaggctgggcacagtggctcatacctgtaatcccagcactttgggaggccgaggtgggtggatcacctgaggtcaggagttcgagaccagcttgatcaatatggtgaaaccccatctctactaaaaatacaaaaattagctgggcatgatggcttgcacctatagtctcagctactccagaggctgagacaggagaattgcttgaaccagggaggtggaggttgcagtgagccgagaccacaccactacactccagcctgggtgacagagtgagactccataaaaaataaataaataaataaatagccagtggtattactcaacttcacactatcagactatactacaaggctatagtaatcaaaacagcatgtacaaaaacagacacatagaccaatggaatagaaaggagaatccagaaataaagccacacacctacagtcacctgttgttcaacaacatcaacaaaaataagcaattgtgaaaggactcgttgttcaatgaatggtgttgggatagctggcgagccatgtgcagaagaatcaaactggacccctacctttcaccatatataaacattaactcaagatggattaaagatttaaatgtaaaacttcaaactgtaagaatcccagaagaaaacctaggaaacaccattctgaacactggccttgggaaagaatttatgactaagttttcaaaagcaattacaataacaacaacaaaaaaaattgacaaatgggatcttattaaactatagagcttctgcacaacaaaagaaaccatcaacagagtaaacagaccctacacaatggaaaaaacatttgcaaactatgcatcagacaaaggtctaatatccagaatctaagaggaacataaacaactgaacaagcaaaaaacaaataaccccatttaaaaataggcaaaagacacaaacagacacttctcagaagaagacatacaagtggccaagaaacatgtaaaaaaatgctccacattactaatcatcaaagaaatgcaaatcaaaaccacaatgagataccatctcacagcagtcaaaatggctattactaaaaagtcaaaaaacaacagatattggccaggctgtggaaaaaggagaatgctcatacactgctggtgggaatgtaaattactgtagccactgtggaaagcagtttagagatttctcaaggaacttaaaacagaactacaattcaacccagcaatcccattattgggtatatacccaaaagaaaataaatcattctaccaaaaagacacatgcatttgcatgttcatcacagcactgttcacaatagcaaagcatggattcagcctagatgcccatcaacaatggatctgataaagaaaatgtgatatatatacaccatggactaccatgcagccataaaagagggtgagggcatgtcctttgcagcaacatggatacagctgaaggctattattctaagcaaattaatgcatgttctctcctataaatgggagctaaactttgggtactcatggatgtaaagatagcaacaacagacgctagagattactagaggtggaggggggagtaagggttgagaaactgttgagtactatgctcagtacctgagtgacaggatcatctgtaccccaaacctcagcattttacaatatacccaggtaacaaaactggacatgtacctcctgaatctaaaataaaagtacaaaaaaaaagatattgataaaattcccaccaaaagcacacaaaatatcttgttctatttaatctacatagacttgttctggttaagcatgttgtctctcttagtctttttgaattatgtaattactcatggccctccaccttttaccaacacctcaactcttacccaccactacttaccaccacttctcagactgcgaggggtcaggagttactgtgttggaaattgttgggctaaatagccacgaatttgcaaaggtccagaaaacaagagtagtttagctgcagtgaatgtcattgtgagacatcattttaccatattgatttatatataaaattttcaaggtagtgcttttgcttttaaactgattgcctcaaattgcccccttagtgcaaagttgtatttgttctgaggcatgacacaacaaatcacaggcagtacccaagagaccacacaaaccaactacccctccactccctccacactcaaggtggggcccttgcctcaccctgccagctggaggccatgtcctgagatccttgggggaaggagcaaccagaggcagatctgttggggcaggatgctcaggggcatgccatggaaggagcttgagacttggagccagaagacctaggtttaaggcccagctctgactataacacctaccataaatgcgatgttgagcaaaataattaacatcagccaaaagggagtaatagggatcttagccccagctccctatctccaagagatgtcagaaagaccagaatacctaaggaattggccattcaacacagcaacctgatcagttctcaacctgctccatgatgtgtctgggaacataaaatcactcctcaacacacgttgtctcttctttatataattttgctttattttctcctaaactcttttgggaaattcaatgtcttctaagacatctatgtatttatcttaacctaccgtcttagggaaccacagaaaaagatgggtggaatgttatttgagagagtgagatgttgacagagaggaaaaaggaaagcgcctgttttacttggcagattgaagtgtgaaaaactgagtatcgaaccataataaagaatgttcttttacattttttgttcttgctctcccagaacatattgctaaaattttccatgtctggtctattttgaacttggctgtattttggtatttgtgtgacaatgtcagaattgcagcccatcatttcacattctgcgagtgacaccagatctatttttcattcaggttcaaaaaaaaagctcacattattttcattgtttggaaccaaggccagaaagccacccctgtgctcttgatgtagtttaagcaaagcgtttcacttatcaactgctcacagatcttccctaattgaaaaaatgctgagaagaacaggtctctaaagatttcccatcacagagggtctaccacagataggtggctatttgaaaactgtcttggattggaaatttattaatttatttcaggactttaaaaattaaggaatatggccaggtgcagtggctcacgcctgtaatcccagcactttggtaggccgaagtgtgtggatcacctgaggtcagaagtttaagactagcctggccaacatggtgaaaccctgtctctactaaaagtacaaaaattagctgggtttggttgccagcgcctgtaactccagctactcaggaggctgaggcaggagaatcgcttgaacccaagaggtgggaggttgcagtgagttgaaatcgcactattgcactccagccttggtgacaagagaaggattccatcttaaaaaaaaaaaatttaagggatacttttattaaatatttatattttaatatctttttgatacttctcggagcttcaattttctgaaagtttaggctgctgttgaactgtgtggactagttactatgcccctaaaatatttgtgaggcatctctttacacatttcaacagaagaacgttgtacgtgcttttacagcactctaattagagtgatcatacatcacagtttgggagtgacctggcttctgcctgttgaaccacctccttttgctcacagttggatgatacactatatggtcactctacctctaatgcacttagttataaatgtcaaccctgggggagacatgaaagacacacaactgattaaaaacagaaatttcataataaattgaaagcttttttttttttttttttgatggagtcttgcactgtcacctgggctggagtgcaatggtgcaatctcggctcactacaacccctgcctcctgggttcatgcgattctcctgcctcagcctcctaagtagttgggaccacaggcacacaccaccacacccaactaattttttgtattttcagcagagacggggtttcactatgttggccagactggtctcaaactcctgacctcgtgatctgccagtctcgccctttcaaagtgctggaattacaggcgtgagccaccgcgtccaggcctcttggcaagaagatatgactcttttcttgtgaaatctactttctaagttgatttaaatttactttctctcttttctttccaaaaacctacaatgggaagagcaagaacactttaactttgccttgatctccaaggtgaatagaagatcctgtataccccagacaggatgcagattcatctgtcactcaatacaaggggcacttccaggaaagtttctctttttccaagaaatagagaaaaaggctatagatttattttctgaagaggagcctcaaccagccaaaagacactgacataaacactaggtgcaatgcaaaagacaaaaggacatatcatatgaagacaggcagaaattggtaactgtgagtattaccaatatttttctttgacctccaacctcagggattaatagataaggagttactaggagaagctaaaaattttagagtgaaaaaggaaagaatgacaattaggataaaaggaaggatgtaggagtgaaagggaaggttggaagggaggagggaagagtgctagcagctgggtttggagttgttaaatatgtttaagagacagagtttaggggacatgctgcttaggatgcctccaaaagtagtggcagaaatatgagcttagggtttcttaaaagggaaaagacttatcatcacacatggaaactccacagtaaggaggtagggttaggtgattcagattccaaaggctcttcaaggacgtccatccatccctctgctctgccatgcctaccagtctaaaggtgtgtggtgcaccagcaggctggcttgcttccatcaggttccagcagaagcagttctgtttcttctcctgtgtcttctttctaattagtgagaaccatcctcctcagaagcttctcggcagcctcctcacatcccattgacctggctggaactgcatttcctacttatgcttacacaattccctggcaaggaaaataagaccaccagatagcctagacccaccataattcacccacctgtggctcagaattaggttcccctacctgggaacccatcgtagtgaggtgtagtgtagattcctattaaaaagaaagaagaggaataaagggtgtttggtatgtgtgattgctgaattgttttcccccacaaaaccagtatgttgaagttcctaaccagcaccccaataccacataatataatcagggctggtctttaaagtggtaattaacataaaatgaagtcacatgagtgaactctaatccaatatgactggtgtccttagaagaagagaagattaggacacagacaggtacagaaggaaaacaatgtgaagacacaggaacaagatggccagtggcacaccaaggagacaggccttagaagcaacaaccatgctgacaccttgatggtggacatctagcctctagaaccgtgaggaaatacatttctgttgtttaagccattttagtctctggtattttgttattccagccctagcaaacttgcataacatgcaaccaggaacttctataattgaagaaatcggagctgggaaaggatttttaagatgttttgctaggctaaacattgtttatcaacaactgctaacattacaaaaggagagccaagcagacattatatatctcctggcagaggcatactacactacaactaataaagccatattaccaaaagaagaaaggaaggaaaaaaggaagaaaggaaggaaggagggagggcggaaggagggagagagtgaggaagggaggaaggaaggagggagagagggagggaaggagggaaggaagaaggaagggaggaggaagggaggaagaaaggaaggagggagggagagaggaaggaagaaagaagggagagagggaggagggaaggagggagggagggaagggagggagggaggaaggaaggaaggaaggaaggaaggaaggaaggaaggaaggaaggaaggtaggttgactccgaatttaaccaagacactagatccaactaccaatttacagaaatagatagttacagagaaaaatgttagctactggaatgcaatcagcaaaatccatattgtgggaagcattacagggcaaatattcttggattgagggactgtctaggacatgagactttcagtgctaacacaggaaaagtcctaggcaaaccaggacaagttgggcatgttagccttctctttaacagacaaatcacaagagaaaaaaagagagaacaaaggaatctatactttaaaaatatttaacgatgtatcagccaatcataagtggaccttgttctgaacaaataaacttataaaattttatgaagcaattaaattatcgttaatttttaatgcaaaaatagtttttcaattttttttaaaagagtgaatccttctgttttagagatatataacttaaatatttgtggataaagttgaatgacgtttgaaatttgcttcacgataacatgggaggaggaggaggaatgggtaggagtggagatgaaataggatcgtccagaagtgaatggttgtacaactgggggatgggtttactatactattttatctaatctgcacaggatgaagctttccataatttttcttaaaacagtatcttttaaagattttttttcaatatattaagaatacattctccaatttggttttttcttcagaggttgagtatctaaatcaacctatttgttgttgggttatgtttttttgaagacatccaggccaaaaggcagccctgatgatatttggaattatatttgaaaaagtacatgaaatgataatcaggatttaatagagtcctgagaactgattctattttatttattccagcatagctgaactaagaaggtaggatttcagcagcttcttgaaggaaggatgcaagtcctatttataataatttgccttcctatttgtccattgcactcctagctaataccattatcaatttcatttagaaaacatatattctggtaatttttaaaatacaagcaattcactttgcaaataataggaatcaagaaatcaccctgaagtgtgttctgcatggtattaatagctgtcatgggataagggctctgtcaaataaatttaaaaatcactaaattaaacaaaatctgggaaaatacttttcattccctgcacttgaatatataccgtgagtctcttagtaggacatcgtttaccctctatcttgcagtctagaagaaatggtgcttcatgatgcacatgctgggaagcactgacttgttttcaagtttacatatttcttagtcaaatcaaagctttacatgaccatatttcagaccagaccaatctggactcaatatctaaataaagagaatatgtagtaaaaattaacaccagttgggagaaggttagggctcttaatcttctccacaactcccagctgaactccaggtaatgaaagcgcctttctcagctttcctgccagcactcgttcaatccctgctgcaagctgaaaaccgtgctaggtgttttgaatagagtatctcatttaatcctcacggcaatcttctgatttaggtattactaactcattttgacagactaggaaactgtggcttgaagacatcaggcagcttgccctaaactttccacctagtaagtgtagaagctgagattccaccaagttcaatactttactttcttctaactcgcatgaggacccctttatcagttaaattcctcaatccccaaaccctaaccccctccacccttccacatcttttccacctatccttttcctgatgcaagtgtttgtatagcagcatggcaatttttcctggattgattcaggtgtagagattccaattttttcccaaaataccgagtaccctgaatcactattattgccccacctgacagggtaatttaaaaagcaccttaaagcacatttcaatctctctacaaagagatctggaatacagaatgcttcaccagtccaggcaaacggggttctggaattacctttatttgacctgattacaccagctgccctctccttcctcccctctccccatgctgccatggttattttggtgcacacggattggagatagggaaaagtaacatgttctactttaaggaaggaaattgttggccatagtcaggactcagaagatgcagggacagaacgtggagtgttgcagaatctccaaacatttctccctgtggcagaagccctggataactttgtagctgcaattctagaggatattttggcatatgatttacaggctcaggcagcataaatggaccttaaatatcatctagtccatctagttgagataagctcagggaatttcagtgacaaaagcagggtcactgtggctacggagcaggacttcatactcccattccagtccttctgtaatgagggccttcctttcccatattaattattttctacaagaaatgctattgctttaaacatgttcatctacattagccttgtaatataatagctatgaacacaggctttgcagccagattgctgaggttgggaccctggcttcatcattccctcattttatgaccttggacaaacttcttaacctctctgaatctcagttccctggttgtaaaattggggtaataatagattctacctaatagacctgttgtgaaaatgaaatgagattaaccatgtaaggcatttaaaacaggacctggcacctaacaagtgcccagcaaatgttagctattattccttacaccatccattgaaaccattattttttaaaattatttttttttttttgagacagagttttgatcttgttgcccaggctggagtgcaatggcgtgatctcggctcaccgcaacctctgccttccagattcaagtgattctcctgcctcagcctcccaagtagctgggattacaggcatgtgccaccacgcccagctaattttgtatttttagaagagatggggtttcaccatgttggtcaggcttgtgtcgaacttccaacctcaggtgatccacccgcctcggcctctcaaagtgctgggatttataggaatgagccaccgcacccggctaaattttttaattgttgtaaaaaaaacacataacataaaatttaccatcttaaccatttttaagtctctagttcagtagtctaagtatattcacattgttgtacaacagacctttagaacttttatctcttgcaaaactgaaactttatacccattaaacaaccccctatttccccctcctcccagcccctggcaaccatccttttactttctgtttctatgaattcaactactttagatacctcatgtaaatggagtcatacaatattgttcttttggtgactgtcttatttcacttagcataatgccctcaaggccattcatgtcgtagcatgtaacaggatttcttccctttttaaagctgaaaaatattccattgtaggtgtacaataccacaatattgtttttccatttatccaccaatggccacttagattgcttctacctcttggctattgtgaataatgctgccataaacatgggtgtacaaatatctcttcaagaccctgcatttaattctttgaatatatatccaaaagtgagattgctggattatacggtagttctacttttaattttttaaagaaatgccatactgttttccagagcaggtgcaccattttacagtcccactagtacttcacaagggttccaaatttctccatatccctactaacatttggtcttttcttttttctttgtttttgatagttgccatcctcgtgggtgcgacatgatatctcattgtggtttgaattttcattcctttaatgataaatgatgttgagcatctttccacatatgcttcttagacatttgtatatcatctttggagaaatgttgtctaagtcctttgcccatttttaaatcatgttagtttttgttattgttgggttttgcaaattctttatatagtctggatattaactccttatcagatatataatttgcaggtattttcttctgttctatatgttgccttttcattctattcattgtgttctttgacacccagaagtttttgagtgtgatatagacccagtctatttttccctttgttgcctatgcttttgacgtcatattcaaaaaaccactgccaaattcagtgtaacgaaactttccccctatgattcctactaggttttatggttttgggtcttacacttaggtctttaatccattttgggttaagttttgtgtaaggtgtaaaataaggccttagcctcattctttgcatgtcgatgttcagttttcccagcacaacttattgatggagccacttttaaatgtcctttacacattcagaagttaatgttgagtttgtttgttttaatgtgtgtttacagtatgctgtcaaacgttctgaaaaaaatgatcagagcatgggactttctttgtcatttctgaggttatttgcatgatttattctggaatctacaggaaagaagactgtatggtaatgtgaaagcaggcttctagtctatgaaggatgaaaataaagacctggacccatcttttccttccatcctctagaaagagacaagaggaaaggtattttaccttagggcaggagaaattttggattagaggatatggaaaatataaccaaaataaccaaaaaccaaataaccaataatcaaaatataaccaaaagaaagttctgtcaatgtgtaactggtaaagtgttctgaaacagccttcatcattgatctttgcaacagatagggtgccctctaactgagttatataacaaggtggaactacactaaggattcttgcttatgtgaatttacttttcaagactctgcttaaaaagctgatggaaatttaggttgcttcacattctttgctatacccaacaattagaaaatgaacagttttattagatctctgcattgcttgatctgttacacaatcacttctataaatatatctctactttaaaatcttaattttagaagttcctcagctacgactaccaggtacctcggcttcctccctcctccgagagaccgccgaggtgcgggctgtgagagagggagcgtggagcctccgaggccgaggactcggtcccagtttggacagatagaagatgcgagcgctctccctctccctctccctctccctctccctctccgtctccctctccctctccccacggtctccctctcatgtggagccaaagctggactgtactgctgccatcttggctcactgcaacctccctgcctgattctcctgcctcagcctgctgagtgcctgccattgcaggcacgcgccgccacgcctgactggttttggtggagacggggtttcgctgtgttggcccggccggtctccagcccctaaccgcgagtgatccgccagccttggcctcccgaggtgccgggattgcagagggagtctcgttcactcagtgctcaatggtgcccaggctggagtgcagtggcgtggtctcggctcactacaacctacacctcccagccgcctgccttggcctcccagagtgctgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagtgcctctgccccgccgccccatctgggatgtgaggaggcctctgcccggccgagaccccgtctgggaggtgaggagggtctctgcccagccgccccgtctgagaagtgaggagaccctctgcctggcaaccaccccgtctgaaaagtgaggagcccctccgcccggcagccgccccgtctgggaggtgaggagcctctccgcccggcagccaccccatctgggaggtgaggagcgtctccgcccggcagccaccccgtccgggagggaggtggggggggtcagccccccgcccggccagctgccccatccgggagggaggtggggggtcagcccccccgcccggccagccgtgccatccgggagggaggtgggggggtcagccccccgcctggccagccgtgccgtccgggagggaggtgggggggtcagccccctgcccggccagccgccccgtccgggaggtgaggggtgcctctgcccgcccgcccctactgggaagtgaggagcccctcagcccggccagccaccccgtccaggagggagatggggggtcagcccccccacccggccagccgccccgtccgggagggaggtgggggggtcagccccccgcctggccagccgccccgtccgggatggaggtgggggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgccccgtccgggagggaggtgggggggtcagccccccgcccggccagccgccccgtccgggagggaggtggggggggtcagcccccctgcccggccagccgccccgtccgggaggtgaggggcgcctctgcccagccgcccctactgggaagtgaggagcccctctgcccggccagccgccccgtccgggagggaggtgggggggtcagccccccgcccggccagccgccccgtcccgggaaggaggtggggggggtcagcccccccgcccggccagccgccccgtccgggaggtgaggggcgcctctgcccggccgcccctactgggaagtgaggagcccctctgcccggccagccgccccgtccgggagggaggtgggggggtcagccccccgcccggccagccgccccgtccgggagggaggtggggggggtcagccccccgcccggccagccgccccgtccgggagggaggtggggggggtcagccccccgcccggccagccgccccgtctgggagggaggtgggggggtcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccagccgccccgtccgggagggaggtgggggggtcagccccccgcccggccagccgccccgtccgggaaggaggtggggggggtcagccccccgcccggccagccgccccgtccgggaggtgaggggcgcctctgcccggccgcccctactgggaagtgaggagcccctctgcccggccagccgccccgtccggaagggagggaggtgggggggtcagccccctgcccggccggcgccccgtccgggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtgggcaaaagattgagaaatcggatggttgccgtgtctgtgtagaaggaagtagacatgggagacttttcattttgttctgcactaggaaaaattcttctgccttgggatcctgttgatctgtgaccttgcccccaaccctgtgctctctgaaacatgtgctgtgtccactcagcgttgaatggattaagggcggtgcaagatgtgctttgttaaacagatgcttgaaggcagcatgctcgttaagagtcatcaccaatccctgatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaataaaaaaataaaaaaaaaataaaataaaatcttaattttaattttacattaaaaagaaaagcaacatgtattcattacaaatttgaaaaacacagaaaagcatgaggaagaaagttaaagccacccacccttcagcgatagccctccatccagagatagcctttctcaatattttcttttgtttccttcatatatgtatatagatcatgatagatggtaggcaggtaggtaggtaattgtatgtgtgcacgaccttttttttttaacagagtcaaaataatactatgtgcatgtgtgtatatgtatacactacgttttcatttaatataacatgaaaatccttttgtgttattttaaattctttgaaaacatgatttaacatctgaattgggatatatagtttatatgcttattctcttactattttctagaaattttccaattttttgatttcataaaacactgtgatccttgaaacttagtatctgtttgcatccatgattattgccttcaagccaaaccttagaagtagaatttttggatcagagatgaagaaaactttaagaatcttaatatacctgtcgaattcttttctagaaaaataacactttttctaatttatactcctatgtacaatatataaaagctccatcccagctggtcttctcaaactctagatagaaaaatgataggtagaaaatagtatctgtttatttttcattaactttcacttctgaaagttgaacatttttcttatatatgttaatcaactaaatttctttgccaattttctgcttatttttctactgatttaaattgtttaaaaaattaataacaggctgagtgcagtggcttgtgcctataatctcaacactttgggaggctgaagcaggaggattgcttgagtccaggagtttagaatcagcctgggcaacacagtgagacactatctctacaaaaaataaaattcaaacactagccaaaagtggtggcacatgcctgtagtccttgttacttgagaggctgaggtaggggggattgcttgagcccaggagttcaaggctgcagtgagctatgattgcaacattgcattccagcctgggtgacagagtgacatcttgtctctgaaaaaaataatttaataataaaacttgattatatatattaccaaaagtcttaatctttttgcatggcatatggagatctttctggggtttgtttgtatttaaaatgtttaatcacaagatataaactaatataaaacatcttaaaaagacaggaaaaatattctagtgctcatcctacacacacagtatttgacaaggtgccgtactctttaagaatgccaaatttcagtctcattcctgccccattctagagctaaaatcagtcatcctaaacaaattttgtgattgccatttatactggtgagttatagaagtgatctgttacacaatcacttctataaatacatctctagtttaaaatctttattttaattttacattaaaaagaaaagcaacatgtactcattacaaatttgagaaacacagaaaagcatgaagaagaaagttaaagtcacccacacttactgaagtgtggtgatagccctccatccagagatagcctttctcaatattttcttttgtttccttcatatacgtatatagatccatcccagctggtcttatttgagtaggcatctggattaaccagacctgttgagccagggggaattcagagcttctccagcctgcttcctgctctattataaaatggaggtgatcataataataatacttctcacatcatgtgttgtgagaaataaatgtgataaaacatgtgatgtgcataatgtagtgcttgccatatagtacttaatacctaatgacaatgatcctgtatctgtaatgacttgattaatatgactcccactaagggcctaacctagcctcatcacagcactcaaaggaaggagctgttgggtaactgggaagtctgcattattcaaagacagtagagtcatttcagattgacaatgagagctttcacagcttttctactatcattcttatagggcgtgatgcaaatacaaataaatatcttagttgcctttgacagtggaatctaggtctcctttattttatattcctcttttcatattaattctggaatagcaggaaaaataaagataatgctctttgttgagaacatgatataacagtttgtgtataacttaaagtactgatactgtagatacgtgatctacgtgattcaaacttacaataatgttgcattcaaagaaccacgtttcaacagctactttcttctgacactatctccaaattacaaaagcaattttatttcttaattacatagcttgggaatcctagtagtaactcttaacaatactttcctactttctgttctctccttcccattttttttttgcaccttttccagactctccagagctcaatttgctagagttccccaggaatgtcttgccttcactctttcttacctcttgttttagctctccttcttctttacctttataactcacttttgcttagttatttctctcatcttctgctacctgggttctgcccatctctgtctatgctttagtcttcatcctcaaagtctggtatctggtctaaaaatgacaaaatctccctgaagtcacagggcagcgtacatctaagtaggcatgaccaggctattatcctcagtattaatagtctagcctaggagagaatgaggggcagagattttcaggatggggagaaatgggaagaaaaggatatggggagttgtgacatccatgtcaataccatgttaataatgcttcgtccttctcacgcctgtaatcccagcactttgggaggccgagttgggcagatcacaaggtcaggagatcgagaccatcctggctaacacggtgaaaccccgtctttattaaaaatacaaaacattagccgagcgccatggcaggcgccgatagtcccagctacttgggacgctgaggcaggagaatggcatgaacccgggaggcggagcttgcagtgagctgagatagcggcactgcattccaagatagtgccattgcactccggcctgggcaaaagagtgagactccgtctcaaaaaaaaaagaaaattgttaagtctgtagggtaggtattaatattctgtttttacagatgaagaaactgtgatatagacaattaacattattgatatatgcaaacacaactaatattttaccaattcaagtctgtgtaactttcctgttgtgaatcttttatgttagatagaaatgttcctctgagctaagtgtaaacaagtgttacttaaaaaaaagtatgaacagaaataaaatgagaagtcttatacaaaagtgaaggaaagaagaatgatatttataaggagccaggtgtccctatggtctaactgaactactaatttcaacttgggcaattttagttgcctggctaagtacatgaggctttaatagctggattctagtgaaagtttattatgacagtatcttcttgatcactgaatatgagaatgtcttaaatttaataagtgttttccataacttatcaatggaattcaatgacacaaaatgttgagaaagatagtttatatttttttcaggtgttgttattgtcaagacagtgaagaatctaaaatcctaccccacttgaaatcatctagttagcttgtcataattttatggatggtgacagaaggcatgagattcctgggtcagagacaaagaactttacttcttagagtaatagtggtaatgagagtatcagcatttgtgaaggttttctgagactcaatcccaaagggcaatgcaagtgggatatgtgacacctgttcatgcaatgggcagtgctatgggggaggaattctgagcattatggaagagcccaactcttctataatgggcagtaagcttacctgacagtaaaccccagaggaagatattatcttcatcgtacttggcagaaacaaacttgccttttcctcagagagaagtattatctttatcttccaaggttattttctttgcaaacattcttagaggattgtttaggggaaaaaaaggcaatttttaaaaaatactttaagttctagggtacatgtgcacaacgtgcaggtttgttacataggtgtacatgtgccatgttggtttgctgcacccatcaacctgtcatttacattaggtatttccatatgaagatctttcttaactcacctcctgccacttctcactacctaaacttcctcatttatagtttgttcccaccatattaaatgtcttgccattacatgacaaagtagactcttttatgactgtttattccatgccctctatttagaaggccattcttccactttccacctaagagactcctacttatattccaaggattaagtatcccttcctggaacagacttctgttatttttgcttgatagcatccattccactttcttccagtaattgcactttgatttctctttgggaattacccttccctcattgcatacagttttgattgcactgtaaatcaaagtgcctcccctgtcttatctaagtggtaggcatgtggcccacaccggattttctcttgtgaatcttgagggaggcaacacaaggacagaaaacatttggagtcaattcatcctatagtaactccccctaggaactgtcctttagtttctgatacctagatgctcagaactcagcagtttgggtactttctgaggcctggttcagctttctttcttttattctttttctgtcagaaacccatatccttccaggaaactgatccctctttattttctttcttttggcttgttatcttgaagaggttgctgttacttgtaactgaacaggtgatattaataacttacattcttgcttcttgcagcccttttcaactctctcagaggtctctgccatctttctgtggttcgcccccactctgtacattgcacttacactatattatagttattagttttctatttcccctctcatatgtgattccctgacaggcaattactgcttttcctggaatgcctaacacagaacctgagacattttagacagtcataaatgtgggcttaatttaaaatgattattaagcttcacaactcaaccatcatttgtcttcctgaaaagcaggaaaatatttcagatttgttgccaaacctctgtgagtatgttagtttggcttaaattaaaagcaaagtccatcaaagccacggaaatgaaataggcaggtaactcatgaactcaggtgtagaaattttataagatagaaaaatgtgaaacaacagacaagggcctagctgtcacaaaactataatctccatcagaaacaaacaaacaaataaaaattccaagaatgatgctgaagcacattagaaagaagggcaactttatcacagagcttcctggtgaggttcctacaattaaaaaagccaatgtaaagattaaaggcataaacataatctgcatgcatttttcattccaaatagaaaatcactttcatcataatatattcacaaagaaaaactgagaaatcccttagccagaaggaaagaaaagtgaatatcataatgttttaaagaaaagtgaatatcctgtttttaagaaaagttaatatcatacaagttacattatatctttctgaaaatttattttctccagactgagaaagcattatgactaaagcatagatactaggaaaataatcagttccaatttttttcattaatgttgagtacaagctgctacttcaaaaatatcttcatcagatttaaattattctgtaactccattccctatttcccatctcctaaaatgatgttaatttatcattctcaggaatgcattctcatcatcttagaggaaattgtaattaaataaacccttggtgagttcatccctgaggtgaacatgaggtgagtacaaatccttctaattcccatggaaattcccaaaagtgagaagataagtgcccagattgccagagatctcctttagaaaaggatagttcgcaaactaaggttatttttcggaaaactgcttgcaaaatcgaataatgctagagtaccaaatagaaaaatctgaatatgtaattgggcatcaatttgcaaatatgccttagtggaaagctttacaaatggaaactttatcatgggatttcacttcctttacttggtgaaaggcatactagtgactgtatattatttcccatctagaatgctctttcctattctctttgaaatcctgaatcctacagattcttatgtgttctggtctataatgcttccctgtttcctttgaaatcctcaatcctacagattcttatgtgttcttagccttgtaaaatgtcagaggctgttcattctataactccactatcagccaagtacttctaatgggggggaaatgttacttacaattaacttctttagttatagcacaattactcatttccatcattcttacagcatatcaagtatcctccataaaagagcccaagagagaggtccttttcaggtttattgtatttgaaaagtcactcgtaatataaaaatcagaaagcttttctgagatggactggtaattagagcagcagacaaaatgctggaagattcaatagttcttgaagtcagttccagatttggacagcttctttgtacatcagcctccatttgacaaaatgaagaaagacagaacagcagtgcacatatataatgatatttcaatagaaaaagggatttcattgcccagggggaagagaatcaagtgccccttagttaatgcaagacacacgattccccagtaaggccattctggaatttatcaaaaacattgctctgtgcaaatggttcttaacctggctacactttaaaattacccagggagagttaaaacaaagtaaaacccagtaaacctggtctccacccccaggggatctgagaatctgattcaattggtctggggtgggatgaatctaatatgcagccagggttgaggagctctgtcatagggaatcaaagtaatcaaaatgatagttaaggcacaaaactcacattatggagacatttatttttaattaccctaaagcatgcaagacatatgagtactaaaaaagcaatattctcctaacctaccacatcaggaccagtggagcataattcaatttttgggaattagaaagctgcttccaaaaattcctggtctctgtgatcaattctctagtcaatttgattctttttattaaaacaatgggaaaggcttattgatgttttctcttagatttttcccgggtaggaataataattctgtaactacaagagtcatccaattccatgttttaatgagaagcatggtggtatttatggttttatagcctggaatggctaacttgtttgtttgtttcctgagaatttaatgaaagctgagtatgtgtatacatatataattttatgtagaatttcagtgggttcacaaatcacccacaattccctgagagttcacagatcccaggttaagaagtcctgctttgcagacttctccataagttactggtcatgagtgataaaagatgaaaaggagaaagggcaataaatgaagctagaggtatagcagttaggacctggaaattcccaaagtattctaggacagtgcttcccaattaatgtgtctaagagacattgaagagctggttaaacagccagtaggtctgcaatggcctgagattctgcatttctaacaaggggctggtccacaaaagaacaaagctggaggcatcacgctacctgacttcaaactatactacaaggctacagtaaccaaaacagcatggtactggtatcaaaacagagatatagaccaatggaacagaacagagccctcagaaataatgccacatatctacaactatctgatctttgacaaacctgagaaaaacaagcaatggggaaaggattccctatttaataaatggtgctgggaaaactggctagacatatgtagaaagctgaaactggatcccttccttaaaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcatggcgacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacacatttacaagaaaaaaacaaacaaccccatcaaaaagtgggcgaaggatatgaacagacacttctcaaaagaagatatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacatttttacactgttggtgggactgtaaactagttcaaccattgtggaagtcagtgtggtgattcctcagggatctagaactagaaataccatttgacccagccatcccattactgggtatatacccaaaggattataaatcatgctgctctaaagacacatgcacacgtatgtttattgcggcactattcacaatagcaaagacttggaaccaacctaaatgtccaacaacgatagactggattaagaaaatgtggcacatatacatcatggaatactatgcagccataaaaaatgatgagttcatgtcttttgtagggacatggatggaactggaaaccatcattctcagcaaactatcgcaaggacaaaaaaccaaacaccgcatgttctcgctcataggtgggaattgaacaatgagaacacatggacacaggaaggggaacatcacacactggggactgttgtggggtgggggagggatagcatttagagatatacctaatgtaaatgacgagttaatgggtgcagcacgccaacatggcacatgtatacatatgtaacaaacctgcacattgtgtacgtgtaccctaaaacttaaagtataataataataaaataaaaaaaaagaaaagagcaaaaaaacaaaaaaaaacaaacaaggggctggtccatagatcagactttcagtagcaagatacttaaaattatgtcatcaactgcactggcttctcgtagcacaagagaacataaatgtacaaatatttccacttttcttgaaaactcaatactgtatataatatatgctattttttcccaacaaaaaaggataaagaagatggcaaacttaattctttattttcaatggtctcagaacttccatggttagaactgttaaattcagtagtgtttcttttcattgaaccaaacattatcaattcaatggaagtaatttttttaaatcctaaaaacaacaacacaaaacaaaacaaaaaacttcccctgggtaatgttgctcaggaagaaatgaaatcccattatgtagtacattgtgatttttaaaccatttttgtctggaaaacaattacacttcaaacccagttgtgaacctgaaaccagcttttctaaaccagaaaataaaacagagcccattgagctatgtgattctccaggttattagagataagagatggaggccctctctcttgtcacactcaaaggtgccagagggttggctgctcacagccacctttgggttttagttacaataattctttcttttaaatagtattctttttatgattataaaagtaataagaataataaacaagagcaatacatgttattgttttaaaatctagaaagtcttcaaagatgtaaagaatacaaaaatacctgtaactccaaaactatttgttgaagaccacctatacattgctctatcctttacctttgtttttccaatgccttttttttgagacggagtctcttgctgttgcccaggctggagtgcagtggcgcaatcttggctcactgcaacctcccctcccaggttcaagctattcccctgcttcagcctcccaagtagctggtgcgcgcaaccatgccctgctaatttttgtatttttagtagacacggggtttcatcatgttggctaggctggtcttcaactcctaacctcaggtgatccacctgcctcggcctcccaaggtgctgcaattacaggtgtgagccaccgtgcccggcctcaatgcattttaaaaaataaatagaatcctctagtacataaagtattgcagcatgtttttttctcctcagtacataaaaggatgtaaaaggatttggtaaatgaccttgacggagaaatgtttgtgagcagcacaaggccatcccaagaatagtgcaagccctttgtgaaacttcttgcattttatctctgctttgagtgtttgtgcaattttatttaactgttgaacaagtatattttattttggatgtggaaagaaaattcagactaacaaatctatacctacaaatggaaataagataaggctgagaggggtaagttattcccttgtaaccttaaagagacaatcatggaatatcattcttgcatacactgggattaattaatctccctcttttggtttctgcactatgaaggaagtacagagaatggctatcaaaagagaaatgctaaaacctcaaggtgaatttcaccagaatcaagccttaaggaacggacataattccttaaactgagcaactctcagagctgggtttagtagagaaaagtgctatttttttcctgcctctccatataattccagagttagagattaatagtaacagcaaactgaaagaaactgagaaaaataactaaaggtttgtctccttaaatttatgaaataaaaggagaaaaaatactgaattaatagattgactaattgaacaaaatttattgagccccttttacattccaggtactgtgctaattattggaaataagaaattcccatgaagataaggttgctgttctccagtagcttacatgccatagtggaggaggtagagatgggcaataaacaagtaaatgaataactacgctgctataagaaaagagtaacttgaaggtcaacggactaatttggaaaagatctcccagggaaggggtattgagtgaaaagaagaagctgatctggaaaccagagccaagaagaggaatgaagacatgtaacaaccctaagactagaatgagcttggtatgagtcaggaacagaaaaatccctatggctggagagtattgaacatgatggaaagaagacggaaaggtgtctcaaaggaagacaggcctagatgatgcaggacctcggaagccagggctgagaatttggatacagtgccaaaagtgcccgtggcagttttttatgcataaaagtgccatgatctgatttacagttttaaagtatctctctggctaccctaaagagaatacatagtcatggagcactagtggaatcaggaggacccaataggaggctataccaatagtccagacaagaaatgagggtggcttggatcatgatcaggatggtaactgtataaacagagagaaagcagagactgtgatatattttaagctaacagggacttgctgatgaattgattaatttgagtagtgagaaaaagatttcagggttgaacaattgggggaatggtgtggtcctttattggaataggaaaggctttggagaaaataggttgcaaagaggcctaaaatttgatatatcaatcggatatccaaaactcaaatcaagtagagttggatttagataaggaagcaaggagttacaggtttattaagtattggtgagaaggttatatattatatttctttaaattttactccaattgtaatgccttcaaaattttcggtattagaaatactggttaatgtttatgattagaataaataattatactatccttttaataaagtaacaataaaattcatactctttttttcctaagtagctaagcattaatcccagcttacacagcaatgtccttgcttactgatacataactaaaggtttagaattagcccagcacctcctggcaggattgatgagcaatcactgtcattattttttttttatctctggaccacttaggaaatttccccgtcgcttaaagtttccattatctttttcatcattattttagagtttcaaagtgtcaccagagaatgatataaaaataaattaaagcggactttaatttaaaaccctaattgtagtagagacgggggcccaaagttctccttttcatccacctagaagacagaagacaatttgaaaatagttccactttgataccattgtgtatcaaagaagaagctaaaggtaccattttgaaactcattgggaatgaaaaaatttcaactacatcgtagaattaataatggttttcattatttatgagtattttttgaaattgaatttcattataaaacattagagtcatttcatgtctacttttttatagccaaacttgtatgtaaacatacttcagaataaacttaggagaactactcccaggttgctaaaaatgcccaggctgcccacacgagagaattaaagcaaactatatagaatggaatttgagattttccatagtcttatataattgtctaaaacagaaaagctgccaagtcaagaagaaaaaaaaatgaagcacatgaaaacaaatctaatataacacattaatcacaactcttgtacatgtacaacatagctatttagagaaaataggtctgccctaaggaaaactattgaaagttatcttgggctgcccagcatcccatatttaatattagtctagtcttgccctagacatgacccctttatatggatccatacatatcctaatgttgcctcccgactggttggtctttcaggtcacaagttgatgcagaaccaccgtcagtggtaaagaagatgtcaatcttagatagcaaatgcttcagtaattacagtattgagactgtcatgctaagagacatatatgtgatccagacggcttttcagaaccttcctgatcattcctccaggatgctgcccccaaatggagtaaaatgcttcctcttacaaacagcaggaagagtccaggtttctcagcccaacattcaatgtcctgtgtaattttcctctctccagttgatagcttcagaccttcctcccatcttctcctacacagaacctctactccaaactctttctctgtcccagaagagaatgtgaattttggcctccaggtttttttttttaatcggtgagaatctcacctaaggcatgaagctcacccttctctctgcccagtctcaagtcttcatggagcctgccctgacaccccagcctgctgagacctttccttctctagtatagaggctgtatcgctggcaacatgccttgttacaaataactgtatgacatttctttcatccgtctccaaaatctcagtattcacatacccttcactattttttcccatattcacatactacctgttacgttttggtctttattactttcttgaaaccaattcccacatttttacttacatttaattttatagaaatttttagatcatgaccataatggaaagtcaatacatactacctgttatgttttggtctttattattttcttgaagccaattcccacatttttacttacatttaattttataggaaattttagatcatgaccataatggaaagccaataacattttacataaattgaagataattgtaaaatataaccattaatataaaaatgtttgtctatgtaggccgggcatagtgattcatgcctgtaatcccagccctttgggaggccgaggttagaagttcaagaccagcctggccaaatgatgagaccacatctctactaacacaaaaattagctgagtgtggtggcatgcacctgtaatttcagctactcgggaggctgaggcatgagaattgcttgatcccgggaggcagaagttgcagtgagccaagatcacactactgcactccagcctgggtgacagagtgagacactgtctcaaaaaaaaaaaaaaaaaaaaaaaaaagtttgtctatgcctactacctaaaattatctcacatatctcagtttgggaaatgctactttatgttgtcatctcatattgcaatttaagccttgcatcatgtaagttattatgtgtgtatatctatttccctgaatataccataacttcctaaagaaggtcatatattatacttcacattccacagtgtttttagtccagtgtgttgcacttggtaggcattaaataaatatttgttcagtaaataaatgtccacaaatgtatcaatatccctagtcacagtttgtagttatacaatcggtaaaatgaaaatactcaaacttaataagcccatttaattatataatgaatttatatagtatactatcatggatataaaatatattataaataaaggaaaacatcgctattaatagtaacagtgttaatcacatgagattctggattttaaaattttaaagtgatagctctagattttatgaaagtaataagcaggaatagatccaatagttaactgatgtgccttgctttagacaaacccaatagatcaaaatccaagcatacatgaaagatgaattagggtcagataagttacactgcaaaataaatttagagtagaggccatttgaacagcaaatcctaacaacattttaaatgcagcttgactcctatttcaggaacatatttattagacaaattaaagtgtgcattatcataaaaatgaacacaagtaaactcagggggagataataaaaagctaaagaaaaaaaatctcaaaaaaaatctcataaattttctgatttgaactggaggtttggttaatactgtatccaaatgcatttttttaaaaaatattctgaactgttatttcccgaagatcaaagttttaattttcaaaagaaaagttgcgaagaagaatttttaagacaaagtaaatagagaaactagttggggtggtgggaattattccagatccctgtgccttctgtaggaaaaataaataaaatctggcagtcagtaggctttctgtatctatgtcctttaactatttcaaacagagaaaaataagaaactaaaatctactgcttccaaatgattaaatatcttccactaaatttataaaggttcctactcagacaattttttcactcattccctcaaaacaccaatatttctgtatcttcaggatgagctctatacggattccagaggaaacatcaaccagaaacagacctgagtgtgtgctagtgtaacccagcattccacatacccccaaatatgcattatgatatggtgacctacactcctccatggagaattatgagatatcagagcaggagcagatctttaaaggttcctactataattcctttgaatatgaaaaatgactccaaggaaaagttattttcccaacttacaaagataaactcaagtccagtggagtgaatagatccactcttgcctgcacctagccacagttcagcttcccaagtactactctcccctggtccacctgcaaggtgagaaagtagatccagagaaacacccaacccattctttccctattctctgcttctctcttgaaatctgtctgcagaaatatgatatctgaaaatagcttttatcctaaagcacaagtatagggcaaatttccagagagtatctagaaagccacaaataaaacttgaggatggggcacggtggctgcttgagaactggagtcattttgtaacccaagctggagatgtttccagtggcctccaccatccagctgcaccccttcagactgggttaggtacaggggaagtactctgctttactctgccatggcatgccctccactgaactgtcatcgtgagtggattctgcaagggaggccctgagtcttacccatcttcttatctccagtgcctagcacaatgcctggtatagagaagatcctcaataatggctgtttttaaaaattactgtatattatttaatttctattattttccaggtgatacatataaataacttgaaaaagtcaaataatcaacaggatttattttatttctgttttgtttgtttggtttttttttttattgagacagggtcttgctctgtcacagaggctggagtgcagtggcgccatctcagctcagtgcaacctcaagttttatttttaaaagaagtgttatcttctatccaccaatccctcaattatataatacacatatctatttctccgagttaatcatattaaacttttagctatttagttgattatgtatttactacttaactctatttctattttttttctttccaacttttattttaggttcagggggtacatgtgcaggtttgttacatgggtaaattgcatgttgcaggggtttgttgtaccggttatttaatcacccaggtaatgagcatagtgcctgataggtagttttttgatcttcaccctcttccaacccttcaccctcaaataggctctagcgtctattgttcccttctttgtgtccatatgttctcaatgtttagcttctacttaaaagtgggaacatgtggtatttggttttctgttcctgtgttaatttgcttaggataatagactccagctccatccatgttgctgcaaaggacacaatctcatgttttttaaggctgcatcgtattccatggtgtatatccatgtccatcactgatggacatttaagttgattctgtatctttgttgttgtgactagtgctgcgatgaacgtgcatgtatatgtgtctttatggtagaatgatttctattcctttgggtatatacccagtaatggggttgcagggtcaaatgatagttctgttttaagctctttgagaaacctccaaactgctttccataatggctgaactaatttacattcccaccagcagtgtataagtgttcccttttctctacaacctcacaagcatctgttattttttgatgttttaataggagccattctgagtggtgtgagatggtaacacattgtggttttgatttgcatttctaatgattagtgttgctgagcttttttcacatgcttgctggccgtatgtatgtcttcttttgagaagtgtctgttcatctcctctgctcattttttaatggcattgtttgctttttgcttgctaatttgtttaagttccttaaagattctggatgttaggcctttgtcagatgcataatttgcaaatattttctcccatcctgtaggttgtctgtttactctgttgatagtttcttttgctgtggagaagctccttaattagttcccatttgtcaatttttccgttgcaattgcttttggagtcttggtcataaaatctttgtcaggatctatgtccggaatagtgtttcctaggttttcttctagggttttatagttttaagttttacatttaactttttaatccatcttgagttgatttttatatatggtgaaatgaaggggtccagtttcattcttctgcatatggttagccagttatcccagcaccatttattgaatagacagtcctttctccattgcctgttcttgtcaactttgtcgaagatcagatagttgtaggtgtgtggctttatttctgggttctctaacctgttccattggtttatttgtttatttttgtatcagtaccatgctgttttggttatgcagccttgtcatatagattaaagtcaggtagtgtgaggcctccagctttattctttttgcttagtattgcttcagttatttgggctcatactggttccatatgaattttaaaatagttttttctaattctgtgaaaaatgtaattggtagtttgataggaatagcattgaatctgtaaactgctttgggcagtatagccattttaatgattgattcttccaatccataagcatggaatgtttttccatttgtatttgttgtctctgatttttttcagcagtgtttcgtaattcacattgcagagatcttttacctccctagacagctgtattcctaggtgttttattttctgtgtggctattgtgaatggcattgtgttcttgatttggctctcagcttggacattgctggtatatagaaacgttattgatttttgtacattgattttgtatcctgaaacttggctgaagttgtttaccagatctaggagctttggggcacagagtatgggattttctaggtataaaatcatatcatctgggaagagaaatagtttgacttcctctcgtcttttatttctttctcttgcttgattgctctggctgagtcttccagtactatgatgaataggaacaatgagagtggacattcttgtcttgctgtagttctcaaggggaatacttccagtttttgcccatttagtatgatgttggctgtgggtctgtcatagatagctcttattattttgaagtatgttcctgttccttcaatgcctagtttatagagggtgtttttttttaacatgaagagatgttcaattttattggaagccttttctgtgtctgtaagatgatcttgtggttttgtttttaattctgcttatgtgatgaatcacatttattgatttgcatatgttgacccaactttgcatcccagaaataaagcctacttggtcatagtggattagctttttgacatacggctagattcagtttgctagtatttttttgagaatttttacatttatgttcatcagggatgtatgcctgaaattttctttttttcttgtgtctctgtaaggtttttgtaacagaatgacactggcctcatagaatgggttaggaaggagtccctcttctcagttttttggaatagtttcatagaattggtgacagctcttctttatacatctggtagaatttggctatgaatccatctaattcaaggttttcttctggttggtaggcttttattactggttcaattttggaacacattatcagtctgttcatggtttcaattgtttactggttcattcctgtatgtttccaggaatttatccatttcttctaggtttctagtttgtgtgcctggaggtgtttgtaatagtttctgagggtgttttgtgtttctatgggattggtggtaatgtctcctttgtctttttttttttttttttttttactctccctgtgtcgcccagccttgagtacagtggcaggatctcggctcactgcaaccttcgcctcctgggttcaagtgattctcctgcctcagcctcccaagtagttgggattacaagcatgtaccaccacacccagctaattttttatagttttagtagagacaaggttttgccatgttgtccaggctggtcttgaactcctgtcctcaggtgatccacccaccacagcctcccaaaagtgttgggattacaggtgtgagtgactatgcccagcctcctttgtcacttttgattgtgtttataataaaggttttttgattgaatgaaggaatgattgaataaacgttaatttctaatatctgcctcacaggattgttacaagcttaaagcatctagtatagactgacagtagtaagtactgaataaacctcagcctctaaaacctggccccaatctactgtctccccagggcccatccccacacaagcacctcttctatatgtgtgtcaaactatactagtcactttctctaatttactagatgtactaggtgctgggcattgtgctaagcggtttatctgcatttatcagctaattcccataacaattgtggaagctaggtactgttattattgccatattagatgtaaattccatgaggacaaatgtatttttgcttgttttattgaataattgaataaatgaatgaataaatgaatacctatttcatgaatgcagaaattgagtctgaaagagattcagccatttgcccaaagtcacacagataataaatggtaattcaagccacattgatttcaatatccatgcttttaatcactttctcacaccctctcagctgggagagtggtgattaggtgtttatcagacgaggtgctaattcttatttatcccctagaccttggtaacaaggtaacaaagacaaacaaacaaacaaacaacaacaaaaaacagagactgtatttattctgactctaaactgtaagatattcttttttctcctaataaatcaaggtttatcaacagaaacatttatttttatgtcaacaccaattagtcttccctgtggttctcaaagcaataaaataatttgttcaggcaaacccagctaaaaagacaaatatttctcctttttgttagattttgattgattcctattttatctagatcacagaaattatgctaaggtagaaattgttttttctatagcaaactaaagaaaatttgtaattctgatgttcttctaagtgatgctcactagttgagaagataacaaagaactactacatacaattccaaataaacccaagcttacataactattttaaaaagcaaacaattcaggtgaaaatactcatatgcagtcaaataaattcctataggatgaaccaatttttccattattaaaaactctcaacaaacatatgaaaaaaagctaaccattactagagaaatgcaaatcaaaaccacaatgagataccatctcacaccatttagaatggcaattattaaaaagtcagaaaacaacagatgctggcgaggatatggagaaacaggaacacttgtacactgttggtgggagggtaaattagttcaaccattgtgtaagacagtgtggtgattcctcaaagatctagaaccagaaataccatttgatctggcaatcccattactgggtatatgtccaaaggattataaatcattctactataagaacacatacacatgtatgtttattgcaacactattaacaatagcaaagacttggaaccaacccaaatgtccatcgatgatagactggataaagaaaatgtgacacatatacaccatggaatactatgcagctataaaaaagaatgagttcgtgtcctttgcagggacatgaatgaagctggaagccatcattctcagcgaactaacacaggaacagaaagccaaacaccacatgttctcattcataaatgggagttgaacaatgagaacacatggacacagggaggggaacatcacacaccggtcctgtcggggttgggaggcaaggggagggatagcattaggagaaatacctaatgcatgtggggctgaaaacctagatgatgggttgatgggtgtagcaaaccaccatggcacatgtatacctatgtaacaaacctgcacattctgcacatgaatcccagaacttaaagtaaaataataaaaaaaaactctccagtgtttgcattatacccataatttcactgttaatgttgatataaacactcagtgttccatgagcactatattgttaagctgtgctaatagaaatcaaggaacagagatgtgccctgtaatatatgatactgaaacccatgattcctatatgtgcaaaattttatgtaaagaaaaaaagtaagtaagcctctccctataaatattcattattatcaacaatcagatcttagtgactaaaagtggggtttgcaactaattatgtcagtgccaatcttgtatttacaagattgtattacactactttgtatctcctggggaataaatgagtattaaaaatacatataaccgtgaagactagtcattctaaagattttatttccaagtaaatatttttgaatatctactatgcatttggcattcttctaattactggaaatacaatgttgaaaaaaaattgacctctgctttcatatttatgctcaggagggaagttaataatgataattctatccaagaaacatttattgaatggtatcatatggggaactttaatgaatgttagtgactttaaatgaattctggactaaaggaattgaataagcaaagataacaagctgggaatatgcatttcgagtactgtaaatggcaaaaattccaacgtaaatcaagtgtgaaacatatgggtgatttgtccagagactcgagaagtagttgagactcaatcctgaaaccattcaaatgccatgctaaaaagttttggttttatgctagaagcaatagagagctgtcaaatatttaaactgacacgtttacattaggactgtaaaaatgtaattctagcaatagtagtccagagagtgagagcaagaatcaagaatgtagaaatataaactctcatttttaaaggttatagatccaagagtcatttctaggtcacatcgatagactttgactatatctaattagttagatatagacatgagattagagggaggagcagaataaaggatgatgccaatgcctctagccaagtagttgaaaaactgaccaacacagaaaactcaagagaatgatgaaactcaggacacaagcagaggaagttagtgagtttgattcagggtatgtagcatttgagaagcaagcagaagatccaaacagaaatgacctgtggggccttggagcttcagaagtcaaataagcctagtgacctaggtttagcataaaagtgttagttgaaataatgtacgctaatgagactcccaagagatagactgtagaacataaaggaaagcagaagacagcaactttggagacaccaccacttcaagataaaagaaggtaaaagaagtgaatcacgggaggtacaacaggggaagactaaggcaggcagtccaccagagtcttacagcatggagtcatagcagtcaggggaggagtttcaggaaggagggctatcagcaccatcaactgcttcagagagattaaaaggatgaccatgattacttgttacctggggatcattacttattgaggcaaatgtacttactattgtttgattaaaatagtcatctggggatatacattcacacttgagtaataaagctgtcagagagctacaagtccctggattctataggattgagaagctgcataacaagaaaaccctacctcttcatgttccaacaaacattgctgtatagaaaaaccactcattagcaaggccttaggcaactcacaagacagcagctatgcatgtgaaccttgagccggctatttcataacaatacaaaaatagttaccagccacctacagtatatttacttttccttttcttttcatattgattttctcccacacaaactgcccatgaagtaggaaggagaagtcagtaggtttacatatgtggatattagaactcatgagggctaagtgacttgcccaggtccccacagctagcctgtcaggctaggaaggctcaaaagtccctagcaattatcctacctccacagatactttcagttttaggaagcttttcacaaagtcatggatgtcatcctgctaccttagctgactaaactaatactaaactaaactgaaataactgactaaaacatagatctgttccaagttgaagaacaccaaatagggacatcctttattgactggtcatccactgtctagacagagagaaggagatgggggaaggaagaggaagagagaggggatggaggaggctgatatttataataagtcccgttatgtaaggtcaccagggtatttctcttcctgcccattaatataatagcagaaaagggacaataataccagtcactcaacttattacagagctggtgggaacatccagacaattcaaaaagaaaattctagaaaatagcaacctctaagtaattcagaaaaaaaaaaggcagttataaaagacataatgtgattacccagtagtgactttccattgtggacttctgggcataataagaactggatatagaaccatctagacaccaatagagtctcataagaaagtaagaaatacatatcactttcttatttgtcttcctcacttagatgaaagtgataccagcagtaggatacaaaagctaaatccatcaagctaagtttgtataataggtgagcagagctacaaagagcaatttagaaatctcaaggtaaaagtggtagacaatgtcatgaaaaggaaaaagaccacttaaaaaatgtagaccatttgtagaagaggattacataaagaaccctgacactgaagggcatgcaggaaagagaagcctgagaaggaatggtccaagagacaggaagagaacagtgacagaaggccagagagatttcaaacagtatcagttattgctctaagatcaagaggagctgatgactcaaaatacaccctgggatttgtctggcaggtaatactcaacctcagtgaagcatccagtgaagtggtggggagaaagccaaattaaactagagtgaagaataaatgaaaatggatggagtggccacatcaggtgtaaaatcctccctcaagatgtttatccttcaaggaaagcagagagagagagatgtggaaagaatggctgaattgcaaaaaggatgttttatgataggggagaggttagcaagggggaatgagttagaggagaagaaaaagctgaaagaaaaaaaagctataaagaagatgggtgggcaaagggtcctatgtatatgaggaggagttggccctagacagaagaagggacatcggtgggacagaggctaagaagttagaacaagcatcccaactggtcagtttacaggtaaggctcctaccagacgcccttctctgtaaccaatgagccagttaccaaataaatgggactagggtagaggttggtaggcacttaggtggggaagaaaagctttggatctgctaaactgagagaagggaagttgtgcctatgataacagctctgatgagagatggggaaagcttcatgagatagggccagagtggataaggcagtttgggagttctgtggcacagcaggcaagatctgatagcccattagatatatgtggctgtgactcagaatactcaagaaaatggctgagggaggaggagtcaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgtccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcctagcacgcagctggagatctgagaacgggcagactgcctcctcaagtgggtccctgacccctgacccccgaccagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaataataaaaagaaatgagcaaagcctctaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaatatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccatacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaatcaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgacaccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtaaactcccattcacaattgcttcagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactattgcaagaacaaaaaaccaaacaccgcatattctcactcataggtgggaattgaacaatgagatcacatggacacaggaaggggaatatcacactctggggactgtggtggggtcggggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaagaaagaaaatggcttacatgaatttctcctttttatctttaaaagcttccccctttccccaacccctttggatgtgtctatggttcaccatagcatgcatatgtcccagattgcaatcccttgctattcctgaataaacttctttttggaaagtctgtctctgctgttattttaggttgacatataaaactagtgacttcttcctactttataaacaatgtgttgggggtgaccaatataaaaagaaaaagaaaatgaaatatggcttacatggttggtaattatttttatattgttatgagatagccaactcaaggttcaggatgcataaatgctgtcttgtgagttgcctaaggccttggtggtttgtctatatagcaatgtttttgaaacatggaacacctacaaagaggtagggttttcctggtatgcagcgtctcaattctgtggaatccagggacttgcatctctctgacagctttattactcaagtgtgaatggatatcctcagatgatctttttttttttttttttgagacagagtctcactctgtcgcccagcctggagtgcagtggcgcaatctcagctcactgcaagctctgcttcccgggttcatgacattttcctgcctcagcctcccgcgtagctgggactacaggcgcctgccaccacgcccggctcattttttgtatttttagtagagacggggtttcaccatgttagccaggatggtctcgatctcctgacctcatgatccgcctgcctcagcctctcaaagtgctgggattacaagcgtgagccaccgcgcccggcagatgatcatttttatcaaacaatagtgaaaacatcaaacaatagtaagaacatttgtttcaataaataatgatccccaaatatcaagattatcttaatcatccttttaatctctctgaagcagttgacagtgctgatagccctccttcttgaaactcctcccctgactgccatgactatgggtcacagtcaaaaaagtttcaaacctactgctttaaggtagaccaataagtagaaagtgacatcctaaaaaaaaaacgaagaataccagctaaggagaaattttaggcattataaatcaagtctatcccgatattcccaattctatctctgatgagttaatagaaatctaatttgatagttttagcttttatatcctatgactaatgtccaatcaactgtctgtattgtgtaactattggtctaaccgtaattcttttttaactgcatcaacctgtggcattgttataaattaaacttttttcttggtttggatttttgatcagtgaatggagtcaaactgtaacatagacataagtattagtaaaaatacggcacttactttgacctttggaagacagctgttctcagaatgattgggttattctcactgatacaattttgggttctaagttttagcccaggttcagtgtctctgacatctacacaattcaatgcagatttatttagttttttatgaagacattggttggattttttaaaagaaattcttttgaagcagaaaattgactccatgcagatttttcactctgttgcacatattaaactacaacaatttgggtgatggaaaaaagcagaaataatttgagaggcgtgggcgaaaaggccaataaggctataaaaatttcgaattacaaagagtcaagagaatattaccaaccttttattgtcagagaaatgaagagtcttacttgtgcccttgaacatgaaaggtggggttgtcagtgaatttcaagagcaattctttaaatagaggtgggtggttctcaatgagacatgagggtggtgtgaaagtggctacgaccttaaaccagtgagaactagatacacacacacacacacacacacacacacacacacacacacacacagcagaaggtagagttaaaccaatctcagttaaaatcccagctccttcacttaatagctgtgtgatcttgggcaaatcacttaacctccagtaagctagttatcttgacttgttagtatcttgggaagataataatagccttcctgagattggtcctagatgtaaataagacaatttttgtcaagtgctcatcaaagggcatggcagaaagtactagctcaatatttactgtattagtttcctagggctgctataacaaagtaccacaaattaggtggcttagaacgactgaaatgtattgtctcacagttctggaggctagaagtctaaaatcaaggtgtcagaagggtcctgctccctttgagactgtaaaggaaagatctttccttgctgtcttcaggttctggtatccccaggcattttttggtttatggcagcataactccagtcttcacatggcattctccctgtatctcttcacagagtcttcccttctgtggatattggtctctctctgtccaaattgactctttttaaaggacaccagtcatattggattagggtctaccctaatgaactcattttgacttgattacctctgtaaagaccctctttccaaataaaatcacattctgaggaactggggttagtacttcaacttatcttttgcaggggtgtgggaagaacacaactcaccctataacaattatttatgaaattatcttgctagaaatattctgcaggagatacattagtacatgaagtacttcaaaattgtagaatatcattctctagtgattcattttctgtttcttttctttttaaaggaaggagtactcagtcttttcaatggaatgacataggtatgaacttaatgagtatccttcctgcgcttagctgaatccggaaaggcaggatattgactcctttgccattctatagattcctggtcttgaggcaaagaaaactggcacaggcctttgcgactgggcctgcaaaagtatatactacacagagaaagggcatgtatccttactttgaatggtgtgctaatcgtctaacaacttcaattgtactaatcacgaatggaagagaacggctctttaatggaacttcaatgaatataaattacatacttactaatcaaaatgaatccttttcagctaatttctttttttctccttaaatgtcttgagtgagtaatataagcttttgttattttttttggccagttttctctgccataaccctgattgtaactccactctcatcatggaacttaatgcccaaacactacacattaatttctatttcttcatatgttttacaaaatgatatatatttttgccccaaactgcaacatgctatgaaggcttaatattctaacattgcaatcatgggtacaacctaaaaaaagacttcaaattagttagcaaaggaaataaaaataggactctctggggacagaatgcaggccagtaggggatacgacaccttggtgggggtttttagggctatgttgattcattcaaatgccttaatgacctcctatgacagaaccatgtggcagagaaaaaagattcatatgccaatgtgaagggagaagaagaatcaaaatgaggaggaacagattaaatatttcacaatttaacaagatgatatttaaggcacctaatttcttgccttctaaaaactgctagcaaaatgtaatttcttgatagccaaaaaaaagaattcaaatgtacaccagcctcttgttacactataaaaataaggccaggcatggtagctcacacctgtaattccagtactttgggaggccaaggtgggcagatggatcacttgaggccaggagttcgagaccagccttgtcaacatagtaaaaccccatctctactaaaaatacaaaaattagccagacggggtggcacacaccggtaatcccagttacttgggtggctgaggcacaagaatcacttgaacctgggggaatttgcagtgacctgagatcgcgccattacactccagcatgggtgacagagtgagaccctgtctcaagaaaaaaatcatgaaaaatttaactataaatccagacttcataaagcaaacatattttccctttgacagtattaagtaatttagagatttatttctaaatttagaaatttatttctaatttgtcctcaataatagtcatttctcactttgtaatttgtctttaccttggttttctaaaatagtgattaaaaacaaataattacacgtgctagggatgcacttcttaaagaaacttaattttagattcagccccattgaggacctgctgtgtttgttaagtgggcagcagtgatggatgaaggccacacggtggcactataagcaatgggctactgatgcaccttttaatcaacatctactctaaaaagtgagccagtccaagtagctttgagaaaactggaaaagtctgaggctgcaatgcagaataaagatgaataaagattacataaatgaaaataaagcagctataatcaaaaccacactctaggccatctaccaaacctaagaagccacttactgtgataaattaattacttaaaaaacaaacaaacaaacaaacataaatgcatgagagttttgctatttggtggactaaaggaaacttttttgtatgttctgggtttcttaatattttttattttgaaatacatggcactgatgaatttatcattgaactgcaagatagccagaaaactaagaattattagttcactagatatagccataacataaacaagtttagtcagcaagtctgtgtaatctgattgtttcagtcaactaagcaaggcaactgactttgacagcttagaaaagtgaccttctagatgaagagttctgaaggtgattggaagctcttatcagaagtgcatgacaaaaccgactcccaaagtagcaccaattaataaaacaaattagcaatataccttctctttaatgcactggtgctcgtatttccttctatgaaattttttctacttagcagctatcaatcaataccaaaacgattatctcttgctgtgcaattgttggacagcttgggaagcgaagtggtttatataaaaatttgaaacgtagacatgaatggaaaagaccactataatttgaaagtggcttactgctaccctgattttagactggtgcctaaggaaagagctaaaagtgatgcatagcaaactgcatgaaattgcttgctcttgtaaacagattgtagcaacagggtaagggaaaacttagactatatattaaaaatatagaatgaatacctttctcatgataccataccatattgctgaagataggggtgaatggcatacatatacttttaactgagtgaaaacaactccagaaagaaagaaaacataggttatatctgtgcctccttggagcattttcaaattataggattgtattctttatgtttttattcttgataaatttgcacctaattgtatgtttcagttcccaattaaatcaagagctccttgggatatataatgtatctgctaatttttaactcctccatggttataaaaatcatattaataaaataaaagctacacatgttaagttctcattagatgccagatattgtgataagtacagtagatagcattatatacataaacttcaccaaaaaacccccatgagattaggactaatgctctctctattaataaagagaaaacagaggtataagttaatttgccaagtactactacacactactaagtagcagagctaagttttgaattcaagaataccttctaccaaagctcccagctcgccttgtagagcagagattgaagcatggtggttaacagccacagtgcctgaggtctacccagctccaaagctgactggctttatggtctttggcaagttgcctagacattctgtgtctctatgtagttgttattataccacccagcagttcataaagtagaaattcaaaaactcttactgagaaccttccaacttctctcagctatctccaaccagttgctctaatgaacaaataaatcaattggcatttgatataattgaaatcaggtgcatatttgatttttccagtaatggtcttcaattgcttctgacagtcactgtgctgtgactattatcacttcaggtgattatagttaatatagtgcttttttttcttcaacaactctactaaaatgtctacatgtcaaatagagttggtaactgaaattaataatgtagatacatagtaaagctttcttgaaaagtgatcatttagagttctgaattttaatattactatacctcattgaaggattgacacaatttacctccagctatttcatttaatctgtgcgttgctgtgatttgaactaaaattacacaaggcaaggaacacaggcataacagaggttcctctcatcttcaggggactcattgaaacaaaaaaaaatcagtaagggataatattctcttctcacttgcaatggcattttgggcattcagcctctatatttagagaaattcattaattctttaatcagtggcatggaggcaatgcaagaattctgaactcaacgttaagaaacactattttcatccaaactttgcactgtgtatctcactgaacaagtcttttctatctgcctcagtctcttaatctgtaaaataagaggatttctattgttgaactttaaagttttaagaattgatacagtacaaagacaaaaagtgggattgcaagagttttataaattgctatgtgaagagcagaacaatgcgcaagtgcttgcatttgcttctttaaagcttacacattatgttgcagaagggtggaattgccctaaaaaacataagccaaagtgatctttaaccaaaacccttttatctagaacaagttctctcaaataggaagctatcaaactatttcaagcagcaaggaaacaaggcaaaaaggatccttttgctcactttctgagtccttttttgtccaaaagtagagtaagattaaccccaccctgttgtatgcaactacaaacactgcaaagaatagtgatagcactaaattaccatgaccctgtaggatcgggggaacacacaggtaaaacacacctgttatcatcttccacctggagaccttcaggaaagtggggattccagatcctaacaccaggctaatccatccttgaatcccttccccattctcagctttgtcttctctcctggcacagagtcagccttcaggagccatgaaactagagaagccgaggacaaacagaagcatctctagcagcagggtcaaagccttttcacagtctctgtgtgcctgctctacccactatgaacatgtttcatgaatgttctatgttcttcctcttagacacaatatccatagtgattaaggagctggttccagtccatattccaccacttactactcatgcgttttaccctctggtccttgattttgtcttcttaagaatggggataatggggccaggcacagtggctcacgcctgcaatcccagcactttgggaggccgaggtgggaggatcacgaggtcaagagtttgagaccagcctgcccaacatgctgaaaccctgtctctactaaaaatacgaaaaattagctgggcgtggtggcgggcacctgtaatcccagctactcaggaggctgaggcaggagaatcgcttgaacacgggaggcagaggttgtagtgagctgagatcgtgtcactgcactccagcctaggcaacagagtgagactccatctcaaaaaaaaaaaaaaagaatggggataataatggtatatatctcactagatgatgaagattaaatgatatagtgcatgtagagtgcttagaatggtgttcagccatacataaaagctaccataaaatgttaactttgaagactaaatataatacttagtgtccagtatttctcagcaaactttctgcaactacatccttcaatgtgttttcacaaacagaaatagattaaccaattgatatctacttaaatagtaaaactgcaacaattccatgaagaccatgtcccccaaatatgtcccccaccagcctgcagtgctatagccaataccattctcttgctgctttacgagggcagcttttcttactgtgagaatcgagaggcagaggactctctaacccttaaggggatgaagagggaaaagggtaaagaaccaaaggcctcaattacctactccaagaatgtcaattacatattccaagtttcctaatcttctctaatatttgctaaatcaagtatttttccaaccattcaattaccatagaacaactattaattgataccttacacagtcactgttctgagggacgttcttattgaaatgtttaactttgaaccacatttttcttatctcaaagtggggataatgatacataccaaattgggtagttacatataataaagaagatgatgtaaatgaaagtctctaccacagtgagccactccacactttcatatccctgcaggagtatcttttctcatcagaaataaatgttttattaaattgcaggatgagtagaaaacaggctgctgtctctagaattattttgttcagaaacaaatattctatgcatgactattgcattaaaaattggggtcaactctcttcttatagaattttaaagaataaagacatttctcagttgtgttttaatttttatcatttattatgtttttattttttgcttaatactttgtgttatcataaaagaagaaccaggcgatattcttttattagcttttcaatggctccagaacattccttcaaagaagtctttgtaaagtctttcttccccactgtcacagtccatgcattaaaagctgaccagctatgtaaaattaaagtcagaaagaggagagactataaacacaatttctagtgaattaagtgtgagaagtcactgagtaccaccattgccacacacaaaatcttgtgcagaagtgtcttctcatgtcttctaagttttgtgagaatcttcactctaaagctctgatgaaagcaacccaggcctggatcaataaacacatttactctgagccttctataattatcctgagaccaggagttcaataatgtcacccatgctcaggcttggtattcacagtcacctcttgatgcttccatggttcaacccaactctgtggccaacacaaataagaaactcttcgatctaccttgtgtgacttctcagagaaagagtttgttcctgctatgctgtaaaggagtacatgctatcatcacccaccttgaaacttcagtggtttccctagctttaatattctaagacactgtaaacaaaattcatgcattctattactgctttccaaattgtgtagaggtaaagcaaattcctctctaccttcattatttcaagactaaaaaagcaggcttcataagcgtgcaacctgtgcagtcacaagggaccccatgcttagaagagtcctgtgcttgatttaaagtcctcctgtcccaggcttaaaattcttaatttttgaacaagggtcccagccttttcattttacactgggctctataaattacgtagccagtcctgccagagtgtctgaattgtctaactctattctcatgtggcagtcatcttctcttcactgtctgtggcactgggaataagacatgaattaatgttggaagtcaaaaggatgagccaagctgagggccacttagagcagctgtggaaagcctggtcatatgacaggtatacaggcagcaagaaatgtccattgaaactgagtcctctgaaacctttgtgaggtcttctgtagtcccgttatttttactttgctcaaaactcatcagggtttctagatgcatcaagatatgtgtgttatctgtacataaaaaatgtatcacttctgtctgcaaaatttcagtattatatctcagagaggatggcaaaataggcttgcctgctaactgcgttcaaagatccacatacacatgctcaaatttttggtgagatgagtctgattcagttgtattactcagcattctgttaagtggccttcaatactgtcatacagtctaaagcaattgatagttttagtgcctctattacatcagaaaatacacaagaatgacaatatgagcaatctactctttttcaagaaagataagcaattcactagagatgtggaatgctgtttcctaaagcaatatcaatcctggatgtggttatgatgaaaagctagtagtcatagcacagtatgaacaaagtccagaaagaatactctgcccagagtcaaatctttctatcatactcagaggcgagctacaaataagaaaggaaataaacgctcatttcctctgtaaaacagaggatactttttctgtaaattcctttatgcacagactagggactgatgccattgacacagtggggaaatgactccactcactgacccactggggatgcaatcctaacagttatacttatgtgttagcaaggatcttcactgcagttaatgaatgtcccaattttgagagagaatagcttttctggttggcaggaatcaagaagtgcatgctcagttagtcactgctcctcatctgaaattccttcaacctgaggttaggagcatttatctaaataccaggagtccactggaatcctccagcctcacctcatgccagaaagagtggatcaatgacacattctggtcaagacaaaaagtagctggaaattaccatcacatcatagcactgaaaaaaaataaaaacgaaaaaccaaaaaactccttgagaattcccagcttatcacattatctggccatgaaagtttattcatattccaatattttccatcagatgcctcaaatcctttaagaaacaagatggaaatgaagggagagaagggggaaagagaatgagagagaattgactatgtgacatttgaatccaacctaaaactcacaccactcactacagtttcagcttctttaaataataataatatgcagaaccaacatactttttcctttgataagcctcatcccagcaccaacggggataggtaaggatagaggtggaataaggattaacctagtacaagctacatgattagtaaccatgtactcttttcagaaagaaacataaattgtttcaatcagataactgcctagtcaatgaaaattcacttgtatatggaattttctgcatatcggactttgtggttcctgctttaatgttacaattttaacactcacttatttttgccttttaataatgtggttgatcaataacagagcttaacgattttcattttcaaaatttatagcagtaatttttcagagttacaagtatctgggggggatagtttcaaaaagtatttaaggccaggcagtggctcacacctgtaatcccagcactttgggaggctgaggcagggggatcacaaggtcaggaattcaagaccagcctgaacaacatggtgaaaccccatctctactaaaaatacaaaaattagctgggtatggtagggtgggcctgtaatcccagctactcaggaggctgaggcaggagaattgcttgaacacaggaagtagaggttgcagtgagctgagatcgcaccattgcactccagcctgggtgacagagcgagactctgtctcaaaaaaaaaaaaaaggaaaaaaaaggcggagggtagcgtggtggctcatgcctgtaatcctagcactttgggaggtggaggtggacagatcacaaggtcaacaaaaattagctgggcacggtggtgcgctcctgcagtcccagctacttgggaggctaaggcagaagaattgcttgaacccaggaggtagaggttgtggtgaactgagatcatgccactgcactccagcctgggcaacagagtgagactccatcttaaataaataaataaataaaataaagaacaagtatttaaaatatatcttggctgggcacagtggctcacgcctgtaatcctagcactttgggaggccagcatgggtagattacttgaggtcaggagttcgagattagcctggccaacatggtaaaaccaccatctctactaaaaatacaaaaattagctgggtgtggtggtactcacctgtaatcccacctactcaggattgggaggctgaggcaggagaatcgcttgaacctgggaggcggaggttgcagtgagccaagattgtgccactgtactccagcctgggcgacagagtaagactctgtctcaaaaagtaaaatataatatattgggccgggcatggtggctcacgcctgtaatcccagcactttgggaggccaaggcgggcagatcatgaggtcaggagtttgagaccagcctggccaacatggtgaaaccccatctctactaaaaatacaaaaaattagccaggcgtggtggcaggcacttgtaatcccacctactcgggaggctgaggtaggagtatcacttgaacccaggaggcggaggttgcagtgtgccgagaccacaccactgcactccagcctgggcaacagagtgagactccatttcaaaaaatgataataataataataatataccttatatttggaaatgaaaatatatatactcttttcatatgcaaattatagaaagtcacatcaaacaactttttcatggctggtcaggatagaattcttctagatttttatgatggcatgagtttttaagtgctgcaaaacatctatataaagagcattatcttcttccaataagttttttgagatttctttttaattgggtacatacttaagggaagagatttgggccataatacaatctcctattctcagctccagtccgacaagagaccctaattaaatttctaactgttctctaaataacacatttacccttatagtaaaactcatttataataatgctttggggggagtacctgataacctcttagaggcttcctaattataaaagactaaataatatattactgcttttttttctaattctaaaataatacatctcacataatcttaataaagacagtagagataaaaatagcaccaaaaaatctacagatcaatttcattatccatattaagtgctaactgaacccagcattatatcaaaataatacactaccaccaaacaggattcatctcagaaataaaagtaatacaagaccaaagtttaacaaagttttcaaacagtatataaattaatacagtggaaaataaaaattgcccagaaatcagatggtggttaagtgtggaaaaagattccagggcatccacttgctttaactgtcaaaacgcctgcatcaaaaacacttgaatcaaaatgttctatgtatatagatggtaaacagaagttaccaaaatatttctaccattcatgctatttgcctcttcagtaagtatccgcctcctacctattcttaatccatttccactaatgtttctatgtctaatggttaacagtacattctgtataaacttttattccaatggttctctttattcttaaacccttgtgtcaatgatttggccagagatcaatggtcatcagaagatagttaagtagctgaagcactcttttaagatacttcagctaagcatgcttctgatttacataacaatttttaaagatccctcagtttgacataatagaacattgatctatccaaatatcagccttaacaaagtcagaactatgactgcctataacctcaccccttagcatgttgacttgattccaacataattgagattgtcaaagaacatgacaatatatactttacttcaatgatagctggaaaacagatattcttttttttctcgttttttcttaattcttaactctcatggctgaaatatatagatgattctccgcaagcagaaacatggtacactccactatctgtgagaagacaagcaaagaagcacttgagacttaagttacaccactgactgttgtttctaggggcacttctcaaccagaattttcctactcataaaatggggctaccattgtggttttgctcaccaaggaaatacagagctgaatggaaccaccactgtcatctggccctctgcccacaggcagccaaacatctgcgtggtagagagtagggctaggggacagtggcatttgaaggcacagattcaactctcagctgtgtggttttctaattgtgtaacctggagcaaataattaattgtgcaacctggagcaaataatttaaatttaataataatttaaaatctcgaaacctctttatttttcttctttttaaaaaaaaaatgtttagctctaaaatgagagtttgaataaagtaatttttaaagtccccttgctttctaagattttcatatattcagtgtgcatggttcttaaaatttttctgtaaggattgataaaataaggcttgtgcagcctttatgtctttaacaagctcaatgtgcaacctgattatctgtgacttcattgatataatcttccaatagaatattgcatttcctattgattgtttatctgtatattttggcatattgagtgacatcatttttacaactcatcaaatgggggtactctttactttgagctcccctcttcctaagtagtaggaatagtcaatgcattgtttatgaaaaatgacaagccaggaaaaaggagaggaaagaacaatgagtttccagctccactattaacttcttgctagacaagacagactgcagttacctcatctataaagaaaaaaatttaacaattcttacctacctcataagaatattgagagaattatatgagttaatatatatgtatatatgtgaagattagactccgcaaatgtaaatttttttttttttttttgaggcagagtctcactctgttgcccaggctgaagtgcaatggagcaatctcggctcactgcaacctccccctccccgagcgattctgctgcttcagctggccaagtagctgagactacaggcacccaccaccacatctgactaatttttgtatttttagcagacacagggtttcactatgttgggcgggctggtctcgaactcctgagctcaagtgatccatccgcctctgcctcccaaagtggtgagattacaggcaagagccactgtgcctggcctgcaaatgtaaattttgatgttatcttaatgattgatgtttccaccagcttctaagagagtaaacataaaaagctgtatacatggcatgtatgctaccatcttccagttaactgtctttctaaacacagcaccagacccacatgtctgtgtgttggataaactccctgcctttaatgtccataatgagcatgatacaaacattttacatcattgaaccacaaaaagcacagagtatttttccaagtttttttcctagggataattgtgaaggatcaccttccaggtgaatggctgcgaccctgtacttctagcacaaatagaactgtgttttatatactgatcctagtgaagatgtaatttcaagaaggagaatgacttattacgatgtgcattgctgagggaacaaaaacccttacttgacccaatgatctgtgcataatcttccccttggtaacaatttgaagacaagaatgtaagaagcagtttggtttcccattttcttttacttaagaaatccatgctgctgatcagaagtttgccataatttgtagttttgttgttttaaactggatgggtcttttttttaattacaaaaagaaattcatttcaaaagcataaggggatatttacatttaaacaaggtgataaacaggtgtcttgcaaaagaaaaaaaaaaccacagtgttaagtttttcattcaaattcagaagcaaaaataaccgaagttgtgcactattgtcttaggaaagggaaagggaagagtgaggggtaagggaacagtcaattcagtatcaaacttgagagagtaaagtcacttctgctcagctgtgagtttacaaatatgcttataaggaggaaaagtggaaaaattatacttaatgttcaaatttatttagctgtagtctcaacacaatttctgtagttgaaatggctttgggccactggctgatctatctctgaggtccagagtggcgggtcaattttcaaatggcaattttatattcctttgtctgttcagattccaagggagtttaggttcagcttacagtcttttggaatgtttagagattattgccaccaatccatagccaagctgaccaacttttgctcatttgtatcattctagcctttcagaactattttctccatatgcatgtgcagtaattctaacaaaggaattttgcttcttctgcagtgagaggtaatggtaatgaagacacctgctttggaatcacaaactattcctaaaaaaatacatcagactactagaaatgtcattcaggcgtttgatttgaatagcaaacttgaggagggaagattaactgtgaaacaaaaatatactaaacattcaaatgcagaacaaaggctctatgctactaaaaatgcccatgacattaaatactccacaaacaccacccaccccgcatctgctgttttaacctaaaaattctattggctaacttatacaataattttgattaataacctgagaagttaaaaatcttgaaaatggcaaaagcaaactgagagagcttcccttccttattggtaccatgttatcaagtcactttttctgggtagccctggttatgaaatctccaaattctaaattatactatctcttcctgtagaaatctatacatacatcagattcagtattttggctgtatttcaccaatagcaatctccaatttgtctttgaaaatgcagcctagctgggcgcggtggctcaagcctgtaatcccagcactttgggaggctaaagcaggtggattgcctgaggttaggagttcgagaccagcctggccaacatggtgaaatcccatctctactaaaaatacaaaaatcagctgggtgtggtggtgggtgcccataatcccagctacttgggaggcagaggcaggagaatcacctgaacctgggaggtggaggttgcagtgagccgagatctcgctactgcactccagtgtgggcaacaagagtgaaactccgtctcaaataaaaaaaaaaaaagaaaaagaaaaagaaaacacagcctttatttttagttttaaataacaataatcatgtaagtgcaactgacttagaatccttggctactgggagtaaaaacctaaataacaagttaataacagattcagccccaaaaggataatcactgtgtcagactacccattcctggaatttaaaaaagtgatttatgtcgtgtagtcaagtttcacagcatacatatatacatatatatatatatatatgtatatacacacatatacgcttatgtatgtatgtatattatatatagacatttctattcaaatagtaagggtccgtattcaaaagtttgtatcataatatatggaaaaaagttaagcaagcagtgcaaagcaacttactttctcctaaaaatgtaatgtcattcctacattttaagaaagcaacgtaaatattatgcttttatgacactagacaggaatgttgcaccactgcctagcagctttattaaacaatgaaaacaaaatgttaagatttacagttacccttctccatatattgggcaaaacactaaaacagaggaaagaggaaaatcagtaacttttcaaaactgatagtctttatcagcagaactagactgaatttcactacattttagaatgaacagctctcaacaacaaattatcaacatatttaaaagtaaaagattcacaatttgaagtctgaataatgatattgcaaaaacaactcaatattgcagacgaagcatccaaacatatcactgtgattttaccttggatacaaccatggtctgttacaaaaatagatcatacatacaaaggtataaagaacattaagtttttagctgaaggcagcagtctgtttaaagggacacccccggaaatccaatgagtagtagaatttaagtatattaagctcatgactatgctgaagaatgctgatgtcttattcagtagagtcttccacgactacgatttcttcgtgtgccccaacctcggccccctctactttccctgaaggctcctctcataattaaagttgcccaaattgctgctatatttctcactgggaggattataaatctgcctggcatctcttttttgttctgctgaagatttctggggtggtgaacctgaagttgtatattcactggctctcttttgcccaatctcaaccttttatacaggtttccaggatagtgttactgtgctcttacaagaaggaggaatgtggaagagatccttgattaaaacattgatattgtttgttgctttcaatgcaacaactttaattttgttctcttctgttttctgttcttttctgttctcacctgtttcacctggagagctaagtgaagttgtctgatataaacttgcaggcctcgtgcaaagtattgcagcctgattttgaaatctttgagtttttctgcattcagtttggctgttaagaaatctggaagtttttggcccaactggtgaaaactgtacaacaaacattccacataactgaactgtagtttgggttcttcatcaccagcattccctccattttctgcttcttctggagggaggggcatgtattccaataacttatcaaatagtttccctaaatttgtttctagtttttccatgtcaccacaaaatgaactcatctccaccaacaatttcaatacctccaactgtatgtcaagaccttccactgcggtagtcaagataccaaggttagggagaacctgctcacagaaatatgtcacagaccttgtggaatggacagttttagagaagaagggtactgcctgctgagtgcactgtaagagcctgcccacacactcaggatctgagggattgaaggtctgttctaggtcggcctgttcagccaccaactttacaagttgctgtcttccacttactgtctgtaagctttttaacccagacagtaattcatgaatagaacaaattcttcatgagtcacatcttctaggacgtgtttggattcagttagtataagctcttccacttcctttgttaatacttcatctggtaaagtcttaagttttgtagaaaggaatttaattgctcattctctaacaatgtcctctccttgaagtatttggctgaacaatgaacctaaagtcccttttccatccatgttaaatatactcaacagggcattgttcactaggttaaattctgcagagccatctgactccaaaagttgcattagtatatctgccactcgaggaagattttctccagtggtaaattgaggcagttctttaattgcttgacgtcaaatagatacatcttcatcttcacagaggtctaactgtgcattgatagcagaatcagccaattctgtaaaatgcttaaagaatttcagaataaattgagctgctaatcgtttttccttagtaccacctttcacaccatccagtatcacttgataggcatctttatgctggcccactcgctccgtggtatcggccatgatgccatagttgccgtaaagctcctctaccatcggcatggtgagcgacaagcccagggcctgctcccactatcttcatccttgccggcaccactgccacctcagcacttctccaagcccactacctgcactattacacccaactggatggctctttaaagtgtaaaacaatggaaacatccatggcaacaagccacatcatccggatcaaatcttaaaacaatgggcactctagatctagtgcaaaatgtattttcagtctcatagagacaataatttctgccaccctgtttcagaggttaaaagaataagaatagcaaaacgcccatcatgtcctgtgactgtcctaatcatgataggaatcatgtccaagtgttaagccgagacttaaaaataaatttagagtcaaccactgaaaagaagcaatggacatttataggttcatccaaggatcgtggtcctaatcatgatgggaatcatgtcaaagtgttaagccaagacttaaaaataaatttagagtcaaccactgaaaagaagcaatggacatttataggttcatccaaggatcgtggttctctgtcttcatgacaagggagaataactgaagacttattctgatgcctcactctgggtttggaaataaaagtggaatacctataacaaatttcagttacactacatcacaagtatcactgtgatattaggacaaacaaaattgatgtcgatattaaagcttcgaaaaattaatcagacactttttttaagagaaagaagacagatatggataggttttttgtaaatgaagtataccaaataaccaagcactgagaatggagttaaaactgcccagacgctatgatgctacccaatgctattaaacattgggtggcacctttaaagaaaaggtactgatttcccacagccacttattatatgctatggagagcaattcttccaaaataccaagcacactttttggatggttaaagcccgttccagccttctgatggtgtcaattaattcttgtgaggaatcattttaaattctctccagtgagagagtttgctattatattttagttttatttaaaccccctttcaagaactgtgtctaatagaccttcaaagcatctctgggtagctctaacttacataacctcatttttcaaaaccactcattactttcttcccctcttaacatactctcactccagcttgggccctcccttggggcaccttgctgcctgctttggtaatatagtcatgcctacctttgagactttttctcatttctaaatagagtatgcagaatatgaaaggggtgggggaaatgctcttttgttgattggcaatggaatcagaatctgccagtgaaaataacctacaatcatatctagccaggatattatccacggcacatgtgggagaaataaaaggaaataatggaaaatgaccagaaaatggtttcatttctgccttcaattcagaaaagaagggaaaaaataaatatccaagtagattttctaaatcactacatactgttaaaaatagaaattacaaagtatgtcacagagttatattatatttgaaattctccaacaggaaatatgatgtggcttcatttaaacagcatattccataaattttgctatacataggaaaatgctctaagtaagctgcagggtaatttatactggaaaacctcactttatcactcagtgcaatcaaatgctatttgcaaattctgatttgaggcacaactttttaaagcaagaaaaatgctaaaattagactaatcctcaccttcttttcattctcagttgaggaaaatataataaacaaccataaatttaaaaatgttttgtcagtaaaagcacaaaattgaagaaaatgaaaatattaaagtatctacctcatagctgtatatgtacaaagccgttattattttttaatgatttctaactctctgttagttttaaactttttcttacagacacaaagctcaagtgtggttacaaatatttatggaaagctgaaatgccacaaggcaatgtaatttagaaataatgttttcctcgtgtcaagtaccctctcctcacacacacacacaaaagtattaaacctcagtttatttaaccatctatacatgtatatcaggcccatctacctgttcatgggtcccaaaagtgaagatgcaacagtaggaaactaatgaacatccaccgagtgtccccatgtggtgtgccaagacagacagttgcagacaattcctggctttgcaagcacaagtcaagcgaccctggacacatttttaaaattgctcacattcagtgttctcatccataaggtgagaattataataatatcaacagtgttgttgtgaggattaaatgagacaatatatgcaaagcacctatcacagagtacactcttaaatgtttccattattttctcatttaagaagaaaagaaaacactgagaaatactgcatgctgtcctgatgtctataatttgctttacattccttagcaaagacaatgtgaaagtgtgtgtgtgtgtgtgtgtgtgtgtgtgtgtgtgtagtaggtttaatatgccatcaaggagcagacagttgccctagtgagaatttatactccagggatattcagaaagctgcactcaaaatgtggctattacaagtgctccagagatctttatctgccttcaatagcatggggctttgcaatgttagaaatggatttcactggtgaaatcagtagcttgttaatcggcacaatggattttagatatcaactctgattactgcaattagtcctattcaagatacatgcagttataattttctaggtctctagaacatacaacctacctttgcattaataaagtatgaaaatctagtaagttccaaacttgtttccttagagataagccctgaagttgtttaatcctgccactgggtcaaaggattggtggttgcccaccagcagaaaaccagattctgcctttgaaatattgttaggaaagttaggattagctaaaataaagagagcttgggcttcatgaagcttactgaatagagtatatgaaccatttgacccaacttgcccacaaaactttgtttaaataaacatctttatgtgtggcaggatttggtctatctgctttttattttcattttttataatttctacttttattttagatttgagtatataggtgaggtttgttacatgggtatattgtgtgatgctgaggtttgggatatgaatgatcccatcacctaggtactgagcatataacccaatagttagtttttcaacacttgcccctctccctcccttccccctctagtagtccccattgtctatgggtgtcatttttatgtccatgatcaaccaatgtgtagctcccacttaaaagtgaaaacatgcattatttggttttctgttcctgcattaacttgcttatgatgatggcctccagctgcatcatgttgctgcaaaggatatgatttcattcttttttatggctgcatagtattccatggtgtctatgtatcacattttctttatctaatccactgttcatgggcatctaggttgattccatgctttgctattgtgaatactgctgtgatgaacattcaagtacatgtgtctttttggtagaatgatttattttcttttggatatatacccagtaatgggattgctgagtcaaatggtagatctgttttaagttctttgggaaatgagatctgcttttattaaaaccaaatagcaagattataggaaagtagccagcttccaccaaattcaaactcttttgaagctattataaggtacctaggaggtattatgaataacctagaagtcgtgtggtcgaattggcttaggtcagtttgcatcatgctagtgtttattttctagttaaaaaattatgccagttacaaaaaattatatcaaaaattagaccaatggttgattaattccttgtggaaggcatgcatacactgaataaaccaaagggtggaaataaagtgaaattagaaatcaagggaatgcaattttaaaaatgattgaagctgataaaagtttagtgagttcatatactgctactggcattatgaattaatataattttctggagagaaaaatgagtgaaatttatcaagagcccttaaaacaaacgttccaccaataagcacatgaaaggatgatcgacatcattagccatcagggtaagacaaatgaaaaccacaatgaaataccacttcacactcactagaatagctataattaaaaagatagtaagaagtactgacatgggtgtggagaattcggaaccctcatacattgcaagatgcaattcaaaatagtgcagctgttttgcaaaacagtctggtagttcctcaaaaggttaaacactagagttattttatgacccaacaattcaattcctaggtatatatccaagagaagtgaaaaaactatgttcacacaaaaacttgtaaataaatgttcatagaagcattattcataatagtcaagaagtggaaacagcaacaaatatccatcaactgatggatgaacaaataaaatgaggtatatccacatggtggcacattactgggccataaaaagaaatgatgtactgatacatgctacaacatggatgagtcttgaaaacgttatgctaagggaaagaagtcagtcaccaaggattacatattatatggctctatttatatgaattgtccaaaactggcaaacccacagagatagaaggtagactggtagactagaaggtaccactcctagactggtattaggagtaggagagctgggggaaatggggagtgactgctaatgggtatagggtttcttctggggtgatggaaatgttctaaaattgagtgtggtgatggtttacacaactctgcaaatatactaaaaaccactgaattaaatggagcattgtatggtatgtgaattatatcccaataacactgtttaaaaattaatgtttaaatccctggactcagtaatcctaagcattagtttgaaccatataaaactgcagatatcggatcatttttgacctatagaacagcaatttaatagttcaacctaacagctattctaagacacagtccaagacttatttgtaaagatgtcaatatttgtaattttgtaagaatgtgatttttgaaacaacctaaatgttaagaaataaaatgattaaataaactattgtataagtacatggtggaaaataatgcaaacatgtaaattacatctttgaagaattatttaaagcatgataaaatactgtgtgtactactttatgcaaacttttaaaacatatatttatttgtaggtaaaaataaataaatataggtaaataaaccaagaatttaacagtattatctctgaaagttaggattacgggtgatactaatttttcctttttttgtattttccaaattttctataacaagctcatattacttttaaaattaggaaataatcttatcaccaaagaaaaggaaaaaaaatccaagaaaggcagagatacccaattcaaagatagacaaatatacttggattctattaaattttacttttcatcagaaaggaatttaatttttaaaaattcaaattcaagtatttcagcattctaagatgaaaagaagcaaccttgctcttttattcaaataatgctaaactagttattcaaagaagaccgttatccatcttaatttgaaatccccagtaaataacaattcaccacatcccattctagttctttaataacaattttgcctgccaacaaatttatttctaatctacagttgcaaattgttctctcctgtccaagtcctgaataaatcagagaagagtttataagacagttctttgtcattttgcacttttagaagtggcttaactaaaatactgtttcaagtcctgccagcatcaagagctatggatgtatcagtcccttaaatcagaacgcagcaagctctccttaccccccaaacttttcctcctagatgtgccagagtcctgtctcttcagcactatgatgcatatctacagcctggctatgtcaggttattatcatccagtctcttaacttccccagttcaggggatggcaaactgaaattgtgattacaacttaatactcataagaagatacaacaaaaagttacttaaggtgaacataataataagacaatactttcttgaacttcaagttttagtgcctaaggcagcctagaggggtttccacatactctgcaggatctaggtaaggtagtttgcagttaccaggaacatgaaaaataaatgaactcagtaactgagttgagtcccctttactccaggtgttcacagtttacatgaacacctggagtaaaggggaaaaaaagaaagattctgttgaagagtcagtcacaatttatcatagttattttgagcgacagctctggatcaaatcttgcttcctagtgaaataccctactttactgctagcccttttgatattacctagactaattaagcacattcgtataaataaaagctacagaaaaaaattgaataatctaaattatgaaaattacatatcctggccagacaaggtggctcatgcctgtaatcccagcactctgggaggctgaggggagaactgcttgagcccaagaattcaggaccagcgtgggcaccatagtgagccccatctcttaaaaaattatgtatctaatcactacttggaattacattatatacttatatatttactttgtttgttgtctgttttttatcactagaatgtaaactctgagagggcaagaatttttgtctgcctaattcatcagtttaacttcagcatttggaaccgtgtctcaaacataatactgtctactaagtagaaacgcaataaatagtgaatgaatgaatagttcttccacacaaatggaacactatatagctattaaaaatagtatgcagatcaatgatcatgcaaagtcctccagattcagcactgtaacagtaacagccctataacttactaagttcatttatttttcatgttcctgataactgcaaactaccttatgtagatcctgcagagtatgtggaaagaaatagaaagaaggatgttgcaactaagcatttatcatttccttggtaactcttagaaacataaaaagaggagctagggaagcaggaaattacaaatgccagtatattagccatcaagaagacactggaatttctgctgaaaggggcctgtaaatctacatgcataccaagcattatctgcatttggaatttaaaaatacactatataggtatcatccttcattttgttcaattattgtgttactgatttccttaaattccttaatatttgatcattatatattttctcaataaatgttactcaaaattcaactgcaatcttttggggacttctggaaaaaaatgttaaactataaaatgttaggaaacactgttaaagacaaagaataatcacttttgaaatagtgcctacttaggtctgagatgacagaatttggcttaagccttgaaagaaaggtggaaatgagaattccatgcaattagataagaatataaggaaaagtatgggagtgggaagcccaagacaaaatcaggggcagggtagaccagtttttgttgaatgttaacccctaagctggaccctggcaggcaaatttgcctttttaccctaaagtcaagaagaggaaaagaccacagccatgacaccatggcaatattgctccaatagaaaaaaaatccctgaagtttaacctgagttctggcaggtgctgtgttggtaatagttttcccataaatcttggttgttgttgtttttttaagtttatttatagccctgaaagaacaaaattattgaacaaagtcataaaatacagcagttaatgtcaatgtataacaactaaataattgaatgggattaaattaaaaataaacggcattataaaatttgaagactacagaaaagactaactactttcacttaattccatttctgtcaaaacaaggggggggggggaagccaatgcattccaaccaaagatgttgaattccaaacatacctgtttctcttaataaagaatgaaagtatgcttgacagtattatacatttctttctgcctctgtcttggcagcattttagaagagtgaatgagaaagacttcagttctttcaaggccaggccaatacttgcttcttccttgtaactccaacttcatctaccacagcatctttgccagagtgttcaataaattttatttccattattttattcccactacatctatgttaagattcaattataagaagagaagtgaatgttttttattgataaggcaagaaggttttcagaaaaatgagcaaaataattaatgaaacatatttggagaacttaatggtctctgttttcaatataattcttaatttcatttttctctgaactatattggccttctaaagctattactgaattacagaaactggtttatttttggtagaaagctgcagtgccacttgagttccagattttaaatttttttgtaaacagttggatggattatgataaagaagaatcttggttgtttttgaaccactcagtcagatatagtcaagtgaacacataaaacacaaacaaattggtgaacaaattatagtttcacagtgatcatatgaagcctgggtaacagcttttaaaaggcaaatagtgctgtgagtagatcatttaaatatagataaaatattggaattaatgagttatgggattcaatccaaattattccaggactgaagtcttaatgatcaaatataacgaaatcatgagccatctgccaggacttttaaaacctttttgctaatgaccgacttttaattattattttcatttatttatttatttatttattttttgagacagagtctcgccctgtcaccccggctggagtgcaatggcaagatcttggctcactgcaacctctgcctcccgggttcaagcaattctcctgcctcagcctcccaagtagctgggattacagacatgtgccaccacaactggctaaattttttttgtatctttagagagacagggtttcaccatgttggccaggctggtctcgaactcctgaccttgtgatctgcctgcctcggcctcctaaagtgctcaaattacaggcatgagccatctcacctggccttaattatggttttatttcaacagattcaaaaatctaacttagttgaaatgtaggcagaaaaggaaaaaaaatgaaatgagaacacaaagggaatttttaaataattagttattctttttttagcatttgtgtatcttttataaagacaatggtgaattaatatagaacataaaaagttgcctggcagagttgttgtaataccactattcatgtacataacaatattttttaaaaatattcaaaaagtacctttgaaaagtaccttctgtggaaactattcataagatgacagaagaaatctctttgctcccacgaaattgactttattaagctgattagttgtttgagggttggctattatagtagtactacagcttgcagccatgtctaaaggtaatctaattttttaaaaaaatcagttctatgccagtcaaatcccatgcaagtcatacatgtgtgagctgcattcagtcttctggggccatcaatttgttgccccttctcagcatgatgcagtcaatattcccctcctcactacagtaaacttaaataccttgtgcacccctgacatctcaataatcttaaacattctcctcacactattagaaatgtgaggctaggagtttataaaattttccctattatctggctgtgagtctcaggcctgttgctgataacaaaactccagcttccgcagagactcattagcatcattcaggcaccatcctcaacaccagttggcagagcagcatcatcagtaacaagctcctggaacacagccagcccctcagcaaccaagctcaagttggctgcatcccagctttatggggtggcggaacatgtcggcatgaaggagagcagcagggtaaccaaacactctgaatcatgagctgaagagaggtgaccagggctaaagaaacctacagagattagccaaagaagaacttcaaaccacagctgctaatacattggctgttggaaagtacctgcaataaacatatcatactttatggaacactgtaatatgaaatgacacttttagggcagatgtataggaacctgggaaggcagataagagcccttgctcttttccatttcccaggtttatgctggcgtgcccacacatcttaatagatcacaaatgtttgctcctatcgaggtctcattattttcttcttcaaaataataccttccatcaatcacccaggaataacaaagtaatgacttaattgaatgcaaagagtctactcataccacctaaatcagctagtttatacatattgctgaaaaataggaatatttgtttgaaacccacaaagtgaaccagaaaattccgatcatctctcctgcatggtctgcctttgtgtgtactttcaaagtgaattatcaaactagtaatttgtcagtatggaacttaaattattaatatgtgaatatagtaggctatatttcatacaaactctcaccactgctgataaaattattgctaattatccaagaactttaaagagcatgaggattttaaagtcattaaaagggaagctttcaggcagaggctggatgactatctgtcaggtaaaatttcctgcattggatgaaggaaaaggtggcagggaatggacttggtgatttttccagtctcttctactacagggtatatgtattacatgatgtagcacagccactgaattataggtgtagaattttcaagaaacacaatatagtggtcctatgcacaattatgttaggtacataaatagcccagaaatcagtataccacatttaatttttaatttatctcagtcaaatgatttactgatttccatattacaaaatgttttgaaattatacagaacataacttatagtctctagatgttgacattttaagatatcaggacatacaaatcatattatgctaatgtgcaacaaattcaccactactcatgtgaatgatgacatggcagttatgtgtataaaataaaattacgaacagggttcaaattactttagtctggctttgaaatatatggtgaactttcataaggctcatttattgataataagtgctaccctaagcactttacatctattatctattttactccacacaacaaccatgtgatggaggttctgaggctagaaagatgcagccacttgctgaaggtcactcagttaataagcagcagagcaaagacttgaacctgctttggagactttctaactccagagcctctcacctaacactcacgacatggcttcctttttgcttccttgttttcttacttgtaggcaacattgaaattactttggttgctgcagtttatgctattgaacgtgggacaaggttttctgaagtctgcttggctgaccaaggaaaactaatttgagttttaaaatgtgaagtgaatgaagttggcagagctctgagaaattaggtacacatactgctaccattgtaaatgggatcaatatttccaaaagctatctataacatggaatgagagctataaaacttttcttgccctttgactcagtaatttcagtctttggaatataacctcaaggaaataacaccaaagaaaaaggtaatttgttcaagatgttcattcaagggctatttgtattagtgaaacacaggggaaaaatccaaattctcactaataggacagtgactaagcaatcgaggctctgtagaaaaagaaaagaagaaaattttatgatctcccaaaatgacaaatgtagaatatattcgtatgtggacgcatatgtaagaaataactgggttaaaacgtagaatgcaaattagtacatataaggataaccttgtacacccaagtaaaagagtatgtgtattaataaggcaagagattcatgaacttataaagaaatatattccccttttaactggagaaatcccaataagggaggatcatctggcatatacattgtatttaataaaaatttatctttaaatgaggacaaacacaggctatttattcatcccatgctataacaaggaagacagtcaccatctcttgcatttggaacactcaaaggggagtgcacaagttttacggtgaaaaaaatagaagactttaggtatgttctaagtggaggttgttggcatggggaagctgaaggcagggtaactagaagcacggcattttaggtaatgagttcagggaatatatttggcttttctctcagtggctctgagttgtaagtatgcaggggtggagggcatgatgagagcaaaaaaatagggaaggtggcggtcattgaccaaatcctggctgtgctaagctgattgctacagagactgtgatttggccttctaagctgcctgctgaagagaatgtgggtctgtcattatatgtggactggtcattgtccatttgtatacccaatctctcatatagaagaccagtttataattttataaaaggttgtaactcagaaacagccagatggaagagatacatagggcgaggtataggggaagaggtgcagagcttctgatccttctctgggtgtgccaccctcccagctaccacctttcagcaacctgggaggtccacttgatatgaatgtatagacttaaattagacaaaggtaatttttaaactgaggcctgactgacatacacatgatacctcacatgtattcacgtgctgtcaggaaaagctaatcaatcgctcatgagaacttactaagtcctaagttctcttccaagttctttccccggattctctcatttaatctccctacagccctgtgagtaagtgttactatcacccctcttctaagaggagaatattgtggcccagagaagctaagtaacttgcccaaggttactgaggccatggcagagatgtaatttcaacccagatagactcaccatatggccagtacagccattatactttgctgtcttctcttatttggaagaaatactttcccgtgaatcacttctagattttgtcttctgcttttctccttcaccttttctgtttggtttgcaatatataggatcctttcaggaaataacaatacccatacgcagaagttgttgagataaaatactctccagctggtgccacctgcatgaacacaatctacctgcactaactggtaggacttcttacaagaagcaaaactagagtagggttttcaagtcaggtgtgggagttgtagaggctggaagataaaatgccactgtggcacatgggataactacagaagagaaaaatatatcatttcaagctagaaaatattcagataaggctgaatctaagaaaaagttgcttggggataagtgacaaattaagaatattttaaaactcatagggaaaatattaattatttaaaaaaattgtattttacacttgcctagtttcttgtattttgcaaagtatttctcattgatgatcttatttaactctcctgctatagagtggtgaatagtatagttgacagatgagaaaacttcaggtcagaggtaagtgtgagctgtgcatccaagcagctgcctgtcattagctgagctgggactcagtcccaggctctcattcttaatagaactaaacattgatgctattcaagaaaggtacagagtcctgtgcaaatcttccctttaaattattcacagctcatgaagctctatctcacaggtacaagtccattaagaaaagtccagaaaacaaatctaacataaatggaatcaaagataagaactaaatatataatgagttccttttaaatgaaggcagcagagcaaaggcaggactaccatctgtgtacaaactgaactgttaggggtatggtatgggtatgtagtggttatatttggaaagacgcaaaacccacatccttctacctaaatctgtataagaggcacatcatctcaggactctgccatctatgatacaaaatgcacaaaatgaaatttctgctttatcttacattccatggaaatatctttattggaataaagtggcctacatttatattcacttctaaacaacgtcctctccttctcatctgtttctgtctgatggaggcctatttttgcttcagaggacagatcaaataccgcctcttccaggaagccttttcagatccaagtgagaacaagcctgtctttcctaggcgcccccagcctgtctgagaacaacttgctgatgattcttgtctcctgccttgtgtagctcctggatgacataacatgattgggatttatctttgtgcctcttaggatcccaatacaagtgcctcataccccatagcattttacttcattgtaagaaatcttttgaggtcctatcatgctctatgaattcaaaaacctttaaggagagttgggccgtctcaattccactataaaaatgacctcaatcaaggactgtcttcacttaaaaaccttcttgtttccttacaatcatatttcatgttgaccttctgtgccagaacatttgcattaatttaatgcatttgtaattagcattggcaaatgacaaacccacatccagaaggttaaattataaagtgttttttaattaaatagaaatatgagagtcatcaaacttaaacaaactaatttgagatttgcttttagcgcatattttataaatattcaaccagattttattcaatataaaggtagaagcttcaaagccagaacttcagttctttgaggactctctctcttttaatataaactggtaaataaactactagtgaaagaacttaaaatttcagagcaaaaagtacattacttccaccaaggtcaattactcttcagggacaaaagtaatgttctttttattagcaatttgaaataacaattaaataacattcgtttttattgagatttttatataagaactgagaaaacaattctttgttgtagttataaaaatataggagaaagtgctgagtttctgaaacacagcaatcttcctatattttctatcttcccttaggccatgtgtggtggagttgtgatccttatcttacttataaggaagacaaagaccagggaacaacaagaatactaccgaggcttataatgaaaagcaagctacaaaaaaagatgaagtaattattttcaattttaccacattctatgaaatatcgaaaaactcccatttcattttgtataccatgagaaaaagctctttgatccatgaatgggctaatccaacagctattcacataattcctgtcttttaaaggagaatagcaatcaatgaccaagaagaaaagtacaactcacaaaaggcatgaaatcttactttttcatcatcttcagtaaatggagctccttcaggaatcttatttatcgcttgggccacaccaataatctcaccatcactgcttcggataggcatgcacaataatgattttgtcttgtatccagttagcttgtcgatttcatcattgaatcgtcgatcctaaaaataagacaaagaaagcattaactgcatgtgcattgttgtcagggagaaggagagagaggtttatttctgcatatgataccttatcactgggaactagccccatgaatttttaatcacaataacagatttgacttcatttttaattcaccaaaggaatataaatccaaataagtcaatgccatagttgtttgccatagtaaatgaagagagagactttaagcccaaccgcaacacatcaaaattggggaaacgtgtttttaaggaaagcgatttatgtgatttatgaaaacatgttatttcaaaaagacaggatatgaaatgtcatataagaaacttacatgagaaatatatactaaacactgaaaaattgttcaatatagagctactttatttctggccaaaatgatcctgtgaaaaaaaaatctatgagtacataatgatatttcaaaatcctcccaaaaagatgtggggtatggggagataaaagacttctctatagaatgccagctaaaatatataaaataaatgataaaattatacaatatattttgcaactacctatataattatgtttacaagcaagggtcattaagtatgctaataccattgggtgaaaattgtttaacttaaacagtatagtcacacagtctcaaagtgccacacccaaagattccttattacaaaggtaaaaggtgtctttgtagtgaataaatctggtgaacgctacctcaaacaagtaaacttagcatcactctttagaagaaaaattaacaccatgtgcctcctgatataatgcaatggaaaggacacaacatcaccaagaatacagtgttcttgtcaaatgtgtaacgtgaatctaattattcaagaaatgaaaattaagaaatgtagaaatcatcagtcattctatcagaaacctaacgctggatgcttaaaaaatgtcaagatcatgaaagacaaaaaaaaagtttttttaaataaatataaagttaaaccatgggagctataccaatttaaagaagactgaagagacctgaaatccaaataaaatatgtgatcctttactagaaattccgaaaattccacaaaggatatttctggagggacaattggagaaagttaagtcagataattatatcattataaactttcttaagtatgatactggtgttgtaattatgctgcagaatgtccttattcttaggatatacatgctagggtatttggggagtgaaatatcataccttcaactcactttcaaggaaggaacgaatggatggaaggagggagggagagaagggaaggagagaggaaaaggagggtggaaggaaaaaaagaaaaagattggctcctgagtaactgtgactaaaaatgctccaaggtagatgataaactggatccagtctgatgataaactatttcaagtcaggggttggagtgaggcttcttcctgtaccttctgcacacccctgttaaaggaggcttaaaagacaaaaacaaagcactggtgcctatgctatgctattctcgctctgtcacccaggctggaatgcagtcatttgatctcggttcactgcaacctccacctcccgggttcaagcgattctcctgcctcatcctcccaagtagctgggactacagatgcaagccatcatgcctggctaattttttttttttttttttttttttgcattttagtagagatggggtttcaccatattggccaaggtggtctcgaactcctgaccgcaggtgatccactcgccttggcctcccaaagtgttggaattacaggcgtgacccacagtgcccggccaggagtctttaaatgccattatgaggcctggctctggtctggtgatccatggaggccacactaaaccccagagagaggagagtccaattaaagagagggaaatcaaaacccaaacaaaaccaaatctcctgctcaaaataagtatgtgaccaaactttcagaaaatcagcaatctgtattaattatttttaaatttctctgaggaactactacatgtcaggctatgggctaggtggaagttgcaatcaagtaggtgaggcagacaatgtatagatgtatatttatatattgtggtaagtgttactgagaaaaaagcaaaatgcgtgagagagactgaatatgaaggacttatttttatagggatcaaggaagttctctctcaaaacagaacaaataagccgagacttcaatcatgagtaagaattttctaggcaaagagtggtggaaagaactttccaggaagatgaaccaatacatataaggtcctgaagcaggaaaaagcttaataagttccaaaaagtcaaaggtcaatgtggctagagtagagggagacaaagggagagtgaaagagggaggcagtgaccaaatggtgccaagtctcacaggcctagaaagagttatatttaatcccaaatgcaatggaaaacctttgaagatcttgaagcagaagaatagcattggccactatttagcacttagattctctgcaattatcttaccagtttacttgttctcctcccaactaaaatataaaatctaagacagcagagattttgtctctcctatttactgcttcattctggcatgcatattatacatgcacaataatattttttaaataatttattcttttgaaaagattgcattgcaattatgcagaatatagaaaagttgttaaggcgctaaggcgccacataccactctttggcatgtatgtagagacatttttccaaatatatagaagagaggtacacaaatgttcactgcaacatcaattatgaaaattaaaaacgtgaagccatttgaatgttgatcaagagaaaaataaattatgatcttgtggtttggtagtgtattatacaacaatttaaatgaataaattagagctacctgtatcaacatgaacaaatgtcaaaaacataatgttaagtgaaacaaacaagcagcagtctgatacaatctatataataccacaatacttaaaaataatactaaatatcatttatggattcaaatatgtagcaaaagtataaaagcatgtaagggaataataaacactaaatttatattagtgattacctgtggagaggaaggaaggaagtggcatcagggagaaccacagaggaggcttcaactacaacaagaaagcttacttctttagaaaaacaattcggggggccaggtgcagtggatcacgcctgtaatctcagcacgttgggaggctgaggccggcagatcacgaagtcaggagttcgagaccagcctggccagcatggtgaaaccttgtctctactaaaaatacaaaaaattagccgggcgtggtgccaggtgcctgtagttccagctactcaggaggctgaggcaggagaattgcttgaacccaggaggtggaggttgcagtgagccaagatcacgccacttcactccagcctgggcgagtgagactccgtctcaaaaaaaagaaagaaagaaaaacaattcaggagcaagatggtggttctctggaggttgagtgtaatctgtggcacccaaggaagctgatctctgttgctttgaaccccactggtcagacctgccatgtctcagcacatccctagggccaacctaccccaggatggtgtggagcacagcatgttcacctgccacccagccgccattctgtttccaaggctgcgtctgtccactggactggtgacggggttgtcagtgtttagctcctgcttccagctgctgctttgaatccttgctctgcgatggactactccctggctacagccctcactctccttagtcactaagactttgaacaagttgtttcaaactatgtctatgcagacgcatcacggaaagctgccaaggcaggccttttggcacacttgactttaacctttgccgggctttgtgatttcaactatcatgatgggggcatctggaaagctgttgccatgctgtggaagctctgaccttttagacttaacaccttaaaaagtaattcttaacaccttaaaaagtacttatctttgcctctgctctgccatgccattccactaacaataaaaaggaagtaacagataagttcattgttgagacaaaactctttggtgcaatcatagctcactttcatcacccaaagtcctgggctcaagcaatcctcctgcctcagcctcctaagtagctaggactgcaggtgcacaccaccatgcccagctattcttttttattttttgtagacacagggtctcactacattgcccagtctggtctcaaattactggcctcaagcaaccctcccactctggcctctttaaacgctgggatcacaggtgtgagccactgctcccagcccagaatttaatctttgaggaaaagtttgagaggatttgtattcaagaaactgtgcaactgagtcccattttctggtgagttaatgagatttctttcccagaatcagagtataactaaacattatatatgagcttttgcatcttcatttaccaatctcttaaacagaattcagtttaattactaaatatgtgatcaaacatctcctgtatttttcctgataaggatagacaaagagaaagactgttaattcatgcacaaagactttgcagaaaattagacaatatttaatttttgaaaatttccccctctgttcagttgatatcagctactgatggttccatgtccttgggaaacattaaaattagaaaaagctgatatctcacactactaatttctaaatcctaagaagaggagcttggaaagctgctgaatatagagaagttccgtttagggaagaagtctcctttgtaattgtatgaaaatatcaaacattctaaatgaaaacttaatctctcaaatatgtttattttacttgtcttaaaacaatctgcctacaagtataaaagtataaaaaattgttattttcccatttgaagttttctaatataaaaatatattctatgaaataaaatttctaaaaataaaatgctatataataaaacatattcgactcttttatgtaaaaaaagcccaatgtagtaaaatattaagattttataaacctagatggcttattcttatctaaaattaagaactttgtggaggatgacacagaattgaaatagaccagttgggaaattttggtggtccaggtaaggtatgaggatagtctgggtttaagaaaaaggcaatgagggtaaagagaagtagacaaatatgttggaagttgagtctgtagtacttcctgatgaattggttgggaggggagaatagacaaaagacaatgagcctcagattttaacttgagaaaccgtggacggaagtatcatttactggaatgggggagattgagataaaggtgaaagtctacatatgaagagagtagaaggttgataaatcaatttattaaacaaggtgaagtgcatctttgaccaaaatcagtggttgttccccctgactgcatctgaaaattaacttgagaaagtcatcacatatggaatcaatcattactaggcattggtatttttttaaatgctcctctgttatcctcatatgagaaccactgtcctaaatgataaagactttagtcattagtgagagcaataaaacctattgatgggaaatgccttaaaatggggaggaacaagaagagtggtatgtattctgatggttgcatatcaatggtgttggccatgatggaatggactgaaaatccactctgcagtaggaacagcctgtttgcccttacctttgtgataatctgcatctctggagaagggtctcttaccgaccaaaactcaactctgagtctgagtagaccaaccaccaaggctatggagtaggttgctaccccattgctaaagcatccaaagtcacatgagaacaatagacactgggatgctttagcatgacaaggagtcacaaaaatggtctaaactctccccaccatctcctcacctctctaaatccacctgataaactgataacttaaagagaaaatgtggcctggagcagtgcttcatgcctgtaatgccagcactttgggaggccaaggtgggtggatcacttaaggccaggagttcaagaccagcctggtcaacatggtgaaaccccatctctactaaaaatacaaaaattagccaggtgtggtggtaggcgcctgtaatcccagctactcctactcggcaggctgagtcaggaaaatcgattgaacccgagaggcagaggttgcagggagccaagattgcgccactgcactccagactgggcgacagagcaagactctgtctcaaaaacaaaaaggagaaaatgtaattgtattaatacatgtggtaagtattaatcttttaatttaaaataaaagctaggaagaaagattttttctattaagtctttgtttttttgtttttttgtcttggtgtgtgtgtgtgtgtgtgtgtgtgtgtgtgtgtgtgtgtgtgtgtgtgtgtttgagatggagtttccctctttttgtccaggctggagtgcaatggtgcaatctctgttcactgcaaccaccacctcccagggtcaagtaattttcctacctcagcttcctgagtagctgggattacaggcatgtgccaccacaccaagctaattttgtgtttttagtagagatgggggtttcaccatgttggccaggctggtctcgaactcctgacctcaagtgatccacctgcctcggcctcccaaagtgctgggattacaggcatgagccaccgcacccagcctccattaagtcttaatggttttaaaaaataatgcatcttaggacatgctttgtctgtgtcttcattacactacttataagataattctcacaaattaactcaaaacttgataaaatcaaattaatctaatgggagatcagaatcgctgatacaattatgtactttcttaatatatacataaatctgtagattaatcttccaattaaaaacaatcaagaaagctgagtcccaaattgaggcataaatgaattatagtagatgaagaaaattaggaaaataattagataaaggaacatgttactctgatattatagaaggaacaaaagtttaataatagatgaaattaaaaaatagatttaactagccaagtaatcaccacaaatgagtataatagtagaggaaacacatagcattacggaacacaacagcagggtgccacaactagtctaaggtcagacaatatctcccaaagaaagtgaagtgtttaaggtgatacccacaggatcaataggaattatccagaaaaaaaggagagaagcattagggagaggtggaagggagtgtcccagaaagagggaatagtatctctaaagtccagaggcaataaacgctggttaatttgaggaatagaaagaagttgaagatggctcttgtgggaagtgtcagacatggggtaggaaagacagctggaggctgatgagagggtgtctagtaactaggtgtagaattgtaaatttatcatagaggaagcgaggggtcactagagagttttaagaaggtgagtgggagtgatatgactgagtcttcattttagaaagactgctgtggctacatgtaaagaatggattggaagcaagaggtccaggtgagagatgaaccatctctgggctgggatggtggttagtggtagtaggagtggtggaaaatggactgagttgagagatatttaggaggtagaatgaatagaactgattctatgctgattaatttggaaggctgtgaaagttagagaagtgaaaatgactccatatttctggtgcagatgtctgggagggtagtgggatgattcactgagtgaggaacgcagtaaggaacagattctggggaatatgagtttcgttgtggacatttcaaggtttagttgcctgtgggtcatccacatggtacagatgctcaaaaagaagtttgatagatttagatatagatacagacatagacgatttttttttttaatttcaggaaaaggacttgaaatggaaagtaaaaattgtctaggtaaggatgggaattttgcctaacagcttttaagcccaggatcttcagaaggtcatcacaatcaccagcagagcttcacagaaggccaggtaaggaggaaacaggactagtaagaaggcaaaaaatgtgcttgtttctgaaaatggaaacttgaataggaaactaacaaatgcctcaaggattataatgaaatatcatatggagaatggtgcccaatttttactcatctcccttgggacaaaagaacaagaaatgatctacaacaggagagatttctaataaattaaggtaaagtaaagttgttaaaatctggaatgagctgttataattgtggtagactcttaccgctttgagtatttttatgtcataatattttttctatctcagatattttaagtacaactgctcttgagaagtgcagaaatcttttccatgccttttatgcagatctgtcttttgtatataacacgcagccatgatttttaacctttaaaaagacaaagtcacaaggccaaaagcaatttttacttctcagtgaaggaactgacctgtgcctccttcatagagaacagtaattggatacatttctgacccaggatcttgcacttgcaaacccatctgcaagtttctgagttgaatgtggtgccatgaagcacacccagaaaaaggattcccaccttcaagatccacaaaggctgtaaaaagcaacctctgaactcagctttcatgtctttgagaaagaattatatttaatatgctcaagaatcccagccagccccaaaaaaacacactttagaggtacgaaagaagcctcgaagcaaaacaaatccatcttctctttctactttctcagagaaatcactggaggctccctaaggcaagattcagagttgagaatcttatccaggtcccacattcatggcaaagatgggttgcctaagatctcttttattccctctgtatttaaggactctatccccaatactttatagtaaaattttccagtactcatgattaagccaagaactaatcttgaccaatgtttaatctacaagggtgatttttaaaaaccagaatcttgaatctaccttaggtccttcatagccaaaatgctcaaactgttcaagtctaagagtgtccacatgatgtaattatgtttcctgaacatacttatgaggaaatatgtaatgacaaaagcccctattaattccataacactttcaaatgaccttgtctttgagttacaaaatatagctcaaaaattataaagttataattgtaaattgtggagaagattacagagaaaaattataaagaaattagagagaaaaggtgaaataagatatgcatgtatataaggtattcttcggcctacagacacttagacatacataggaatagaacagagcttggcagtccttgttaatactggaatcacctgggacctttaggaaagtactgatgttttagccccaccccaactaattaaatcacaattggtagggggaggggccctggaggggatctgacttctggctgtttgtcagggtagggttaagaaccactgaattagagggtcacttaataaatccaaggcctcatcaggcattcacgcctgtaatcccagcactttgggaggctgaggtgggtgaatcacctgaggtcaggagtttgagaccagcccggctaacaagctgaaaccccatctctactaaaaatacaaaaattagccgggcatagtggtgcacacctgtaatcccagctactcgggaggccgaggcaggagaattgcttgggcccgggaggcagaggttgcagtgagctgagattgtgccactactctccagcctgggcaacagagcaagattccatcttaaaaaataaaaataaaaaataaaaatccaaggcctctggggtctgaagacaacaggttataaaccatgctttagagatttagcttttgttttattttgtcttttccatacactttccctgaaggcttcatgaactaggcctgcatacctttttcaacatcatattagcccattgccccaccaaaagattcagagaaaaagttcagtctcatatttcatctacatcctgtttcaaatgccttatggagttgtaatgtagagaagttaatggaaataaaaaaacataaaatgaataatccattgaaacacaaaccaatagattgccaaactttctgaagctcaaaaaattgcttttattgctatatcatttagtaatactcatttaattccaattcataaaatcatctccttacacttatgacttatcagtagacatcacttattttccagaaaatgcttggaaggcaaagctttcgaaaattgattagtctttaatgacttgaaatctattattcttactttcttcatagaaagaagaactaattgttctgaattgatggaagacttgagattacactgcataaaaacaaagacacagcatgtggcaactacatagctcattctttaggcctcctaatttgatatttgctgagaaaaagtgaaaaattatcattgttgttcttaatatgtatttgcagaatttcattgctgtacagtaaacaaaaaagaatctccaaattctttcctaaagagttctaaatagtacaaaagattaccaaaaattgtttctgaagcttcactcttttatggacctgaagtggtgtagttggaattggagtattttgtacattcacataggtaagctctacttgctaaatgtttaaagggcatacctttatttaagtctttcaaatagaattggtggttgatagacaccatcaaataatttgatatgaagtttcaaaacagttattgtgattaccatgttgtttggggcattatccctttttttagtcacgttgctaaagtaaactttgtttgctgatcttatttccctctgttcttcctttcttagttggcacttttctttggtcctgtcttatcatcatgattattattatttctctttattacaataaatacaaatacaaatctcaaggcaaaatacacaggaaaatgaagacccacaccacacttgaaaccaaagcgcaactgacgtagtaaaaaagaaaatgatgaattcttaaactgctttaatagacagcccagatatctattaccgtaagtctgcaaatatattgtacctagagttaaaatgcaacctcatgctctataagctttattgcatataaggaaaatgtctaagaaaaggccagtacctgaagaaagagttatgggaagggtcagctaaccagaaggcacctttttttctgacacagtgagaccatctaagaactgcaatgaatcagggaaatgaggctctaaggtaaaaccaggaaggccaggcagtctgcaaataaggggaagggaactatcagcatgaagctgtgattcagacaccagacaaacagtcagaaagtagagaatacagggcaagccaaggtcaagacagtgatgcatgaaaagccaggtccaggtcagaagaacagatctaacagtgagacattggagacttggtctcacccattcatcagaacctaacacagactacctccaacagagagctttggaattcttcccactgaagacaactgagacaacccgaaaagtggcccaaaaatgtaactgatatgtaggcagctatctcaatcaaatgctgatccttcccacatttatggcaaataccagaatttatagagtcatagtgatatgttatattttaattacataatttgtttaggttttattgttaatatgcaaaggttacaattcctctttgacaaaagtttaatgttaaaaagtaatttttgaccgggcgctgtggccaacacctgtaatcccagcactttgggaggccaaggtgggcggatcacttgaggtcaggagtcaagaccagcctggccaacatggtgaaaccccgtctttactaaaaatacaaaaattagctgggcgtgatggtaggaacctgtaattccagctactcaggaggctgaggcaggagaatcacttgaacccaggaggcagaggttgcagtgagccgagattgcgccactgcactccagcctgtgcaacagagcgagactctgtctcaaaaaaaaaaaaagaaaagaaaaaagtaattttttaaaatctgctttttaaagttttttaggttttgaaatgttttaaaaacacatttttaaataaaatgtctatagaaataagtgtatttagttaatcaaaagagtattatttcaaatcagtcagaaaattatggattattcaactagttacatatttgggaaaaataagttagacccctatctcacatcagacatcaaaattaatttcaagcagaataaagacttaaatgtactcatctcttaataaattgcaaaagtaaaacaaaaaatttactcaaaccctgccaagacatatttcctattttaacatgaaatactatagtattaatcatttaagatgccaatatctagctttattgaaacgaccagtgaaatgtctacttttatacattgctaatgagaatataaattagtgcaataaatatggagggcaatttggcaagaagtaacaaaagtcttttaaaaatttttatgctctttaataatttcatttctaggaatttatgataaggaaaaattgaaaaatatctacatattcaagaggaaatggattatattatgatatagacacaataccactaaaaaaagcattagaatttattttacatgttataagtggttttattatgacatgagaaagttacatgaagaaaagtggtttagaattcagtaaaattagcataatttcctaagggtgatgaaattaccatctaagacagcacaatagtttcaaaagtgccctccaaaaacatagaagtcattatgctactgaattgtcagtaaaatagataggcaacatacaccagccgtcaagctggaggtgggtcgatattcataaataatttatctctatgaaaaaccatagcatcctatactttcagcaagatataagcgagtccaagctagcaatccaaatggccccggctgtttttttaaagccactatcaccctagctaaaaaatctcttatcataaaaggtccaattgacctgctacccagaatgccaaaggaacttggtggtattgcctgaaaatcacaaagaacaaagaacagaagactgtcaagatactataattgggcaatgttctgatatgtgaaatggatggatttttcaactctctcagattctgaccttctccacatttaatgtgaaatatcacaacctcttatgtggcatagcatatataatattggaaaacatcctgattttccaaaagaatgaatactatcaactaaaaaaaacaaactattaaaccagtaaatataagtttgtaaaagattgctgtgaacaagtcctccagccacagcagtgtgttccaccactgaaagcccaggttagaaaaaatcaggcatcttctactgggaaaaggacttggaagcagcttaacactacttcccaccaaccttccaggtggatccctggagctggttggttccatacacattcccttccccactataagtccctgcatccctgaagccttccttctccattcccaggccaggctctttatttccttggtgttcaccctcgcttcagctacaaataagcaaagtgccgagagtacctggactccttgcagaagttatatagtcacatgttccatcaaaaaaaaaaaaaaaaaatggggacatgaatctcttgccctataatatgagagtaggcgtgacataccaaactgaaggtgtcaacctgtggggggaagtcattcagaggatggatcccatcagcaggaatcatttgtaaataatctggataaatacaagcgtgccttttccttaaataaagcaccaaagtgctttcacataaatgtttgtgagtaggagccctctagccagacacactggagaaatgagtcggcatgtttattggcactctcatctaagctattccaccttggatagagttgattagctcctcttagaactgttctcttgtctgctgccttgtaacatgtcattttcttagccagctagcaaaatgctgcagtgtttgttttatgaactaattcaagcacctggaatagccagctaattagaccattcatatttttcaggtttgggttttgctgggctagaaagatctgatatatcggctagcatttactctcatgcaaataacagggccaggaaccattctataaatctcaattcatttctgaggtgttccagtaaaatgagcaatcaatttaaccgactagaattcttcactttaggatctgcatagtacggaacaacagaagcagtagaaattgcaacaagccctaggctaccaaagtctataagactcctagatactccttcagatggcatttcaaaaacaaattgaaaaatttcatagcttccaagtccctctgccttacttaagaaaggttatcttataggcatcattggatattgtcttccccaccataagccacccatcagcatgctcacgtacatctgatacatctagctacactgcacccaacaacaagagatttcatataattagttccatgattgacatgaaaagtttatgaaaattcaccaaaagctaagtcatcaggttagccagtttgaaatcaccatgtcaaataactgatatcacacagaaaatataatttaactccaatgcactttagttaggaacaataataaaaagataactagtgaaatcaaatatttaaacatttagaatacatttctgaattacccatcaatcaaaaaattaaaatagaagttataaaatacttagaaaatactaagaaaaataatgtctaaatataaaaataccaggatgattacacatcatatatcaaaaccgtggtccacagttaaagagttcttaaaggttctgttgtaaatgcttacctcaggaaaaaaaaaatgttcaacttaataatcatccaaccataaggagttaggggaaaagaacagcaaaataaattcaagaaaatggaaaaaataatacaaataagagcaaaagttaatgaaaatggcaggaaatatatattgaagacaattgaagacaattcaatatatattgaagacaattggtttaaatgtttttccccctcaaaactcgtgttaaaatttaattgccattgtgatgatattaggaagtgggacctttaagaagtgtttaggtcatgagggctctgccctcatgaatacactcataccattatcacttgagtgggttcattattgcagaagtgggtctgcctctccccagcactctttgccctttcaccatatgatgccttccaccatgttatgccacagcaagaaggccctcaccagatgcagacaccttgattttggactccctggctttcagaactgtgcactaataaatttctgtttgttataaattaccgagtctatggtattctgttatagcagcacaaaactgactaagacaaaaattaacaaagttcaaaaaaagaataacatatgaaaatctctagagagaataatcaggagagaaaaaaaagagagaggccttatattttaaaaaatcaggaataaaatggggctaaaactacagttgctacaaagattaaacaaatataatggtgttatgaacaactttgtgccaataaatttgaaaagttagatgaaataaatagataaaaacttatccaaaaaatctttcaaaaaactagagaacataaagagtcctataagctttaaataaattgaatcagtactttaaaatattcccgttaaacatacacacacatcctcagatccagatagatttctaggaaattataccaaacatcatggcattgggcaattctaatttattacaaactattccaactaatggaaaaagaaagaccattctcccagttcatttgtgatataactttgctttcaaaatcagacaagagtattctaagaaaaaaaaaaaggctgggcatagtggctcacacctgtaatcccaacaacttgggaggccaacacagaaagattgcttgagccctggagtttgagactagagtgggcaacattgtggaacactgtctctataaaaaatttttaaaaattagccaggcatggtggcatgtgcctgtagtcccagctacttgggaggctgaggtgcagggatcacctgagcccaggaggttgaggctgcagtgaatcttgtgattgtgtcactgcacaccagcctgggtgacaaaaagaagaaaatataaaaatataggccagtcttgcttatgaatggatatagatgcaaaaaccctaaaaaccaaaatttttgtgaaacaaatcagacaatacataaaaaaagatcactttttataaccaagttgatgtttcctaggaatgcaagattggtttaatatgagatcaattaaagtaattcaccacattaatagtgtaaggtaaaaaaattcatatctttataaaggcagaaaaagttaataaaactctgcattctcttattattttaaaaataacagcaacaacctccttagcaaactgggaatagaagggaactttcttaacccaataaaggggatctcaaaaaacccacagaaacctcatacctaatgattaaactgaaagcattctctataagctcagtttcaagacaaagagacctgttataatcagtcttgttctacatgatactggaggttcttgcacagtaggagctaagaaaaagaaataaaaggtaaaggattgtaaagaaagaaaactgtcattatttgcagatgatatgattgcttacacagaaaatcttaaacaagctacagataaaaatttaaataagagttgttggattccaaattgatacacaaaagtaaattgcatttctagataaacacaagaattgactaaaaatataattttttaaatatactgtttaaaatatcaataaacatttttaaatacctaggatacaatatagcaaagaatgtgtaagacttttatagtgaaaactaaaaaaaagacttaaaagacattaaagaagattaaattggaaaaaaatatatatcatattattgggtaggaagactgactctcatacatcagtaattccccctaaactgacctataacttcagtgcaattccagttgaaatcctatcagagtgtgcatgtgtgtgtatgtgtgaaactcaacaggctgattacaaaactgacatgaaagaataaagggccagctgaagccaagaccctcctgaggaagaacaagtcataggggttggggagaagattcaccctactagatattaatactttctataagctacagaaattaaggcagtgtgatagtaatacaggcatagattaatagaccaacagaataatagagagcctagtaaaaaacccatgcacatatagaaaatggatttatggcaaagcagtcatcacagatcatgagaaaagatgaacttctcaataaatgaccctaggtcaattgcttattcaaatagaaaagaaataaaattgtattcatatcctacaccctaacacaaaaaaggaattacaattaaactaaatacttaatatgaaaacaaatttataaaaatttccaaagacactataggagaatatttttcttcataccctgtttcaagaataagaacaaaaatgcaaatttctataagatcaataaatcaagtagtattaaaattaagagcttgggctgggcgtggtggcacatgcctgtagtcccagctactggagaggctgaggcaggagaattgcttgaacccgggaggcagaggttgcagtgaaccaagatcgcatcaccgcactctagcctgggcaacagagcgagaccccatctcaaaaaaaaaaaaaaaggacttgggttttccattaagaatgaaaagcaacagtacaccagctctgctaagggacagaatgcctcctcaagtgggtccctgacccctgtgcctccttactgggagaaacctcccaacaggggtcgtcagacacctcatacaggagagctctggctggcattaggccagggcctccctagaatgaagcttccagaggaaggagcaggcagcagtctttgctgttctgcagcctccactgatgatacccaggcgaacagggtctagagtggacctccagcaaactgcagcagacctgcagaagagggacctgattgttagaagaaaaactaacaaacagaaagcgataacatcaacataaaggacccccacacaaaaaccccatccaaagatcatcagcctcaaagatcaaaggtagataaatccatgaagatgagaaaaaaacagtgcaaaaaaacaactgaaaattcaaaaaaccagaatgcctcttctcctccaagtggttacaacccctctctggcaaggacacaaaactggatggagaatgagtttgacgaactgacagaagtaggcttcagaaagtgggtaataacaaactcttctgagctaaaggagcatgttttaacctaatgcaaggaagctaagaaccttgataaaaggttacaggaactgctaactagaataaccagtttagagaggaacataaatgacctattggagctgaaaaacacagcacgagaacttcctgtagcatacacaagtatcaacaaccaaatttatcaagtgggagaaagaatatcagagattgaagatcaacttactgaaataaggtgtgaagacaagattggagaaaaaagaatgaaaaggaatgaacaaagcatccaggaaatatgggactatgtgaaaggaccaaacatatgattgattactgtacctgaaagtgacggggagaatggaaccaagttggaaaacacacttcaggatatcatccaggagaacttccccaacctagcaagacaggccaacattcaaattcaggaaatacagagaacaacactaagatactcctcaagaagagcaaccccaagacacataatcatcagattctccaaggttgaaacaaaggaaaaaatgttaagagcagccagagagaaaggtcaggttacctacaaagggaagcccatcagactaacagtggatctctctgcagaaaccctacaagccagaagagagtgggggccaatattcaacattcttaaacaaaaaaaagttttcaacccagaatttcatacccagccaaactaagcttcataaggagaaataaaatcctttccagacaagcaaatgctgagggattttgtcaccacaaagcctgccttacaagacccctgaaggaagcactaaatatggaaaggaaaagctgttaccagccactgcaaaaacacaccaaaatataaagaccaatgacactatgaagaaactgcatcaactaatgttcaaaataaccagctaacatcatggtgaaaggatcaaattcacacataacaatattaaccttaaatgtaaataggctaaatgccccaattaaaagacacagactggaaaattggataaagaatcaagagccattggtgtgctgtattcaggagacccatctcacgtgcaaagacacatagggtcaaaaaaaaagggatggaggaatatttaccaagcaaatggaaagcaaaaagaaagcaggggttgcaatcctagtctctgataaaacagactttaaatcaacaaagatcaaaaaagacaaaagggatcaacgcaacaagaaaagctacctatcctaaatatatatgtacccaatacaggagcactcagattcataaaagaagttcttagagacttacaaagagacttagatacctgcacaataatagtgggagactttaacaccccactgtcaatattagacagatcaatgagacagaaaattaacaaggatattcaggacttgaactcggctatggaccaagtggacctaatagacatctacagaactctccaccccaaatcaacagaatacacattcttctcagcaccacattgcacttattccaaaattgatcacatagttggaagtaaagcactcttcagcaaatgtaaaagaacagaaattataacaaacttccctcagaccacagtacaatcaaattagaactcaggattaagaaactcactaaaaaccgcacaactacatggaaattgaacaacctgctcctgaatgactactgggaaaataatgaaattaaggcagaaacaaaggagttctttgaaaccaatgagaacaaagacacaacataccagaatctctgggacacatttaaagcagtgttgagagggaaatttatagcactaaatgcccacaacagaaagttggaaagatctaaaatcggcaccctaacatcacaattaaaagaactagagaagcaagagcaaacacattcaaaagctagcagaggacaagaaataactaagatcagagcagaactgaaggggatagagacatgaaaaacccttcgaaaaaaatcaatgaatccaggagctgtttttttttaaacattaacaaaatagatggaccactagttagactaataaagaagaaaagagagaagaatcaaatagacacaataaaaaatgataaaggggatatcaccactgatcccacagaaatacaaactaccatcagagaatactacaaacactactactcaaataaactagaaaatctagaagaaatgacaaattcctggacacatacaccctctcaagactaaaccaggaagaagtcaaatccctgaatagaccaataacaagttctgaaattaaggcagtaattaagagcctaccaaccaaaaaaagcccaggaccagatggcttcacagccaaattctaccagaggtacaaagaggagctagtatcattccttctgaaactattccaatcaatagaaaaagagggaatcctccctaactcattttatgaggccagcatcatcctgataccaaaacctggcagagagagacaacaaaaaaagaaattttcaggccaatgtccctgaagaatattgatgtgaaaatcctcaataaaatagggcaaaccgaatccagcagcacatcaaaaagcttatccaacacgatcaagttggcttcttttgtgggatgcaaggctggttcaacatacacaaatcaataaatgtaatccatcacataaacagaaccaatgacaaaaaccacatgattatctcaatagatgcagaaaaggccttcaataaaattcaacagcccttacgctaaaaactcagtaaactaggtattgatggaacatatctcaaaaaataatagctgtttatgacaaacccatagccaacatcatactgaatgggcaaaagctggaagcattccctttgaaaaccaacacaagacaaggatgccctctctcaccactcctattcaacatactattggaagttctggccagggcaatcaggcaagagaaagaaataaagggtattcaaatagaaagagaggaagtcaaattgtctctgtttgcagatgacatgattgtatatttagaaaaccccattgtctaagctccaaaactccttaagctgataagcaacttcagcaaagtctcaggatacaaaatcagtgttcaaaaatcacaagcattcctatatatcaacaatagatgagcagagagccatgtcatgagtgaactcccattcacgattgctataaagagaataaaatacctaggaatacaacttaaagggacgtgaaggacttcctcaaggagaactacaaaccactgctcaggaaagaagagaggacacaaacaagtggaaaaaaattccatgctcatggatagggagaatcagatcatgaaaatggtcatactgcccaaagtaacgtatagagccaatgctattcgcatcaagctaccattaactttcttcacagaattagaaaaaaactactttaaatttcatatggaaccaaaaaagaacctgtatagccaagacaatcctaagaaaaaagaacaaagctggacatgtcatgctacctgactttaaactatactacaagtctacagaaaccaaaacagcatggtactggtaccaaaacagatacatagaccaacggaacgaaaggagacctcagaaataacaccacacatctacaatcatctgattttcaacaaacctgacaaaaacaagcagtggagaaaggattccatatttaataaatggtgctgggaaaactggctagccatatgcagaaaacagaaactggaccccttccttacaccttatagaaaaattaactcaagatggattaaagacttaaatgtaaaacccaaaaccataaaaaccctagaagaaaacccaggcaatacgattcaggacataggcatgggcaaagacttcatgactaaaacaccaaaagcaattgcaacaaaagccaaaattgacaaatgagatctagtcaaactaaagagcttctgcacagcaaaagaaactatcatcagagtgaacaggcaacctacagaatgggaaaaaatgtttgcaatctatccatctgacaaaggtctaatatccagaatctaccaggaacttaaacaaatttacaagaaaaaaacaaacaacaccatgaaacagtgggcaaaggctatgaacagatacttctcaaaagaagacatttatgtggccaacaaacgtgaaaaaaagctcatcatcactggtcattagagaaatgcaaatcaaaaccacaatgagataccatctcatgccagttagaatagtgactattaaaaagtcaggaaacaatagatgctggagaggcggtggagaaatagaaacacgtttacaccattggtgggagtgtaaattagttcaaccattgtggaagataatgtggtgattcctcaaggatctagaaccagaaatatcacttgacccagcaatcccattactgggtatatacccaaaggattataaatcattctaatataaagacccatgcgtacatgtgtttattgcagcactatttacaatagcaaagacatggaaccaacccaaatgcccatcaatgatagactggataaagaaaatgtggcacatatacaccacggaatactatgcagccataaaaaagaatgaattcatgtcctttgcagggacatggatgaagctggaagccaccaatctcagcaaactaacacatgaacagaaaaccaaacaccacatgttctcactcataagtgggagttgagcaatgagagcacatggacacagtgaggggaacatcacacaccagggcctgtcagggggtgggggacaagggaagggagagcattaggacaaatatctaatgcatggggggcttaaaagctagatgacgggttgataggtgcagcaaaccaccatggcacatgtatacctatgtaacaaacctgcatgttctgcacatgtatcctagaacttaaagtataataaaaaaaaaattgctaagggttatagattagataccctttaatgtaaatattcaaatttctttttataaaaaagcagatatattgagatataattgaaataaaaaaactgtacatatttaacatatatgattttattagtctggacatatggttacacccatgaaatggccacaatcaagatatgaatataactatcacccccaccaaagtttcttcatgccctttttaatcccaccttccatccctcccaccccaccatcccccacctcagataacactgatctgcttcctgtcactagagagtagtttgcattttctagagttttatctaaatcagccatgcagtatgcattcttgtctgacttctttcattccacattattaaaaaaaaagaatgaaaatcaagcaataaagaagaaaaaatatttgtaatacatataaccaataaggaaggtggtgttcagaatatatatgtatataaggagctcctacaaatcaataagaaaaaagcaaattcaataggaaaaaatgggccaatgacatggaccagtactccacaataagagaaaacacaaacatatgaaaagagggttgagggggagtcattcactgagctcaccccagaacatttgcatggtctatactttcataccaaccatgagtagcctgttcttttcttggctgggaggtaaatgaggaccctgtccatagatcaggtggccatgaggggaatgggcttggtagggaaagctagaatttgtgctctggtgactatggtggtcctggccccatatatattcactgtaaagaggaagatgcagcggaacaagaagaacactgaataactaagaaacgaatgcttgtgcttactttggcagcacatatactaaaattggcacaatagaagattagcatggcccctgcgcaaggatgatgagcaaattcatgaggcattccatatttttagcaatcccattactggctatataaccagaggaatataagtcattctaccataaaggcatgcacacgagtgttcattgaagccctattaacaataacaaagacatggaatcaatgtttttgcaggacatgcaaggaatcaacctaaacgcccatcaatgacacattggatatacacatggatactatgcagccataaaaagaatgagatcatgtctttttgctggaacatggatagagctggaagctattattattagcaaactaacacaaaaacagaaaaccaaatactgcatgttctcacttataagtgggagctaaatgatgagaactcatgaacccaaaaaagggaacaacagacattggggtctacttaaggatggagggtgagaggagggagaggagcagaaaaaataaatattgggtaccagacttaatacctgggtgatgaaatagttacacagcaaacccccatgacacaagtttacctatataacaaacctttacatgtacccccaaacctaagagttaaaaataaataaataaaagttacaaaaatgaatagttaaaagtctgcggtcatgcaaatatgatgccaagattccaggagacctatacaaaatgcccatagcaacattactgataaaagcaaaaaataaaaataaataaataaaaataaaataaaataaaataactagaaataactcaaaagtctgtcaatagtagaatgataaattgtgatatatttatacaaaggaacattatacggcactggaaattattgctacacatttcaacatgaattaatctcaaaaacataatgttgagcagaaaaagaaacaaaagaatacatgtagaatgattccatttatacaaagttcaaaagcaggcaaaattaaattgcatattgtataggaaaacaaagataggtggcaaagtcatggggagggaaacaaggggatatttcacacaacactcagcatgacaatgaaggtggtggtgacaagaggaaggataatattattgtgaaagggcaccagaagatttcaatgtagtggcttttttttttttttttttttgagacagagtttcactcttgttccccaggctggagtgcaacagcgcaatctcagctcactgcaacctccaccttctggattcaagctattcttctgcctcagcctcctgagtagctggggttacaggagtgcactactacacctggctaatttttgcatttttagtagagacagggttttaccatgttggtcttgaactcctgacctcaagtgatccacccacctcggcttcccaaagtgctaggattacaggtgtgagccatcgcacccagctagtgttttacattttaatctggtgtgagtagaaggatgtccagtttattcttctttatgctgtacgtatatattttattcttccatttgaatatatgatgcatttcacaattttttaaaggcaatggacaatataatgaaaattgaagaactgaagctcttgtcctttccgatatgttcagcacacatattgttttgaatgcgcagagttcttagggttatgatttagcaacatgagcagttaacaacccaacccttgttatgttaataggaacactgtggctaaaccactaaactaaaatttcactccatagacttattgatactaaaatggaatgtttcttcagagaactacatacctcaatttgctcacttttctcttccttttactatgctttgacattaccatttattacagataatctactaaatagaattgccttccttctttacagttctttctacattgttttgtccaggtaatttttatgactttcataatagtgtctgacatgcacgtaatttaaagtcaacaaatacagaatgataaaaatgagcagtcagaaatttttatctacttatttatttatttattcatttattgagacagggtctcactctgttgcccatgctagagtgcagtggctcaatcatagctcactgcaaaattgatctcccaggctcaagtgatcctctctcctcagcctcccaagtagctagaactacaggcacagccaccatgcccagctaatttttttgagttttagtagatacgaggtctcgctatgctgcccaggctggtctcgaattgctgggctcaagcaatgctcctgcctcagcctcccaaagtgctgggattacaggtgtgagcctccatgtcaagctcagaaattttttttttttttttgagacagagtcttgctctgtcacccaggctggagtgcagtggcacagtctcagctcactgcaacctctgcctcccgggttcaagcaattcttctgcctcagcctcccgagtagctgggactacaggcatgcaccaccacgcccggctaatttttgtatttttagtagagatggggtttaaccatagtggtcaggctggtctcgaactcctgaccttctgatccgcccgcctcagcctccaagtgctgggattataggtgtgagccatcgcacccggccagaaaattcttttaagaaccacgtgacttctgcaaataaggcatattcagtattaacttttaactagataagacctacaatgagctattttcacacacatatgttttttttccaaaaatggtagaagctaatatttattttaagtctgcatggcaagtttttcagtttttcataatactttggatgacagatgtcattgccaaggcatcgaaagcactaaattcctctttggaagtgctgtttgtccagtttcacatctgccctgtatcctttactcctcgaaaagacaatgtttcaagcattatccccctagatgttacaaacagctgaaccagcctgcaaattaaaggactaccttgaacataaatttctgataaggcccatattaatcatatgccccaaagtttagatgatcacacaaaagtaattttctcacagaaaaggtttttgctttcttttcaaaaaattgtaaaggcatggtgtaaacattactattccttttctctgtttctaaatgggtctaggttcttgtgtgaggaaagaggacaattagtaaatgtaattttcttatgcagcctcagctggcttcacatacctcataaatagttcttattcaaacattctaaagatacctacaattaaataaaattcatcctaaggctgggtatggtagctcatgcctgtaaacccaacactttggaaggccaaagtgggaagatcacttgaggccaggagtttgaaaccagccttgtcaacacattgagactccgcctctacaaaagaaaaagattagccaggtgtggtggcacacatttgtagtcccagctacttaggaagcggaggctggaagatggcttgagtccaggagtttaaggctgcagtgagccatgatcacatcactgctttctagccttggtgacagagcaagactctgtctcaaaaaaaaaaaaaaagaagaaaaaagtccatcctagttatatatttgatctatttcatgttctgaaagatctaacctggaactttccccttacgtatacaactttaaagagtaaatggctattccaagtcaataaactggtggcaaattgaaagatattaatgtgtagctaatctattttacatgatggagtttctagtctccccacaatgagcctcagtatatgattttaagtaacattcagaatactaaacttgattttaaaaacttgcaagcattcaggatattctgccatgaagcctctaaaattataactatattacacagaagttaaaaacaaacaaacaaacaaaaaccctacacttaggggcaagagcgcttaaccaaggcattgcttattgctgcaaagctgctctgtattaacctcacattaaatcattagagagaatggtgggaggcgagggacagctggcacccttggacatgggggctgaggcatccatggctgctaaagattttatagatttttttccttttacaggataaaaataaatcatttgcctttagttatagtttctaactgatactgtcacaaagataatttctggttgtggtttatgcagtgcagtcttatatactattatattatatctggctgatattaggtactgggtgcccatttgtgaaatggaacttaaggaactgtacatttttaataagaatcaatgctatttccctaacagacagtatctgtcatgggcagatgattcacattgatggcttataaatagcatgaattccccaggaaatttctccactgggtcctcctttcacactaaattcaagatattagtcaaatcctgctaaggtacacagatttgactatccagaaaagacagatcaaggttcttcagacatcaaaacttgctttgaagagagaaagacaacataatctggttttgcagtggcagatggctcataactttggctttgaatcttgatcttctaagccagtagacaagcggagacataagagtcataccaattactccagcaccacatatggtgagctagcctttaaaacaggcactaaatgagacttgtgatcagtttaaactgcaaagaaattgaggcaattataagacttattgattcctcagataatagcaatgatggctatcatttaccaggagcctaccatataacctgtgcatttatgtatgcaaaaatctgtgccagagttttgcacacatggaataatcacaacaaccatgcaaagtggatactattcgccccattatacatatgaggaaactgaagctaagagaagatcagtaacttatctcatgttaagtaatttaccaataactgagccaggatgctaactaagagatgcttgagtctaaagcttgggctcttttcaccatattatgttactttgaagagttagcaatttgtcctcaaggcctctgtccatgctggtgtttaatacagctcaaaaatcataaagaaacttgtcagtggtacaaacagtagtttatgttcagcctaatgtactaggacagagtgagaagttaatactgcttgccattcttcttgtgaccagttcaacaccaggtctttttattttttccagtctatgattaaatatattagcaaagattgacttctgcagaaggaaaacatagaagaaataaaatatctccccaaaagcttgaagctcttgcttcatgaagagtaggaacatcatgaattgcaaatgtctttcaaatattttttccagtaataggccatttcataaaaataatgcaatgaccaaagaagtgaagaatcctgattttaccatattttccaaaaacagaaagtgtatatagatatataaactttatatatatgtttttatatatataaactttatatgtttatatatatataaactttatatatatgtttatatacataaacatatatatgtatgtatacatcagtaaaatgtatgattttctgatataaacccttgtttataatataaacaatataaaactcttgtttctgatataaacctctcatgatcatggtcacataagaagttcttgggaggtataacaagcactgcatatgatgccacaagtcctgaatcccctgcccagcccccaaactgagccatttaacttccctcagactgtttctttaccctccaaatgaggatagtaattcttacctttcagacagcaaggattaattaggtagtatgtggtgaagcattttataaatcataaagtgctacacaagtatatcaccacattcagaatacagaacaggaatcagactagaaacattagaaactctccatttcccaaattctgtccctagatgtttttttgggggatgttataccccactccacttattatttttgattgcttcagtaggtatctagctccagcaatcaaaccaatccatgactaaggcaacaaatgcccccaaaggacattccctgcagccaaacagcaaaaagctattggatcaatagatcaccggtatggctgtagcttcagtgccctacctacaggtcacctagagtttacaaaaagtttcacaataaagagaaatgtgcagtttttttctagaataagttgcttgcttgtatacactagagcttcaggttttttctcagagacaaattgtacatctctttgttttatgatggatatatgcaagtataagacctgcatagagcaactcaaactctgccttgaaaactctctaaaatgttgtaggaaatctgttaactatatcctccagttaattcctagtaatataaacagattccttccctgcaggttttggtactgattagttgtgatgaaaaatgaaagtttttcatatttaatgaaactatccattttgcacactcacaacatagctcccagaaatattgtttagtccttggcaacactgtctcacaactttggtaaagagcattgtgaaaagatgttgttgaacagactgccactcattgtttacataccacaccagagacagcagtttgtggtggttaagagtacaaactgtggctccaacaatatgggttcaaaccctggctctccaacttaatagctgtgtgaccttggggaaattaagaaagcttctaataagtgttaactatcactactgtcagtagtagtagtagtagtatcgccttcacaggcattaatggattatattgcaaaccatgaagtttcctgaggcatcttgttccaaactctccaaacctgacacaattgttgggatcttcgcacaaaaataatcagttacctggtgtcaatggatgtgaatggctaaaacagcttctggaatgcattctagcagatttttgaacttcatattccatcaaggagccgccttctttcatggacaggaatccagccttgaacatgtgaacagaacctgaatgtaatccttaatatttcccataatggtaaaactgtagaatctaaacagagatggataatttgagtttgcatctggtctctgcctcttactagctgtataaacttgggaaagttactaaacctattcaagtctagcttcctcacatgtaaaatgtaggaagtaacggtgtctatctcatagaaccttgtgaggattaaatgagataactaaatcttaccacagtgcctactgcataacatattcccaataaatactggctattactattaatttttttgggggggttggttggtacagttgatatgagctcttcacctgtgtgttaattgaaaaatgaattttttgcagctgatcctttgaggactataaaatgtatggatgaagtcttatcagcagaagtcttatgttattataatgttgaattcagttcactttttggaagattttataataaatcttacagtgtgaaacaatcatggagtagattgtctaagaaattatagaaagataacattgagaaagtagttgatctctgtattgtaaccatcaatgtctcctttctacttaggtttcttgtttgttcgtttgtttgtttgtttgtttttataattgaagaattggagtcagaacttcagaataatagtcattgagtcagaaggtgagatgatagatagaaggtcaaggaaggctgttgattgcccctttcaagtcaggcagggctgacttaaacatggttggcttttggcaaagctgaggtagtcagttcatcttgagttcccttgtagattctctttactcttctcggtcaatgtaactatcctgggtccaattattgctcatatcaagtggtaaatttatttctgttagtgttaatcactaattaacttgttcactgctcatgggtcctcagagatgtctggagactcttacagttggaaaagccaggaatcttgaggtgcatagaactataaaagaattataggttgtgaagttgttagtttgaggcatatatcttttgtccactattcctatgtctagggcctatctcattcctgtagacttattatgtgttcttagatgaataattatgcagaaaaactttctgggattttttttttttttacttggagacaaaaggactcagatcctatgacatgatagttgtctatatcctttattgcagttgatgggaagactcagaaacaaacttggacccagataatttccttcttctagatatcacccaaggccgggcatggtggctcatgcctgtaatcccaacactttgggaggccaaggcggatggatcacttgaggttaggagttcaagaccagcctggccaacacagtgaaaccccgtctttactaaaaattcaaaaaattagccaggtctggtggcacatacctgtaatcccagttacttgggaggctaaggcaggagaatagcttgaacccaggaggcggaggttgcagtgagccaagatcatgccactgcactacagcctgggccacagagcaagagtctgtctcaaaaaaaaaaaaaaaaatcacccagtggcagtatcaaagaatggcttttccccagctatcctaaagatatataaaacaacatgctgttacacaaatagagctttgttacaagtcacctcatcagtactttcagtcagatgacagcccagagcccctctggtaacatgatagagcagccacgagtcacactatgagcagatcagacatgagcctcattcaacaccaagaataacctgctacaaagctagtagcttaaaattttggggaaggattattttgtaaggtttctcctctgtgttttcataattaacatggaattttagagctgagagagtctcagaagtcattttcctaacccccccatgttatatatggagattctgagggccagagagagaggtcatctgcctgcattcccatagatgatgagtgcagggaagcccagatttatgccccttcttgctcccaggccttccatggctcactgtcttcaactgaaggtgactaagataacaaggccctcgaataatctggctctaccatcctatccactgcctacccaggatgaactccttttgctcatgaacattctacgtgagaaatggttacagacagaagtagatagagcagctgggaagcagtttcaataatctgggtgaaagataatggtgacttgaatcagagttgtggtagtagagttgcagaaaagtgaacagattggagattgttttatggagtgaatcagaagaaccttctaacggatctaatatgtaggtgaataaaaggaaggaatcaaaggtaacacctagggttctggcttgggcaactgaagataaagaagataaggcagaggcaagagagtattgggatggggggctgggggcgcggcatgaaagaaagagttctctcaatgttccgtgtataacaatctgagaggtggcatggcatatgtcagaggaggaacaatatttcccccttttctgttttccatgaggagagacttcccttaacccgtccaccctttggatccattccttggtcctcctcagaaaggtagggtgagttatctgatgagggaattagggagactaacagggcatgcacaacctagctccttcctccctttaatccttgggagtcaggccacccccaaagagcagtccttcagttcctcgatgctgtaatttccaaagggacaggccccttgcatggggaggactatgggcatccagcattttctgtgcttgggagggtaggtttatctaattctggtgctgagaattatacacgcctataaatataagcccatattccagtatctgtttcataagccataaatgtgatattttgatatcccatatgcatttcttttttgtcttttttctcatctgaattggttcagggtagggaagaaagaaggtaggtattgggtcctctcaaaactcaagagtgggaggaacagtgggagaggaacacagagtccttcctctaacactgtggccctgtgacctcaggaagaggacctaacttctcagtgcttgtttcctaatctatgaaaggaaagggatagcatctactctacatttctcaaaaggttattatgaagatcttaataacaaatatttgaatatttaaatgttcaacatttgaatatttgaataaccaatatttgaatgtaaccttaatattccaatatttgaatatgactttgagccgggcacttaaagtgccagtggcatatgttaagagttgtggtagtagagttggagaaaagtgaacagatttgagatggttttacaagtaactcaaaagaactttctgatggacctaatatggtaggtgaataaaagaaagtaatcaaagataagacctaggtttttgtctttaaactgccaggcttgggggggaagttccaaggtggccaaataggaacagctccagtctgcagctcccagcatgagtgacgcagaggacaggtgatttctgcatttccaactgaggtaccgggttcatctcactggggcttgtctgacagtgggtgcaggacagtgggtgcagcccatggagcatgagccgaagcagggcaaggcatcgcctcacctgggaagtgcaaggggttggggaattcccttttctagcccagggaagctgtgacagatggcacctggaaaatctggtcactcccaccctaatactgtgcttttccaacagtcttagcaaacggcacaccaggagattacatcccatgcctggcttggagggtcccacacccacggagtcttgctcactgctatcacagcagtctgagatcgaactgcaaggcagcagcgaggcttggggagtggtgcccgccattgctgaggcttgagtaggtaaacaaagcggccaggaagctcaaactgggtagagcccaccgcagctcaaggaagcctgcctgcctctgtagattccacctctggtgcagggtatagctgaacaaaaggcagcagaagcttctgcagacttaaacatccctgtctgacagctttgaagagagtagtggttctcccagcacggagtttgagatctgggaacggacagactgcctcctaaagtggcttcctgacccccgagtagcctaactgggaggcgcctcccagtaggggcagactgacacctcatacggccaggtgcccctctgagatgaagcttccggaagaacgatcaggcagcaacatttgccgttctgcaatatttgcggttctgcagcctctgctggtgatacccaggcaaacagggtctggggtggacctccagcaaactccaacagacctgcagcagagggtcctgactgttagaaggaaaactaacaaacagaaaggacatccacaccaaaaccccatatgtacatcaccatcatcaaagactaaaggtagacaaaaccacaaagacggggagaaaccagagcagaaaagctgaaaattctaaaaatcagagtgcctcttctcctctaacggaacgcagctcctcaccagcaatggaacaaagctggacagaaaatgactttgacgagttgagagaagaaggcttcagaagatcggtaataacaaacttctctgagctaaaggagggtgttcgaacccctgcaaagaagctaaaaaccttgaaaaaagattggaagaatggctaaatagaataaacagtgtagagaagaccttaaatgacctgatggagctgaaaaccatggcacgagaactacgtgacgcatgcacaagattcagtagccgattcgatcaactggaagaaagggtatcagtgattgaagatcaaatgaatgaaatgaagtgagaagagaagcttagagaaaaaagagtaaaaagaaatgaacaaagcctccaagaaatatgggactatgtgaaaagaccaaatctacgtctgattggtatacctgaaagtgacggggagaatggaaccaagttggaaaacaatctttaggatattatgcaggagaacttccccaacctagcaaggcagaccaacattcaaattcaggaaacagagagaacgccacaaagatactccttgagaagagcaactccaagacacataattaacagattcaccaaagttgaaatgaagaaaaaatgctaagggcagccagagagaaaggtcatgttacccacaaagggaagcccatcagactaacagtggatctctcagcagaaactctgcaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaacaccaggcctgccttacaagagctcctgaaggaagcactaaatatggaaaggaacaactggtaccagccactgcaaaaatatgccaaattataaagaccatcgatgctaggaagaaactgcatcaactaacgggcaaaataaccagctaacatcataatgacaggatcaaattcacacataacaatattaaccttaaatgtaaatgggctaaatgctccaattaaaagacacagactggcaaattggataaagagtcaagacccatcagtgtgctatattcaggagacctatctcatgtgcagagacacacataggctcaaaataaagggatgcaggaagatctaccaagcaaatggaaaacaacgacaaaaaaaagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagaacccagattcataaagcaagtccttagagacctacaaagagacttagattcccacacaataataatgggagactttaacaccccactgtcaacattagacagatcaacgagacagaaagttaacaaggatacccaggaattgaactcagctctgcaccaagcagacctaatagacatctacagaactctccaccgcaaatcaacagaatatacattcttttcagcaccacaccacacctattccaaaattgaccacatagttggaagtacagcactcctcagcaaatgtaaaagaacagaaattataacaaactgtctctcagaccacagtgcaatcaaattagaactcaggattaagaaactcactcaaaactgctcaactacatggaaactgaacaacctgctcctgaatgactactgggtacataacgaaatgaaggcagaaataaagacattatttgaaaccagtgagaacaaagacacaacataccagaatctctgggacacatttaaagcagtgtgtagagggaaatttatagcactaaatgcccataggagaaagcaggaaagatctaaaattgaccccctaacatcacaattaaaagaactagagaagcaagagcaaacacattcaaaagctagcagaaggcaagaaataactaagatcagagcagaactgaaggagatagagacacaaaaaacccttcaaaaaatcaatgaatccaggagctggttttttgaaaagatcaacaaaattgatagactgctagcaagactaataaagaagaaaagaaagaagaatcaaatagatgcaataaaaaatgataaaggggatatcaccaccaatcccacagaaatacaaactaccatcagagaatactataaacacctctatgcaaataaactagaaaatctagaagaaatggataaattcctggacacataaaccctcccaagactaaaccaggaagaagctgaatccctgaatagaccaataacaagctctgaaactgaggcaataattaagagcctaccaacaaaaaaaagtccaggaccagacggattcacagccaaattctaccagaggtacaaagaggagctggtaccattccttctgaaactattccaatcaatagaaaaagagggaatcctccctaactcattttatgaggccagcatcttcctgacaccaaagcctggcagagacacaacaaaaaaagagaattttagaccaatatccctggtgaacatcgatgtaaaaatcctcaataaaatactggcaaactgaatccagcagcacatcagaaagcttatccaccatgatcaagtgggcttcatccctgggatgcaaggctggttcaacatacacaaatcaataaacataatccatcatataaacagaaccaatgacaaaaaccacatgattatctcaatagatgcagaaaaggccttcgaaaaattcaacagcccttcgtgctaaaacctctcaataaataaggtattgatgggatgtatctcaaaataataagagctatttatgacagacccacagccaatatcatactgaatgggcaaaaactggaagcattccctttgaaaactggcagaagacagggatgccctctctcaccactcctattcaacatagtgttggaagttctggccagggcaatcaggcaggagaaagaaataaagggtattcaattaggaaaagaggaagtcaaattgtccctgtttgcagatgaaatgattgtatatttagaaaaccccatcatctcagcccaaaatctccttaagctgataagcaacttcagcagtctcaggatacaacatcaatgttcaaaaatcacaagcattcctatataccaacaatagatgagcagagagccacatcatgagtgaactcccattcacgattgctataaagagaataaaatacctaggaatacaacttacaagggacgtgaaggacttcctcaaggagaactacaaaccactgctcaggaaagaagagaggacacaaacaagtggaaaaaaattccatgctcatggatagggagaatcagatcacgaaaatggccatactgcccaaagtaatgtatagagtcaatgccatccccatcaagctaccaatgactttcttcacagaattggaaaaaactactttaaagttcatatggaaccaaaaaagagcccgcatcgccaagtcaatcctaagccaaaagaacaaagctggaggcgtcgcgctactgtactacaaggctacaggaaccaaaacagcatggtactggtaccaaaacagagatatagaccaatggaacagaacagagccctcagaataataccacacatctacaaccatctgatctttgacaagcctgacaaaaacaagaaatggggaaaggattccctatttagcaaatggtgctgggaaaactggctagccatatgtagaaagctgaaattggatcccttccttacaccttacacaaaaattaattccagatagagtaaagacttaaatgtttgacctaaaaccataaaaaccctagaagaaaacctaggcaataccattcaggacataggcatgggcaaggacttcatgtctaaaataccaaaagcaatggtaacaaaagccaaaattgacagataggatctaattaaactaaagagcttctgcacagcaaaagaaaccaccatcagagtgaacaggcaacctaaagaatgggagaaaatttttacaatctacccatctgataaagggctaatatccagaatctacaaagaacttaaacaaatttataagaaaaatcaaacaacctcataaaaaactgggcaaaggatatgaacagacacttctccaaagaagacatttatgcagccaaaagacacatgaaaaaatgctcatcatcactggtcatcagagaaatgcaaatcaaaaccacaatgagataccatctcacaccagttagaatggacatcattaaaaagtcaggaaacaacaggtgctggagaggatgtggagaaataggaacatttttacactgttggtgggactgtaaactagttcaaccattgtggaagacagtgtggcgattcttcaaggatctagaactagaaataccatttgacccaacatcccattactgagtatatacccaaaggattataaatcatgctgctataaagacacatgcacatgtatgtttattttggcactattcacaatagcaaagacttggaaccaacccaaatgtccatcaatgatagactggattaagaaaatgtggcacatatacaccatggaatactatgcagccataaaaaaggatgagttcatgtcctttgtagggacatggatgaagctggaaaccatcattgtgagcaaactatcgcaaggacagaaaaccaaacattgcatgttctcacttataggtgggaactgaacaatgagaacacttggacacagggtggggaacatcacacaccagggcctgtcatggggtgggggggagggaggagggatagcattaggagatatacctaatgtaaatgacgaattaacgggtgcagcacaccaacgtggcacatgtgtacatatgtaacaaacctgcacgttgtgcacatgtaccctagaacttaaagtataataaaaaaataaaaataaaaaaataaagtgccaggctcaaagtcatattcaaatattggaaacatcacttgtagttccaaatgcattcactaaggaatttatagatggaatttctacaaagagaaaattaataatggaccaactaatatttctattgtaataataattattattatcatgattattttactatatacttctccttaggaaaatagtggttatcaaagatgacagccctacaggaagagatagaaagaaaagtcatctgatgctcctttattcacgtttttctatttcaaatatggaaaagctggccttattatttagctttgtacacttatagaaaatttgagaataagaaatgcattcgtaataaatgggctcttttttctaggaaagaaaaaaaagtatctttcataaacctggggtgatatttttttaaatacgctttcacatacaagcccagggattatgttctgctaaaaataatgaagatgcagatattaaggttctgtgtagtttttagtcaagaaaaaaaaagctctcagaaacagctacacggttgataaagtgtggttgagtttcccttcgacgacttgtcacagaagggcaccagcaagtcctgtggctgaattttacaaatcactaagcaagttttggagcgttaacatattgagggagaagaaatataataacaaaggtgattgtcccacatccttcctggtggattcaggaagatggaaaatatttcttttctgtatacaaaagaaagaaaaagagtcctgaaggggacattcaccatcaggaactttaggttaacagagacaagacctcaatcaatgagcctgagaattgctggcatggtaactcctgggttgctgctgctaaaagttcctggtagataccaggctaagagatatatcaaagaaagaatatttattatcgttctcattctaataaaagcctggatattgcataccaagtgtttaaatacaaatttccctgtcacttgttctacttagaatggaagggcaaggtcctttttacattgcaagacattgcaatatagcaaataaattacaaccaagggccacatggggtaacagtttaaagtgtaattaaactctgtgtatttaaaagaaaaacaagtatttcatatatctgatattaaaatggaaaagaaggatacactcacaggccacatggaagtaaaaaaataattgttttatgaaagaggccaatgagatttaaaaatatgattgtaaaattaaaaactgggaacaaatacttattttcatattatatcagtttgatagtaaggtaagtaaggtcatagaaggcaagaagaggattaggaaaagagaaaagagaatgaggagaaaaagagacaggcaagatgaaggataggaggagggagaaggggaaaaatggggcgcaccaggggaagccattacacaaaaggaacggcaggtgtgggatgtccaaaaagaagaaattaagaggacaagacaaataaatggaaagaggagaggaaacacagaaagactaagagaaaagaggagatgttgagatagccagcagttcaggggactctgaagcatgatagataaatgcatttaactattcctttgagctttggagcattaactgttgtgatcactgtctttggaaatgtcatttagctgtttaacaaaactggtcacagatgactttagaagaattgcgggggttaagtagtttctagggtaatggtagataatccaaataaaaatatcttgagtccaaaaacaaatctgacaatcttggaggacacttcctggaagcaagtagagaagtacagactagaaaaacataaatattctgtgctcttggttcttcaggggaaagcagaagtggtggtggtggcagagcatttgctttcaccaaaggctgagctctggctctttacatacattaatgtgcttcaagttaccacccttacatcagagagttcccagcctgaccttttatattctccctagcaaatcactctgccttgcccaaaagatatcaccacggtgatttaaataaacatatgaaatgcagaatacattttctttgctccaacattgccattattaactacatcatcaccactggagtcacagtctttctctcctgctccatccttccaaccttgttcattcctcttctctactggtaatagatgaattgcttgatcccctgaaccttcatgtctccaacagtcacagcctggagcatgatagccctgcacctgaccagttgaccagggaacctgtcctacccttatgtatgagaaaatgcaaggactcttggcctacaagtgccctagctcagcattattttatttatttattttgagatggagtctcactctatcacccaggctggagtgcagaggcgtgatctcggctcactgcaacctccaccccctgggttcaagcgattctcctgcctcagcccccctagtagctgggattacaagcacctgccaccgtgcccggccaatttttctatttttagtaaagacagggtttcaccatgttggccaggctggtcttgaactcctgaactcatgatctacccaccttggcctcccaaagcgctgggattacaggcgtgagccactgcgcctggcccctagctcagcattattagctaaaccccctggtcctaatctgaccttgtaacccagtgctggtatttaggccacttaccctgtgactgaatttttcattatattcctgatatggtttggctgtgtccccagccaaatctcatttcaaattgtaactcccacaattcccacatgttgtggaaggaatctggtgggaggtgattgaattatgggggcagatctttcctgtgttgttctcatgatagtgaatgagtcttccaagatctgatggttttaaaaatgggagtttccctgcacaggctctctctttgcctgccaccatccacgtaaaatgtgacttgctcctccttgccttctgccaggagtgtgaggcctcctcagccacgtggaactgtgagtccattaagcctctttttcttcccagtctcgggtatgtctttatcagcagcatgagaatagactaatacatttcctttccctcatttattcatgtaacatataacatttttattgagtatctacctactatgtgctaggtaccatgccaaacacagggagtgctacaaagccaagaaaatcatagcatctgccttcaaggagctcacagtctaatggagagaaagacaggtgagccaaaattaaagcaaccaaaactggaataaatagcaagagtcatacagataaattactatggaagttagtggaaaaaagaatgaacttccatggagagtttgccattctcattatttatcttgacaaagtcatagtctaggcctcattccagtctggctccatgagcctgcatccagtgcattcacccagggtcctgtgccaagaagagtccccaaacccacccttgaagtttaatgcactacagtcattatcttgaaattcttaataattttattttggaatttttattttgtacatgaggtctgatggagcatgcctcagaggttcacatacagtccagcctcctgatgggttctcagcctctgcctcctgccctagctccatgagccctgccttgttctattcagggctgcaacagggtcaatgaacagagatacctgtgttctactgttgccctctgtgtctagcagggtccagggtatgggtatggggagagtcagtgtccctgggtagggaaaggccctggccatcttgggatgtccccaccccaggccggcagcaccatggcatgttcattaagtgactctatgggggcttcctgcccacccctgatccaggtagcaagcttgtcaggcacagaggttgtcatcttttggggcttgcccatctaccatgggtcgggtggctgcctgcaggggctggcctagggaaggggagattgacttccctgtccctagaaagacccctgttttcatttttcactgagtcctataaattatgtagctgggtctgatcccagttcttgaccttgtaaccctcagagcttagaggcaacaatctcattagcaaatttcctacctccagtgtcctatttcccagagtcctattctccaatccattctgaagagtgaaaactgaaacaggaagaatcatctccctgtgccattctgatccctttcccaaagcctaactggctttccctctcagattttgttatgggcagttaatcatgcacacaagcacaggcctgtgaaaatcatgacctgctggagaggacgctcaccacttaaaggccctggactttgacggcatgcagtgactggatgggactggggctggggcccactctgggtcaggttgaagctacatttgccagcctccctgcacttggctatggccacatccctgggttctagagtctagaaagacattgaaatatgagcaagaaatgtgtgccacttcctgacaggacaggaaaatctctcatttcatttcccatttttctctgtctcttccctcatctgctgatgggctgttaatgctgacagcaccctttgaacccctgtgttgaggctcaggaaggaaagaatcctctcttggaggagagccatctatcaatcaggaagactgtgctgagcctcagaagagtgagaaatgagcttccattgtgttactcctgtgtgccactgagctttggaagggtatctgagaaagcaaatatggtttctttaagtaatgattagtacatatatggaaaaaaaataaaagaaaacaaaaagagaagagaaaaattagtcataagcccacactcagagattacctctatcaatgttttggcatattgacctccaccctttgaccatgcagtattctaatttctttttactgagcccaaacaaagtgacaaacagtgttaagcacttttcaggtttaatcttggcaacctcttaagacagaaggtatcattatcctcattttagaattgcagaaactagcaactagagaggtaaaatatggcacagcccttggatatggtggaactgggaatcgaattcggtctgattctgaaaatgatgcactccaccatttcccttatgcgtctgttgttactgttaagaaaactgagattctgttgaataaactttgttcacttaatagtattctctgagcaatctcctatgattaaatattcccttttataatatatcataattgattcatccaaccctctagttggatgtttggattgataatttattattattatagataatactgcaacaagtattcatatagacaaatctttgcacatacccataaaatttttcttagcatgactggaattgttacataagccattgtaaatattcttttttttttttttttttttttttgagacagagtctcactctgtcacccaggctggagtgcaatggtatgatcttggcttattgtaacttctgcctcctgggttcaaacaattctcctgcctcagcctcccaagtagctgggactacaggtgcgtgccaccacacttgggtaattttttgtatttttagtagaggcgaagtttcaccatattggccaggctggagaagttgtgactattcttaaggcagtatacggttcttgccaaattatcctatatcagttgtggttggcagagtcgggcagtgggggtgtgattttactaccaggggatatttgacaatgtctggagactttttaaattgtccagactaggcaagtatctagtggagagaggcaagggatgctactaaacaaccatcctacaatgcacaggtcaccctacctccaacaaagaattatctgtccaagatgccaataatacccctgttgagaaagctaacccacataatgacctcatcagtgtgtgtcagtcttgagacaaaataaagtttataataaagtctcttccacttactcaaacatgatctaccaagcgtctactctatgccagatcccgtggtaggtactaagttagaattcaagcatgagggtgagataaatagggaagagtaaagagaggaggtggctcggaagcaaagtttgacttcacttggtagtaagaaagcatatctattccattttataccttcatatctttctatataattttctattaaattatttccatgcgattcttcattaaatatataacctcacaaggtagtcacaagaaatgattaatattgctatattgctacctacaggaatggttgatcctgattctttttaggctatttctgaagaacaaaattagttttttcttcaacagaaacccaaagtcttaagtatgaaacattcttataatgacagtagctcttcttcccccagttgacctttttgttctttaacatagcaaataatcttaatttggttaagtcagaggtagaaaaatattttcctgccctttatattttaaaactcctttctatctattcacagcaggcatgagtaaaagaaaggatcaaatcagaggctgttcctcttgttcattcattttaaaaatgaatggcaaaagagattggggagagatgcctcagcttccagctgttcgtctccctgcttggttaattcatggcacattggctgccactggttcctctctttgcttctctgcatgataattttagggttatgataaaaaggagggctatggctagggctgtcttgggctttcaaagccaatgatcaaagatggggaagtgagagaatctgactccagtctcatatacctgaagacagaaaaaaaaaaaaaaaaagaagctaccttagcagttgcacagagtaacagagtgtgcaccctctcacttagtggttctctggaagcaaaaggaaaaagaggctaacagggaagtgtgagtagccataaaggtggccattagaaagagggaattagagcttcacttttccagaggactttattcagaaaagaacaaaaatctggactggtttcttgagcaaccctgggataatctttcccacagtgtcccaagcctgcagttcttaatgccattacagctgttatgaaaactttaaatatgtaatcatgcatattaagttgccaaatacccataaaaactgttagttcattaaactgtgcatacccatttaaatgaaaaaggagtaccatttaattttttaattgaaaaatgtaaaggttaaaacattctggtaatctgataaagtagtacatgcaacataaatgcaaaaatgtaatgctagtattaaaagtatcatcatttccaaacacaaaaacataaagaaagcctatgttttatataaggaatagtcaacacatctgcaataaaattgtgtcatagatatacttagcctactaaattattagatcttgattataggcatgagatttagtgttcatttattctttaatgccagctgctagaattgatttagtttgcaagtgcttgagccaaataccatcatttttaaaaatttttaatattttgacaacaaaactacaaatcatcaacttggagatttcatatggggatttatttcacagagacccaatgtatacttcggaaattgcattttgtactagaaaaataggcatgttgatcaattgtaacaagaaatttaacatatctgtgtttgtcaaaggtagaatatttattatggactctaaatcctgacagcataatattcatttaaaggatttgatctctttacattttaaagtaatcatttcttgtgtttcagggattatgtatgtgtggtactgtgttaaacagtacctaggatttgttttaatggggtatggtaaagcaaacacagaaatgactgtcatgaagaaagttcatactcacagaccctagaaacgggaggcatggcacactgtgcagggccgcatagggaaaggccagggtcagtccagaggcagaaacagggcagagcatggcacagaacctttactagggtcttcagggaaggatgaactagacagggtaggtagctgagtaagtttaggattggctagtttgaataattttggcaaactatgggctataggagtggtctttagttgttgggtacctggccctgggtgatttagggcaaggagaatattgtctgggtgtatgagattttgataaaggagatagttagggctctggatcggctgatttatatatcagaggtaccctcaaaagggagttcttcactctctccagaaattagctagccctgggaggggcattctctccagggtcgtaagcctcaaatgctagaacatcaagaacacagaaaatgtggaattatagtcaatacaggtactaccacattttagatcaaaactctcctattatgttcaaagccctttccaaagacaacactgtgaataaagccttctggactgtgtattttaaaacattaataaggccttacatttctgactttatccattggaaaatgcttttccattatctcattgccatctaatgattagatttgatgattagaggtttacaaaatactatggggtagacatgtctgaacatattatccctatattatagctaaaaaactaaggcagaactgggaatagaaccacaattcctgactgtaagtctagagcatgttctgtcacactctgatgccttttacagtttaacaatgttattagtaacctaagaattcaattgtcaggcaaatggatttaatgaggttgtacagagaacaggttgcacaaactagatcaaagtcacctcttcgctgtaggtgtgttcggccaaggttaccttttatggactgtctttggggatacagaatctcacgaataaacagaataacttgaagagaataagggagtcagctccctcacttaccaacggagtcactttaagcaaattacttaaactgtccaagcctcagtttctccttttgtaaaatgggtgtggtcatagttacctcaggggattgttgagaggattaaaagagacaatgcttgctaacgagctgtgtggctcaaagttagtactccataaatgaagttactattcatccacagtgaagcttccctctaccttctgttattatgttaaaaaaaaaaaaaagtagacaccctgccgggctcagtggcacacatttatagtcccagctactcatgtggttgaggtgggaggatcacttgagcccaggagttttaattcagcctgggcaacatagtaagatcttgtctctaaaaaaaagaaaaaaatagacaccctaaagaggtatctcataggtttcccctttttttttcttcaggaaaaaaagattttttctcctgaatttgcgacagcctttaagctatattttatgataggaaacataatttgtcattaatatatgaaaccactgttcagtcaaaaacaaccaattaatgaaaaaaacctcaggaattatagaaagtatattttttaatgccagaaaaccttctttactattttaatccaaataaataaatatagcctcaatgcctataaatgaccaggaactgaaacttctcctaaaatattagcaacttaacccactcttttatgattaaactgcctttatctgattaaaatttcactttccaaaagaatgtggttatatggcaaaatactacccttaaaataagcagcaagcaatgtacctcaaggaccttgttgactttcctataaaacaactaaaagctgtttcagagaaaagtttgtatgactcttcaacattatattcaacatgaaaccctaacttccaaattaagccaggcttgtcaataaacaggtgacccaaacctcaggaaccaaaataaattggtcagaatagtaaacatttagcttatgggttgggaaaaaaatttagttaaccttaaattacctttacatgattctgtaggaactgtgcctttctgtaatctatcctcatgtacaaagcagcaaatgtaatttgtccttgtgtttatcacgatcatgtgtctgtcaggaagagaggctgaaatagcagagtttcctacttcaaacacaaaatcaactctggttctgggctagtgaacatgtttgcgcgcttgggggaattttttttaaacactgtgcaaagctggaataagatttcatgaaactcctttataatatcagtgttggagtaggatcaacatctgcctttttagacaaatctcagcaactcaataacatgagtgtagaccatatctatcagcactggctcatcagggaacgaagcactctcatcgctgaattttctagacacccaaaattaattcctcctgaggcaaacactttcaatgtgattatttcaatggagattattccaaaaagaaaactgaaattcaatgaagtactaaatattgttattcatattattagaaaatatatataataaatatatatcagcatattataatgcattcttaaatacaattttatgtataattttttgtgttgttttccaactcctctcttcaaggataaggcactcagctctctcttctcatatcatgagaaggcaagcaggttctaaatgagcaaagatggagaagaagtagtcctggcagaaaggatgcaaaatacaggaatagaaaagcactatctgggcattgaaaacagcctataatttaattaggatggtgctgaggccacatgaagggctgaagtagacaaggctggattaagattgaacttctctaccttagactccatatgactcagattcagggcccgcttcgtgagcatgtgaccagtgcagtggcatgaaagacccctgcttgaggtttaatgctatgctgtgcgagattcttaatactttttatcattgaatttgtgctttgtaagcatagtccaatggaacaatggagtatgagccccagagtccagaaccttggttcacatacagtctcccctcccactgcctgcccaggactggtttttggccacctgatccccgctccatggtgtcccaggcctcacccatccttcccagtctcacctctgcccttagcaaccaggtcacatgggctgagggagaggcccacattcatgtctgccattgcactctgctcttagatggggtctagggagggtacggagaagggcaggtgcatgccccacaccacctcagggaagtgcaaggatgtggccctcctcacccagagctggcagcagcatggcacctcaggcaggcaattcagcgggggccccttgcccaccttcaatccaaatactgagaatgcctcagcctagaggttgcaatcccttcggactctcagactggagcttgctatggattaggggacagactcttgggaaggggagactgacttctttaaccccggccagagtcctgctttaccatcttgcactaggctccacagattatgtagctggccctacttagaatctttccccttaacccagcttctctccctgttctggataaaggcatcacacttcctcatatctcctgggtttagaatctgagtcatcattgccctccctccctcctttcccaaatccaaacccacaggccacttcccatctgtctccttctgcccattcccactgttcatgcttgagtttaattgttcatcatggctccaccagaccatgacagtagactcctaatcatttccacagctttgagcctctccttgttcaatccattcagctgctgccaccaggttacccaaaacaccactttgatcatgctaagatatttttaatggctccctgtggcctactcttggtgaagttcaaactctttagctaggtgttcaaagtccttccttcttttgtcctcaccttacttttgcaaatcattctatgacaatagaatgtcatatatatgcaatatgcaatattttggccaaattaaaccactcactctcccttatacatattttatgcttggtcatcactgtgtctctgctaaagctattttgttggacttggaatcacttctccctaccccacaactatctctaactggaaaatctaatcctatttatagctggaatggtgcctcctccatgaagtctttcattatgagcccagtcacaaagtgactccatacttgtccaagactaacatcatttagtttgtacagcttggtactagttttttgtggacagtacatggctgtctactgtacacccttggagagcagaagcatatcctgccctttgtacaccgataggccctctacccaaggccttggggataatgggctctttctgtgcatgtttgttggaactaatgaataaatgaagctgttgtgtaaacagatcaggccttctgaaaggcaggcgcacctgtaacccttcagcgtcatcccctttcctgctctcagttcatctaacaaaacatcctgctgcttttcacacccaagcccatcaaacacctgtattatcattatcaacactgacaaaaattcacctcacgatttttatgaatgtttaaagtgctatattctgaatgcttagaataatctcagagaacacctgttacttgaatgctcttattttcaacctcttgagggcaattttttcattactatattaaagtggactgttaaataacttataactatctggggaaaggtatactgcagtcactatgatctggactggatacctaaaaatgaatgttttttttttttccatttacgatttatttttttcctaatttcaagtctgtcttttaggactaattgaggaaagtaatgcaaaataatgaaataaactgaggggttttgggctgtcagaacttctattcaattttagcatttcattaaatattctacccttgactccagaatgccacgcttatcatcataattttgtctcttcaatgcctttctcttgcccatattaggaacccccaagagtatcatcaatataattattaaatgattaaatttggaaattctgtgtgataaaaaaaaaaccttacctcctgaagaaaaaatacactgtctgaagctgagcaagaaacaccttaaaaatatagtagttaacaaagaatcaggaaggatggttacatatttacatagaaacttcaagatgcttgcatatatggtacaaattaaaacatcatcacaaaagaacatgtatttggaaggttgtcggttttcattaagagaaatctgtaacaccaggaaatgcaaaggatggaggaaaatgctagaactggggaaggatgcaacatccttccctacaacaaccctataaaaagtttatactgcatgtcttactaacaggaacaaagtatagaacttttgataggctaggatatagtgttaccaaaccacatttagggacattttaagtagagaatggaaggatagatattttcatgttccttgaatgtaaacctggtttcaaaatacttaatttaagggtggagcatggaaaagattaggctggtcaaaatgtgctgacttcacatctcagttccagataaggagaaaaacaatataaaataaggtaaacagaaagaaaaagaatatcagcaaactaggtatcatcattatcttcataaactgtaaccatttcctgggtaattgcaatgtaccagatattattttaggggctttgacacaatatctcattttattgagataaacaaaaataatctttgctaggtaggtattattgtccccattttatgggtgaggaaattgaggctgtgagagattaagaaattctccaaggtcacaccattggtgactgtagcgtcccataataaagaaaaaaaagtagctttatcaaagaagagtagcataagtaaaatgaagaaaactacaccaagttaaaaatacagagatacataaaagaagccaatggaaaaagaaaagagaaactttctaaccaaatgaaaacaaggtaaaccaagggtaaattcccaacccatacagcacgtttcccctacctgccttttgccagtcctcccaacaacccagtccccttttgtggccatcattactactctggggggaaaagggaaaaaaaaaaactcctctttcccaatgtcagcttccaaaaatattaaaaggcaactttgctttacactctgcagagtaagggtagagcccacaggaagcatcagctgctgaaaacctgctttcccctgcctgtgatgacacctacagccacaattctagacagcagcaagacaagttaactgttgaagaggctaagaattatgctcttaaagaaaggacagtatgaaataaaggttagggcctgaaagaggacggtaagaaataaaagctatagaaatgggagaaaatcaattggggatgaagttcaaaagtaagggcaataaagagaaaaggctgcaaccctaggctggaataagtatcattgaactaggaagggatttttctttagcccaagcatacaaaaaggatgtgggaaaaaaaaattggaaagaagaaaatgtgtgattgttttatttctctagaaataataatttgtgacaaaatttttatagaatcttcaacatatgaattattaaatgcttatatttcttctcatagctttctaggattgtagaggaataaacacttgttgaaaaccactcattgttgcttcacctacaccttttaaagtttccaagaaagatacaatgaataatgcacttagtctataataaaaagttaacaaaaatggtattttgagaaacatcctttaatattaaagtgttaggttggcagatatctcacaaaaatatgaaacttggctttagtacaagctagtcaattttctatgtaaaattgtcaactttcagatgaaatagataaaattttacctttagtgtccttcccactctttttgctattctcagcaacagcaactaaactctagagaaacatgtagctccctgagaccactggaagaagtacttaccagatgactataaaactttcctaaccaaggatgagaatttttaattcttatgaaccctgaagaagtctcatagaaaataacatcaagtctcatcatattcagtgaataagtactgaagaaattagaatggactggtttcagatccagcatctaatatcaagttcaaaatgctgtgaaaatgaaaggctcagaaaacccagatgagagcatgttgggtttccttttccacttgaaactaacatgtttaccctgctgatggctttggagttgctaaaaaattatcaatatttgttgtttgtttcataaattaaaaacctacttgctcagtcctatcaaagctgactacagataatgctatatttgagcctaaagataactagcccctctatctgtccaatctttctaatcttaataacagaaacagttacgatactaagaaggcacaagtgagtcacaggaccatttttcccctgacattcctcttcttttcctcttttccctagcttaccacttgtgcaactctaatctagagaagggaacagggaagtagttaagcactttgttctctttccaatattgacttagagaatgaagcattatggtccccaaaagacaccaaagacaccaaaatgctcatcttaacaccggaattctggagcacacatctttttctagcaactcacaaacacatactaaaaccacacattgacatattaaagagaggaggagggagctgtggatgccagaccagccaaagtgtcagtgttaaagacaaagtgtcttgacagagaaatacgtggtgttattgggtgatatattaacttcccacaagccattgggtgttaagaaaggaccaacacatcaaagatgccgtagtaacattctaactagtctaaactcgggaatttaaatagcaaaatttgtattgtaaagagcctaaattaatgtgttcctggatgccagatgataaccgaaggcttatctcccaagccaatggggctctgggagaaggggacaatgcaaagtcctacctggtaggcatcaggaatgttgaccgtttctccatgctccccgacatagccaatgatacctttgccccaggggacctgcacctcatttgagttctctgtgctgctgcaaggcagcagaggtgttcctgcatgcacatcaaagaatttggagaccaaggtcttcttgccagcagctgccccttccaccaggaaaagagagcagcggtcagcatccaccataaggcagacaaagatgagaatcttgtagctcaggctggtgaggtcaaggtcattggagatatctttgaccaattccagaaagaactgacgctcattatgctttttcagatggcacttgtagtcgatggctgtagggggataccgaggcagattcactctcgattccagcagcgcactgagaatatgggctgtggtggggggcagggagcttgccttccggagaagtgccctccgtcgtacactactcaggggttcctgagcccgggaggtcacctgttcatcgtaggtcctgttcacgtggatggccttggagcgggcaaaactcttccttagctctttctgagaagctctccgctgcaggttcccatcgcccctgctgccaccggcccagctgggactcaagggaaccccaccacagtccccgccaccgggaaggggctggctgtgggcagagccatttggtccagtgccaccaccaacgctgctgccacctctgcaggtgctgtgagccaagctgctggtaccagccaaagagggccttggacctaaagccccctgaccctgactgtgcctctgcagccacttttcaaccatctcctgcttccccttccgcatcaagtaatcttcaaacaactctgggtgcctgtccaggaaagtttccacctccccaaagtccaggcgggaggctgccatggtcccagacagctttccttgcctgtttacacgtgaaccaaatgttttcctgccccgaggcctctagctgttcctgcacatgttcacccccaccagtattcccagttcagcgccacctcccctggagattattcccagcagtggaatctgggagatgccccttccttctctggctcagagtggctggcgccgaccccaccccgtggtcctgctactcctgctccgcacaggtgcccagcactgagctgccgccgctgccccggctcctgttccggaaacccgagctatcgctgctcctgttctggctgccgccgctgc

SEQ ID NO: 1363 - DNA, 33587 bp, Homo sapiens
gagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaaggtgctgtttttgccaccacagtcttcctgagagccactcactgaatttctcgcccttagtagcccagggtgtcctgtacctgttagaagagttgggagaccttccaaggcctcatacttagtaaccactcagtacattttggatggagggttgctttttatgttaagacagcacaacaaattgcttcaaccctcctttcaaataatgggtttcctaaataagccctcaatctttcagaaagccgtcccaataaattcaacggaggaacgttaggagactagggaaagacctctgccattggactttaaggagctgaagctcagaatacccaacccacgatcctgttcgatggtccagttaatgcttaaatgcttagttttgatagcattatcttcctgagtagttccaagtttgactacttaataataaatactaatagtatagttgcttttttttcttgagcaaataaataatgatctggtgagctacacagctcagagatattaggaataaagcagatggtgattagcgatttttatcggaagtaccagaaaaattgaataacaatgtgtggataattaggtccactatttcttgtgtaaggctttagaacttctttcctctagttatatagattaattcctactagggagacggggagggttcatgagaaaaagacatgtaactcctttattcagggaggtaagaaagagatgattatctgttcagttcttaaagataccaaggaaactccaaaatctgccaaatcttatttgtttgtccaactgtaatcctctccaggtttaattcaagatttcagaaatccagcaatgattcatttcgtgagctttgacaagccgattaacctgtcctgactcaggctcagtacacatccacactacagagagctttgaagaatttagctgaaagattaaagaaaatatgtagtattttattgggtgcaaaaacgacttttacaggaatagaaatttgaatcgcttgaaatgaatttgaaagaaatatatgggtgctttagtgtcataaatgaggttttatactgttttcgtagatgtaacaggcagtcttttccagtgatattcctctttaacaacgattttcataattcttcctaagcttatctatatccagtgcccttgctactgaatggtaaccaggcatcttgtaattttgtttgcattaaaattatttccgtgaacacatagtttaattgttaacatgagattgacacaatgaggtaactttttgcaaacatctttgtgaaataaatggtaggagtctaacataacacaactttcagcaatgaaaatcaggtttacttaatgtgcagggagatcactgagtcacacctgccaagatgtagcagtttgcaaacctgtcttacaaagactttttcaaataatcacacttatttgaactttaacacatataagcaactgtaactttttaggattttactaaccgttgtgtgaattatccaacccatttgcttttcttctttctttggttgactgactgctattttgtattttaaccaaatggtagtcaggggatacacagttaaacatttaaccagtttattttgctatattccatgctgagggaagaggtttagtcatttcaactctcagttgaaatgaagtttgaggattacttgtgaataccaattattcctgtatccctgggcactcttcacatggttaattaagagttgcctgtgtaatgttgtttgacattgtttcttaaggcaattatgatagttgccaaagtgagacttcctttggtttaaagtctttgctttcaggtaatttaattgagctatcatggtgggtaaataaaagttataatatgcacagatgaatcagaaatctgatgtcctctgcttcgcacatatactcaatcacttctaatctactgcatttggcctggatttcccttatttatcactcaacagatgctcctagtacattagacaatgagctatcaatatcgagcaagactttgaaagaagttgacttgaattctttaggaaatctcccacttttctgcttttaaatactcaattatgaagagtatgaatagactaatgtccaaaccagaaacagccaggatccatcttgtgggggacattaatgaaggtcccatgtcctttataatggtttacacactgggttcaggaaaaagagttcttaccctgcaacaccctttccctgtaatctcctagctgtaacagtgccacctatttctcttctaaggaacccagaatatcattgcttttatgttttagacttcaacaaggtgagatacaaatatacattgttcttagctattgtcagaacactaagaaattgagttatggagtatatgaatcctctctagaacccatcattagaaaaatacttgcagcattataaactataaggtgagattttagctatgtgatagatatgtaaagggtcaagtaggtatctccagaacctagaaagaaggttgattgtcttttgtgaatgaatgaatcccttattagaaatcaacacaacttgggtgaggttttcaactgtagtagtgaggaagggctgcctattaatgtatggctgcagacatttgggactgcctagttccaattggaaggccagcatgaatttgtactaagaaagctaagggttaattgactttgttgttccttgtctaaagagactttgttcaaggaatagtaaatgaatacatggaccctaggaaagtggagcttcaaggtattgtttttgttacatacctccctcaatatggacatctggctcctctagcttttgattatttcctctctctgggcattctaatactaaggatttggctttttagatggtaggtgtaagtttactggccaatgaaaaaggctccccaacccccagcagcaatttctgagagttcagtaagtttaagccagttctgtgaagctaatcagctctgaatggagtcccaaagtcaactctttctgaaactccaaaattaaggactctagaccctgaaatatgaggatcacactagactgatgcccttatctgagatactgaggactgtaattgaagtagcaagcctgtagataaatatcttaacttctaccatgctacctttaaaaaaaattattatttttttagagatgaggtattgctctgctacccaggcttgagtacagtggcatgatcatagctcactgcaacttcaaattcctgggctcgagcaatcttcccacctcagcttcctgagtagcggggactgcagatgtgcggcaccatacccagctaattttgtttgtttgtttttgtttttggtagagacgggggtctcactctgctattcagattggtctcgaactcctgtgctcaaggcatcctactgccttggcctcccaaagtgctgggattacagacatgagccactgtaccaggctgctgtcttcttaagtaacagttctatctagtctttcattgccatagtaatgttgactgataactttaattaaaattgaagttttccttattttattttattttttgagacggagtctcgctctgtctcccaggctggagtgtagtggcacgatctcggctcactgcaagctctgcctcccggattcgtgccattctgctgccccagcctcccgagtagctgggactacaggcatctgccaccacacctggctaatttttttttttttgtattttcagtagagacggggtttcactgtgttagccaggatggtctcgatctcctgacttcgtgatccatccgcctcagcctcccaaagtgctgggattacaggtgtgagccaccgcacctgtcctttcctttttttaaatttactgtatggtttttaactttttttttttttaaagctaaacattgtagttgagtaagtaaaacatttagaaaggtggatgcatagatttctttttcttttttaaaactaacattctcttagatacatgtgttaaccactttttcttctgttataaaatggtacttctctgaaatgtttgtagtattataattgttctgaaccctaaagtgtatttcttatcactggaacttaatttgtgcatgggttcttagatattagaacatacataccccgtgtatattcaaatgaaaaggatacacaacctgcatatagacagactaagaactatgttactaaatccagagtgttgatatttacttgtgtaaaagtcataggctatttggagagaaaaaaaatgtgttttgctctgtgtcctttagtcaggcgttaatgtgcatatgactcacctggggagctttaaataaatattctaattcaataagtctggcaagggggctgagattctgcattgctaagaagcttcctggtgctgcggttgctgctggtctaaggactgtaattgaagtagcaaggctgtagataaatatcttaatctctagcctttatattttcagatagaaatatcacatgtggagtccatatctttggatctcctggcttagaagttggaaagacttataccaccagctgccatgagcactgagtcttacatgctgaacaaaagttattttccagttatgaaggtagaagatatgcaacagctatgtaggacaggggtggccagtacatttccactcttgccaattctgttgaattggtagtggctccctggtataggatattaataagaattctgagtcctcatgaagactgtgtggtaaaaactgcagggagcaattggcaaaagggaatgtgaccacaagcatgccagctaccttccatttttgtctgtattattcagttaacttatttaaactggccttcctaagaaagggaccaagactatgatatttgctatttacagtatttttatttcaacttaataagtaaaatgttgatcatggaagatccaggctagattttagattgagtctgtgtacgttggctctgcagtgatggcaaggattacaaaatgatttctgtctatagtagctttgggaaatcatgtaaaatataattagctatatgtttcactccagttcttcataaagatgctgctactgctggcagtaaacactacctacaaatgcagcagtggaagagaccagtgtgtaaggtactttgctgctcacatctgaaaattattcattggtttctggctctggtccatttgcagaatgttatttgtctccccctcataccaattggcacctcaagctctgcgccattaggccaaccaaaatgtctcaccgaggtttctggcagttgtgttctctgtagtactgtgatgggcttagggctccctggcagtttcagtgtgggtgttacattttcccattttctgaaaagatcgagaatatcaggatctggtgcaggctctgctagtgcagaaactatgagatagttcacccatggtgactaaataccaggaaactaattcatgctatgaaactcacgagtgctactaaattccttccagagcaaatgcagatttgggaggaatgggagcctcagtctgtgtctaggttatgactagaaatacagaacctggcctggacttggatggtactgtgggctgtggcttcagggcagggagaaaaggggagccatggacactaccccaggcaagaacaatctagaaaacaaggcacagtattaagtgtcaagtcaaggccaagtgtgcagataggtaagaaccagatatgaggggaacagacagggcagaaaaaaattttggaactgaaattcaccagtgttcttcgaaggaatactaggcagttagagggaagggagttttgtgagggctcaaaggcagcttgacattaagaaactggatttaggccagaatgctagcttattatttcagtgaaagaataactttgcatgagaactgtgattagcttaattgtatggatgtttcctggagagtaggatcacctaagagattaaattacagatgagaaagttgctccgtgaaagtagaaccagagtgtacagagttttatcattcttgacgaattaaccttttctactctggcaagattgttatccaaaacaatgctttccaaagtttttcacatacagtactccatcacatcctacttcactctgccttttttaccgtcccaagggccaaggggattgatatctctacactgcactattctttttatgagaacccaagaatgtcatttctctcaggctttggaaccagatattcctggatatctgttgagaaactcatctgttttcattgggtcgatacagagatggtatctgattccatgtccctttttaccctggttactgggaagcttagagtcaaatctgggggttatttttgaccaatcttatgagacctatggtatctgctgcatcttaatcatatttctataatgctatttccttttctcctccaatttccacattcattaattgttacattttgtatagtgtgtgtatttgcaaactgtagcagaatcactttaggatcagtttgtgcacctgtccctactgccagctagctagccaggtaaacagatgcgtacaaacataagtgtcaaagtacatttatgtctttaataacattgtgacatttaaactgagttgcctttgggaaattttaaatataaattatattgtggatacataaaaatcaatcaaagtatgtatcttcctagtttgattgttttgtccactacctgacgtattgtcccatcagtctcttgcccttggttagatttcgttttgagtctgtagcctgtagctcttttctacttctctttcctctgggggtcttcaaattgagctatttatgtgatttgatttacctgttattaatataacacttgaaagtttttggaaaaaaataggtgagttcattacctaggatattggtaaaaaagttgtgtattcctattgtgtcactgtagaaacagtactatgtagcagcaaatttatggcatttgtatctcaggaatttatctttgtcattcacagctgtgtgatcttgggcaaatcttttaatctctgattcagtttcttcatttttaatttagagatgggtatatctgtgctgtttgacctcactgggttgtgtgagaataaatatagttttggtccatgtgaaaatacttttaagctttataaaatggtagttatgtactctcttaatcttttttgattgtgggaaagtaatacatttaggtgataaaaagccattgtctagaatatttgctgggtaggagtatgtaagtgttgattgatattttctatgcttcgaggacaaatcactttttttctactctatattgccatgtgacatcttcctcatataatcttatcagcggttggcttatttacaactttaaagtctatccagaagcttttagagtatttacttctttttgaaattattatgatgtgaacatggtgaaggatggcattgcttttctggagacatacaaatgaccgcttacaaaattactttctaggagctgtctctcagaaggggtcatgctttttcatagaaaagaggctgacttcctctagctgaaccttcggaaattttatctcattatataaaactatcagaggccgggtgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaacaaaaaaaaacaaaactatcagaaagatataaatctataactggagggaaatttaaaatgtcttttatttattcattttaacatatgggggaacagaggcatgagaaatttaaaagatttttttttccatagatactcatctctttccagagtgagaaaagaaatgacaacaaacacttgtatatcatttactataagccaggcactaatctaaatgctttacatatattgactcttaacattcttatagtatggaaggaagccagtctctaaaataaaatgacaccctgatatggtttggctctgtgtccccaccctaatctcaccttgaattgtaataatccgtatgtgtcaagggcaggaccttgtagaggtaattggatcatagggccagtttcccccatgctgctcttgtgataatgagtgagtatcgcaagatctcatggttttgtaagtgtctggcatttccactgcttgcacccattctctctttcatggtgccctgtgaagaagtgccttccgccatgattgtaagtttcctgaggtatcctcagccatgcagaactatgagtcaattaaacctcttttccttataaattacccagtcttgggtatttcttcatagcagcatgagaatgaactaatacgcatccagtgagccccacctcctaatattcatgctcttgtgtaatcctcacacactgagtagacgtgacccatgtaaccagtgggatattgaagaaatgatgtgtgacttctgatgtttggttagaaaagctattgtggcatccacattgttttcttggactgcttattctgggggtagttagcccaccatatcttgaggatgctcaagcagcctgtggagagacccacatggggaagaactgaggtcttctgggaaactagtacattgtcagtgagctgccatggaaatggatcctgttgcctcatctcagccttcagatgactctaattctcctgttattttgactatgacatgagagacccccaagtcagattctaccagataaaccactactgagcccttgacccagagaaactacaatataataaatgcttattgttcctttttcagcgttattgagttgtaattgacaacattacatatattctaggtgtacaacatattttgatttacatatacattgtgaaatgattaccacacccaagctaattaacctatttacctcatatagttaccttttcacttttatattacttgtggtgagaatatttaagatctactctctttacaaatttcaagtgacactccattattattagccatagttactgtgctatacattaggtctccataaattcttcatcttataactgaatgtttgtgcaacgttgatgaacatccccccattttccctaccctctattcattggtaactccccttctaatgtctgtttctgtagagttggaattttttttagattccacatataagtgagactatgcagtatttgtctttctgtatctaacatttcacttagcatgaccttcaggttcagtatctggagtagggtgttaaataagaagtaacagagtagctttgaaactggggattagggagatgttggaaatactttgttagtgaaagataaaatacctcgaacagattgctagtagaagccttatgatctttaaagaggctgatggcaaggaattagagagtgaggcaaatactattagaatctgttctacagtaatagataattaataaaggaggtattttactccttgtagtatttaatatggatgaattaaggttatggaatagactgcaagtatgcaactatttttttgtttaatcatttaactagctatttttgagcctaattacttttcactatgttattaggagaggcacttattcatgttttacaataaaatactgaccttttgacagatacctggtatctgaggattggtcataatggaatggggcttaagtgtccctgcaagggatagggataagacatacaggatgattacttgtgatggagcttagtagcagtaataaatttataggtttagatctctgtggaaaataattggcaaacactttatgtatttatgtagcacagaaaacccacacagaacatggagaggcaatataatatggtgaaacctaaacatctgggctcttttaggtcctagctgtggaaccttatgcctctgattcttgatttgtaaaatagagttatagttccagcctcataggcaggatgaggatgaaattagttaatacatggaaaacacttagaacagttcctgtctcctattaaatactgtgtaagtgttatctgttcttgttataagcaacagaagttgttatataccctttcagctaatgcttggtaaacaatgccagagacattttataatcagcagcaaaatgaaaactaggctaatcttatctttgattttcataaccattaccatgcattaaagtgtttaattcacacattttaaacttggcataaccgagtcagtgtaatcgaaaaaaatgtaaacctaacaataataacaacaacaacaacaagcattgctggtgtgtgctgtgatttaacataaaatattgtcttgaagttttcatatgtaattagagtaacttatagtttttgaaagtcttaaagcagttctcttagaattattttatgttagaatcatttccattgatatttaatttcttcagtatttatgaaattttgaattatgattgctatatactttatattcacttaaaaattaagttatctttcctataaagataatttaaaaatggagatacatggaaaagtaaaatttaaattttactgataaaagcattgatatgtgtttttttcttaaatattggcgtgcatttgttttgttcattcacaatactttaaaccaaataaagtcacattttattcatgtactgtgaatagttaactcaggagctctggaaaattcattgtggtttaagatgaatttgaaaaagttactgttttttcttacctgtttctaattcacgctaccttatgatattatgtatattttcacaagccttcatagaatcaagtttgaaatcattagatagatagtaaacagtcaaaagacagatagcaatgtaggttttcatggatttgagttgtgaaaaataatgaagtattttatttttaaatatctagatttataggctatatggggaagacaaattttttaaagattaaattatatatatttaccaacttcctggtgagatagttgaatccaatactatatttgaaggtcaaatcaatttttgtgcaataattttattctatattttttgagattaaaacttgacaagatattcagaggtcaccataactgaagcatctgaagatgactatgaatatgaagaggtaacatgttaattttaggtgtttattctgtaaatttattgcagtcattctcatgaaatgctcattttattttctgaaacatgtaagaaccattcttttttcttaagagataccagtttttcaactgaatttagctagtatcagctgattaagaatgagatgtgaaaattctgtttaaacatttaaattggaaaatacatctgattcttttgattttcctgttaatcgtccttcaggttcagctccttattacctgccttgtagattcctaccataaactgttatctctgttcaggaggcacttccttcctgtcatccagtctgctcttgtcaaggattcctagattcccactgctcagttgaagcggaggccttatgcatccttccagcttaacagtatttctatctaatgtggttcctatctcaaagctttcctttaattcattgttcccgagacctatcattacttcggacacttggaggataaaatcactggtagatgacagaggctgtgaatgaaactgtgtggaaataagcctggcgagcctgggtgagcaagagacaggatgaaaattggagacaggctttttattactggtaaaatggagattatgtgtaccacatgaagttcctgaatgagttaataaatgtaaaaggcctaaaccagtgatcagtacataagaagcgtgtgttaagtcttaactgtcattaatcataattgcaatccatcacgtcctttcaagattttaatgctcagtgagttttattttttaataaacgagagattttcagttgctagtagttctgaaaaagtgatggtggaaagcacttgagatggggcaagaatggtgatatttagatagccttattattttttcagcagaattgttagattacattttctattatagataaaagcagttgcccacaaactaatcctgaatttattagaagtgacgtttattgacatttacaaggaagtcagaagaaagcagttattcatttttcatggatcttcagaatgacatggtattttacataaagtatttctttgatcctttgatttgtgaagcaaaattatttctgaagtgaaataaagtattttatatttctgctcactcttcctatccttctctttctctgtgatctagataccagatgacaattttagcatcccagaaggtgaagaagatctggcaaaagcaattcagatggcccaagaacaggctacagatactgaaattttggtgagaatttgaacactagtgtagtctatagtttagtggtagtgctttttatatgaagtttggaaagtcttttaaatgtaaatactagtgtagctcagtcatctgttatatcattttcatctctgtttatttgtgatcaagccttcactttaaggtaagcagtcatatttactcttttttggattgccattctccacatcatggtcactcttgcatgactttgtatcaagtgacaccttctctctgaactctgattaatctcactggaggataaaccaataattttcaacatttatgtttagaatttagtgtcatatacaagttctacagtctgttttgtaaacattttgtgtttttttacatgaaagtattaatcttacagggaatgcttaatatggctttcttgtgaggcttatgaactaattatgttaaggaatgtggtgggggatgttttttgattataatacaatgaactaaaagtgcataaaactgatggcattcctctaaaattgaaaactcattaaaattgtgaaccatttaatatgatggcaaaaatatttttaaaaatgttttattttgtaccaacattaagaagcatgctttctttcagtgtttaacccctttactacagagaaatgtgaaggaatttgtgaaactcctttttggttgcagatttgccttcctcagtgtggaattgtatgtgagactttactgcatattataccatatcattctttccatattctgtagacttcttcaatgtagaagtccaataactccttttcaaaatgtctgtccactcaaaattggaataaaagctctagaggaagattttttcaggccagaattaattgcattctgttgtaaatggagggctgcagctcatagtaaatgacattctctaatgaatcccatggacatagcttcttcttggtagacacaaagtgaaatctattccatagacttagtctgttggatatctcaaagcaataatttgtaggaatagttttaaaatgtatgaatagcattttcagtgacatgcaactgatatgtttattcatttatcatcatcctcttgctttacatcactaaggattttgacaaattctttatgtaccactcatttgtatcggtatttggtaaagtacatgtggctaatacagtgcttggcacatagttggcactaaataaatagcagttaaataagagaatggataagtggatcattgaatgaaaaaactgaacaaaactgtaattgcttccttctgctatcatggtcgaaagtgtttgtaatgcaaagataaatcagaggaaagttgaggaagaaatacattgtagtagctgttgtatctactgagccaaatatcagtaattcttcttttatcaatttattggaagcttttctttatcataaccttacatgagttaacattcttgatttctggcatgtctgtagctgattgactctcatttagcttctttttacctcattttaaaaaattctttggaggaacagtattatgctgaaaattcacagaagttgtccttaagctgttaaatatggattcattttatcataagcatattagttatattttttaatttgctttttatttctaaagtatgttaatcttcagtaatttgaattgtgctatgggctttctcttttaaagaatacttattgcttgttaaatccattttttgttctgatcttatatatattcataaacaagatatattttcttctctgttaaaggatacagtaatctctatgcacagaactcttaaaattttcattgaagattgcaagtaaatggttatgatactattaggaaagttaagttgaaataatgtaaattatcttatttgttaaaatattaacaaaaaatgacttattgcgacttattgaatagttgacatttaaatacattcttgttcttatgatttccttttttttttttttgagacggagtctcactctgtcgcccaggctggagtccagtggcgcaatcttggctcactgcaagctctgcttcccaagtagctgggactacaggcacctgccaccacaccgagctaattttttttttttttgtatttttagtagagacggggtttcaccatgttagccaggttggtctcgatctcctgacctcgtgatccacctgcctcagcctcccaaagtgctgggattacaggtgtgagccaccacactgggccaagttcttatgatttcctttaaatgtgggtagtatagattaaatatttgagaattgattgcatggtttgctttataaattttaaattgtgtatttgatactatccgttttcttagtgggttcaatgatctgaattctgaattaaataattttcattatatttaaagttattcttgaaaaatattgagaagataggaaatgttattaatctataacagttatgtagtttgattatactatcagtagtttcttgaaatttaagtattttacaggtatgaatacaagtaaaggtaggattatatatatgttcgttagattgtgtctgtgtgtctgtatgtattacttagggatatttgtatgtaaatatatgaaaagaaaggtctacttacattgaagctgggtctccccttctaaattctgagcctttttataagtgtatttttgccatttttttggataattcttcagcctctttggttattgatagtttattctgttaattttcaaggtacaatctcagaggtcttttatactgctgtaattacgtaatgacttctaatttttataaatgtagaattttgatctttaaatatgacagtagcaagacacccaagtcatataattgttcaattccctgatgcttttcctcctcctgctaccccttttcctcctctttcttctcccttccctcctcctccttttcttcctcttcctcctgagaatttaagtagaatttatggaatttctttggaataattaactatttttggagaagactaattgatgactgacccaagcgagaatgttctttaccatatgtatcaatagttctcaaagtattgtgggagatcttttggggtccccaagaccccttttagggaatttatgttgtctttcattttccaactacacacctgctggaggattctcctcatgtagctcaactgagacaacatatcacaacaggtcaaatgcagaaaaaaatatggggatctagctgttcctctaaatactaaaaagatttgtaaaaatttgtaacagtgtcactcttctcattagttctttttctgttttggaaaatgtagttagtttttattaaaaaaattctgtctatgttatctgtgtagaagttttgctatagttattttaaagtaaataaatgaatattttaaaatttaatatccaatatataattcttgataggtataactcagataaataagtgctgtctggagtactcaataatttttaatagtataaagtgttgcgagaacataaagtttgagacattttatagaattctattctcagaaattttcaaatatgttaagaattaatataaaaaagttctcttgctattatgttaatataccaaaatatagtctaggattaataaatatgtattccttttatttagatcttaatctcacgagggattaatattaggttggtgcaaaagtaattgtggctataccattacttttaacggaaaaaaacgcaattacttttgcatcaacctataccattatgttaactctcacatcataatgctaatggattaaattcttaaacaattttcattacttttagactcaattactagtctcaagaaaaagagctgtttgtcattattgaattcccattctctccatgtacacacttaattttagttagagacccaggctccttgtactcaaagccatgtctacagattatccaagccaatatatttgacttaatgtgaattaaggagttgatgaaatgaagccccaaataaagtaacatttaagttttaagaccacttggatttcattgtttatttttttgtttctcactggtcaactaaagttgtcaaaggaactcacattaaaacagttcaaaatttgtcaagatacttaattttaatatgtggtttagcacttctttgcaattcaacatttaattagttcttaagtctggaaagttttatgtcctcaacatctttcatatccttctctttaccttcatcctcacttagtctaccttaaagctaccctctttcttttctcatctgagctacagcatgctgctggtactatgcttccttctattcccacctaaaagatgtgtctaatgcaaatttcagtttatctcccctctacgtaaattcccaatgtgtctacccttccacctgcctttgccttcttgatatgcttcctgtttagtttttccactttatctttggccctttctccgtaagaccctgagccttaatggattgaattgtcactccttgtttttgcctcagatgttttcttgccttgaatattggtttatctttctttatctgttgtatttcctcatcgtctgtaacgttcaacctaatagtctccttaacatagccttcattcacatatctaaggcaagggaaatattcttctccattgtgtatcacttcacctagcagatttctattgttgcaatcataacacaatatagaatcctgtctacttagaaaatgtcaactttagaatgttcatagacaaaatgaagctatgtgctagagctaccattgtttgtcctcaacagatttctgggtcacatgtggctagagtaatttttgatcattcagcagtctgcaaagtgagaccatgtttcgctagtttgtagattgcttgcttttttgtgcttattctgtggtgttttgttaacctcataattaagttagttaaaagccgtaatgagagttgtatataatgtataatagggataaaagtgtaacttaaatttcttaagtatacataatggttgcatgtatgatatctgtggatacctgagtaggattttgtaatcaaaatttgtaacaaaagagcttctgtattataatgttttgtttttgctaaatgaaccgttcagttcctcaagacagaactgtcttcttcatgtttaattcccagcacctttcatggtacctggtacatgggagatgttcaccaattatatgttgaataaatatcctacgtaaaggtaaaagagatattcatgatcacattagagcttggaaggggtgtgtgtgtgtgtgtgtgtgtgtgtgtgtgtgtgtgttgtgtataaatgcagaagaactataaattgaggtatatttacaagcttatacattttattgtacagtataaataagaaccaacacagtttaaggtggtcgtatttcttttctgtgggaatgcttcaaggtgtgtgcatggtgcacattcaggaagacacagaatgcaaacatttatttgaaagggcaggaatctgccaggtgtgttgcaaccgtacatacaacaaacatcctttaacctgcccataagtgtctttagaaatgagaatagatacaccctcctgctgtctgtcttccttttcctgttttccaagttccttccaacaatcagcctaaaatatcattttcaaatttattgaccaaaaaaactgaggtagcatttattgttgtataatgaatgttcacttccaactatattttgccctgaccttacaattatatataatttcctgtgctagtaaccagcacactgcaaagacttgaaggcagacatcttgtactctgctagtttggtatctcccatgacatttgaattggcatcctgtacttcttatgtaatgtctttttaataatctttggaagaatagtccagttttttttttaatttttaatttttgaggatacatactaggtacatatatttatcgggtacataagatattttgatacaggtgtacaatgtgcaataatcacagggtaaatggggttctatcaactcaagcatttatatttctttatattacaaacaatccaattatactcattaatttaaaaattactataaattattgttgaatgtagtcactctcgtgctatcaaatactagatcttactcattctgactatatttttgtacccattaaccatcccctctcccctccccagcctctggtaattattgctctagactctgccttcgtgagttcaattgttttactttctagcccccacaaataagtgagaacatgtgaagtttgtctttctgtgcctgacttattccacttacataatgatgtccaggcccatccatgttgttggaaatgacaggatctcattctttttgatggctgaatagtactttattacataaatgtagcacatttcctttctgcactcacctgttgatggatacttaggttgcctccaaatcttagttattgtgaatagtgctgagataaacacaatagtgcagatatattttcgatatactgatttcctttcttttgagtatattcctggtagtaggattgctgaatcatattaaataactcttacttttagtttttttggggaacatctaacctgttctttatagtggttgtactaatttacatttccactaatggtgtacgagggttactttttctccacatccttgccagcattcattattggctatctttcagataaaagccattttaactggggtgagatgatagctcattgtagttttgattggcatttttctgatgatcaatgatattgagcacctttttatttaactgtttgccatttgtatatcttcttttgagaaatgtctattctgatcttttgcccattttaaaattactttttttctttagagttgtttgagctccttatatattctgattattaatcccttttcagatggatagtttgcatatattttctcccattctatgggtagtcccttcacattattgattgtttcctttgctgtgcaaaactttttaactgatgtgatcccatttgtctattacttgtcttggatgcctgtgcttgtgaagtattgctcaagaaatttttgcccagaccagtgtcctgaagagtttcttttgggagttttctcttagaaggtccacggtttgagggtgtaaatttaagtctttaatccattttgatttgattttgtgtatgacaagggataggggtctagtttgattcttctggatatggatatccagttttcccatcaccattcatcgaagacactgtcttttcccctaatgtatgttcttgatacctttgtcgaaaatgagttcactgtagacgtatggatgtgtttctgtgtgctctgttctgttggtctatgtatctgtttttatactagtaccatactgttttgtttactatagctctgtagtataatttgatgtcacataatgtgattcgtgcagtttccttcttgttcaggatagctttggctaatgtgggacttttttggttccatataaattgtaggattattttttctgtttctatgaagaatgtcattggcattttattttgttggggattccactgaatttgtaaattgctttggatagtattgacattttggcagtattgattcttctaatccatgaacatggactatcttttcattttgttgtttctttttcgatttctttcatcagtattttatagctttcattgtagagagatctcacttgattggttaagttaacttctaggtatattatttgtaactatttgtaaatgtgttttctttcttgatatctttaccagattgttaactgtcagcatatagaaatactactgattttgatatgttgatttcatattctgcagctttactgactttatcagtccttttggtgaataggtttttttcgagtataacatcatagcatttgcaaacaaggataatttgacttcttcctttctgatttggatgccctttatttccttcccttgtcagattgctctacctaggacttccagtactatgttgaataatagtggtgacgatgggcatccttgttatgtttcagatcttggaggaaaggctttcaggttttccccattcagtgtgatactacctgtgggtctgtcatatatggcgtttactgtgttgaggtatgtttcttctatctccatgttttttgagggtttctatcatgaagggatgttgaattttatcaaatgcttttttcagcatgaattgaaaggataatatgatttttgatcttcattcttttgttatgatgtatcacattgatagatttgcataagttgaaccatccttgcattccaaggatgaatcccacttggtcatgatgatgacctttttaatgtgttgttgaattaaattggctaatacggtgttgaggattttgcatctatgttcatcaggaatattggccttttaacatgtctttgtctggccttgatatcagggtaatactggcctcatagaatgagttttgaagtactcccttttcttgtgatttttagaaaagtttgagtagggttggaattagttcctttttaaaatgttttatacaattcagcagtgaagccattgtgtccagagctttcctttgctgggagcctttttattatggcatcaatcttgttattggtctgtttggcttttggatttcttcatgttacaatcttggtaggttgtatgtgtccaggaatttatccatttcttctaggctttccaatttactggcacgtagttgctcattgtagcctccaatgatcctttaaaatttctttggtattggttgtgatgtcccctttttcctcttgattatatttatttgagtctactttaaaaaaatttttttttggctaatgttttgtcaattttgtttatcttttgaaaaaaccaacatttgttttattgatctattgtattgttttgttcatttgaatttcatttatttctgctctgatgttcattatttttctttcctctttactcttctctcctcaagtggaaggaaggagtctctcggggttaggggaggtgtggcacaagcactcacttggctgccctggctggtatctcactaagtcatgtgctcctaatgtccactggctctgagcccagcatagcatcataacttgccaaagaattacagtccatgtggtgtagactgcctttcaagtttatttagtaccccagaaccctttagcccgtggtggtgaggctttctggaactcaggttctgactgctgggatgggcaagtcccctcttgctagggctggttgaaatgctccctctgggtgatggctgagttctgcctggtgttgctttctgccatgatgatgcagcactattttcgaatgtaaaaaattccataattactacagtctccctcccacaggacagagattttctctccatgccacttggccactgccaggggatgggggaggtgtggtgtcagcaactcaagactgtcttttctgccttcttcagtgcctctttcagcaatatgaagttaaagcctggtattgtgattactcacttgatttttggttcttatgaagttgcctttttgtgtgaatagttcttcagtttggtgttcctgcagggttaatgatcagaggtgtctattcagccatcttgaactgcctccttccaaattattctttttgaactttacaaaagtaattttacactctacccctttgtcaggatttttctgtagccccaaaatttgcctcaactcaccactattgtgaatgtcatagcagctatcagtaataaacatcagtgttgaattttgtttttttttattttttttactttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaataatgcagcaataaacatagcagcatgatttatagtccttttggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgtcgaattttgtatagcacttttggaaagaatttttggggcagcaaagatcctctttcctcattggatttccatgtaaacattctgtgcattctgtgtaacctgttgtataaccattaacagcttgggaaagagaaggcgaaaggaaaatttgctgctgagtttctgtaggtgagaatagatctgcttattcaaatagtcagcaaacaaattagagacttcttgccaatgcgaagaaaatgacagcactcaagagacgatgattgttttatttttttaattttatttttattgagcaacacttcattccataaaatagaattagtattccctattccttggtatttttaaaaaactaccaattattttatttattttgtacactgacttacatgatataataatttttatggctgtactaatttcatttgttgcttgctgaaatgtcttcatttttctagttttaggtctgctaagatgttctgtcagaatactacatacagtttgagtatcttttatccaaaatgcttgggaccatagtatttcagattttggattttttttcagatgttggaatatttgcaaatacatatcaatgataatgatattttgaaaatatgatttagtgttattcaagtgcaaagcttgaggatagccacctgggaaacacagtctccaaaagaatgagtgagtgttccatagtggggaagttttcacttatataggcagaaacagaagttaacagggttgcaacattttccatacaaggtcattacatagtttgtaatgatttgattgattacagcttgctacattccaaggaagattgctttgacattctgcaaggaagggcagtgttctaaagtggtcttatatctggtggtattccgtgttttgtaatcatttttaggacagtaatgaagacatttaatctataattgaagaagcagaagttgcagcttcatgctatgtggctcaggccacatagtcccgttcctctcaagccttaacaaatataaagttccaaaagctataggtttggattatttagtttgacatatacactaagatctcttggggctgggacccagttataaacatgaaattcatttatgttccatatacaccttgtacacacagcctgaaggtaattttatacaatattttaaataattttgtatatgaaacaaagtttgtgttaagtacttgcatgtggaattttttacctgtggtatcatgttggtgcttcagaatttttggctattggagcatttcagattttggattttcggattagggattgctcaacttgtactttaggttttgagggccatgaggactctgtggcaactagtcaactatctcatgtagtgcaaatgcatccatacataatatgtaaacaaatgggcatgggcatgctgtgctctaacaaactttatttataagaactgttagctgacccctgatctagttgatagactgactgacttccatgtggaatactagtgtaagctcctgttgtcactaattattttctccatagtgtttctaaaagtcatggtactaaaattactgtatttctttttaaatgataattaaaagcattaaaaggtccatgcattctttttttcttttttttgattaacatgctatgtgctattgaaagggcaaacctaccttcttactatcctttagacaatccaatcacactcctgctgcagggcctttgcacttgctgatgcagatacaaaccggaacataagacactctgcctctttgtctagatttatgctcagataacagttttatcaatgacatcttcaccaccctaaatacgtagcaacccagcttcacataaatacttgtcctacacttggttctatctttagtcctctactttctccccaccccaaggtacttagtaccatctgtcatagtatatgttttttatttagttattcatattctgtctccatccacttgactaatagataggaggacagagatttgtttgctttcatctgctttatccccagtaattaaaatattaatggttcctggcatataacagtcaacaaacattgttgaaaaaaaatgaatggatgaatgaatgagtcgaaggcttatctatatcattaattaatgctttgatgttttcagaataaataaatgcacgtttaaatttcaggaacggaaaacagttcttccttcaaagcatgcagtacctgaagtaatagaagactttctctgcaatttcttgatcaaaatgggaatgaccagaactcttgattgctttcagtctgaatggtaaacaattatgtagataaatagttctcttaaaattctaacatttaacatatacacttttaagtgtcttaggagactttgaaatgactcagcctatgaaaaatgactagaaacttttcccatctccagccctgaaaccacaacacacacacacacacacacacacacacacacacacacacacacacacacacacaaatcagaatagcagttacaaagacatttttattaaacatctttcccaaatatttaagtttaagtaatttttaaaaaatcaagacacttgaatatctcctggagttataaaacacaaagatattttatgaaaacatttcctaatatttttgtataattattgagagtatttcctgtatttagacattatactaaacagtcctgctttacttccttgttttatttatagtgtaatggcttgtctttttctactcacatagctgattaattatatttctatgaatattcttcagttagaagtaagtggaattgtattttgaatatcacttaaacaaaatattttcttgttataattgaaaattttaataactagttatgaaaatcagtaggtgtacctttattcctttgttataataataatgtcaccaggcatattttcagtttcctgacattgtttaaataaatttattaaatgattagctatgaaaatgtatttgaactttaatagctattgcatattctagaaagggggattaatatgatacctaaagatgtttataattaggactaattcctaattttaaataaatttgcaatgtatggataatttgcgatttttactcatccagctgtggtataaatttttattttttgctttttttggttctcatcttctgagaacatgcacataagcgcagtcagtttcattattttaaattgcacatgtaatgttaataaattctatgaggagaattatttttcattaatacagtctaagaaaaacaaagttcagtggaagaaaaataatactgcttctcttaaatttggaaatagtgtgaattatttaaaataattttttataaaaatatccctaagaaatataataattacaaatgtactagaaaatatattttttgtaaaagtaggtagatgattaatttacagtgctaataaagtgaaagattaatatgattcacttaactttctgtgttcaacaatgtgtgttaggacatgtgatgcttatatgttaggccagtccaaagtgtaaaatgattttcttagaataatctggatccaagtatactgttaacaattcggtgactattgtcatattttccttttagatttagcaatctgaattgatgagatgaaattttaggaaactaagattactgttagtattaggatttaaagtcctcccaaactaagcatactagtcataagataaaattggtataacgcatttctttatgagtttagaatatcgtggttcaagtaattttatccttatccctagctgccagtttgcaatgagattacattgtattgaataccttatttcatatgaaacattttttattttgattagaaaactttacctattctacatagtaaaattataggaatattaaatatattattttttatcatttttaccacaggaaaaaacacttagaatatatcatttgctatgaattcacttaatctttcaaaacatgaccaaacaaggattttcctttgttagtttgttaaaataagcaaacaaacaaaacactgggcagtaaaatttgatataggttctttcactcctcaagcagaaaatgcaatagatcctttaaatcgagggttagaaaactaagatccttgggccaaatctggcctgcttcctgatttttaaaataaaatcttattggaacacagatataacctttctttaggtattgtatatggctgctttcactctgtaaaagcaaagttaattagtcacaacaggagagatatggcctgtaaatatagttttgccaattctaaaatatttattctctgaccctttacagaaaagagttgccagaacatagtaggaatttgttctatgaaccactgaaaagtttccattgcaggtttagtcgatggttcaattctatttatatgcctattttagaattctcaatgggcaatggtaatttctcaggggggaaaaattaaagaagaaattaaaatggagaaaatatgataatctaattccagtacccttacctgagcatatgtcatccatctgtcttcctacactgactgttcccctattaacattgtcagaactactcaccctaaagatacattcttactttttttgcctcttactacacttctttttaaaccatttttccctttccagccaatattttgaaaacagagtttaaattttttttctttcttcacctttttacttcgtattcaacacttagttctctccagtttggcctattcgcaccatttcactgaaggtagggtggcaatgaaaatgccatcaaaagtaatagtacaattatttataacatttaattactaatttaattttttttaataatggaagagattgtaaattaagagtatatttcattaatttgcatgaaagaaatattgcagcttttagacaataaaatttgtcataacatttaatcacttaaatgtgagcagtgcagttacaactttctggggatggttaagttttaaagccagagcctagaattaaaattacctttgatatagcccttatgttgcccaagtatgtacaggaaatatgtgtggtgttgtgtatacattaatgactcccagtgaacactacacaaatatttgttcctttgtcatttgatcttactgctgtttcttcaattaatgagaacttggcttctagttatatgtcccataagaatattttttccccattcattattaagtttaacacaggaatgtagtgactcttctacataacataaaagttagcaaaagctaatttttgctatgttacattatgatacatttgaccactataaatacatctgcacagatttatgtactatgatattaagagagcagccatttaggtgagtatttaatttaaatttttaaaacaaaattaataacatgtttattaaatatgagggatttaaaaatatttaagaaggtgaagccttaggcttatcactcagaaatttactttgtatcatttttattgatatagtatattctcatgcattatttcatttacttctcccaacaactgtatctagcaggtagccacagccatatttctattttacgggtaaggaaaggggatagggagattaggaaatctcatcagtgagtgtcaccaagtcatagccagtaagtggcagagtcaacctaggacatactgatcttaaagaccagtctcctaaccacagggctatattgtgcaattatacaagagaatctttgaaaaaattaataaaggtgccttttggcttggctggatactaaaaggacttcagaaaatattaatttagaattcaaatttgtgcctattttctatattggtttgaggaatcttggggccagtaataaacatgtcagccatgctatatttttcctgagagggactgtctggttctaagtgatagtcgcgatagtgctggggattctgacatcctcggtttgtacaggaattaaaataattttgtctgtgttggtaatgtatttccctaaatctttatgaaaacatggaggaaaagttctcattataggcttcgtataaggagattataatcaagatgacctttcccctgtcttttacatcctatgccttgggtgccaccatgagggaaaaataatccttattcttctgacaccatttctgtttttactggaattctgtcataatattcatcatttatggcagtgggtcttaaatgcttttgttatgtggacaaaattttatgaaatttctatgcactttctccctgaaattcatatatattctccatttctacataattctaagtagttgatggatctcctggtaaatattaagataattaatgcagttttattagtgataattttattggcaatttcattaagagcaaattatatttcaaatttctaatagttatggcaatcttttttcccacctgaacacttttgagtcttattttaagagtgagtgaaaaagaagaaaaaataaaaagtcaggatatttgttaaaacaaaacaaaacaacagatacatacaaactgaagcaaaccacaaaaacattatgtatgagaattcagattttattgagaagtatacttctgtagtttgtgcattaaaattcctaattacttgtattattatctaaaaatgagcctgaagtcatctttcatatttttacatggatggcagaaaatttacctgataaataatttttgaatgtcctgagatatatactatgtaataaatgttgtatttggatttgtgcttcttttatcacatactattttatttatagtatttaatttagaggaaaaactattaaatcacttttttcctcatagaaaatttctctagtggtttttcctcattaaataaagcaaggtgctgaaaaccaattttatggtcagaaaaagcctatgtcttctcttctgagataagtatatcacattcctagtacagattacttactgaatttatgattcaattgatacctatttcctgttttatgaattgtggcaaatataatggaatattgattcaattatcttaatcttcaggatattctatgggggggtcctcttgctctttttttagaaaaaatcagataaagtatataacacaaaatatgtgactttataaatatgtaacattattatgatttataatatgaaactactgataatttataattagctctaatatttagctcatctagagtaagctttgtagggatttattaataaccttattacttgaaatatttttctgtgctcaaattgttttttttaactttattgattgccatacacagggattaaaattgtaattatttacaatctgcaattgattctctgatgttgcttcttatttgactgagaaaatagaagttccatcactcccacctccctctttaccaccctgctgcctctggcctcaggtattcttctcttctccctcagactctaatgttatctgaagccaactctcatcttgtctgcttgataccagcccctctcacagacttaaggatactgcttttgtaatcgtcccgcttttacctccattgtcagttttttccctcttggctgagtcattcccataagcatacagatgcacaatatctcacattttaaaaaaggaagagaagaaccgccctagatttcatatcttcttctaagttcatcttgattccctgtgctttgctttagagcatatctccttgaaaaaagtttgttgccacttcctcatttcctagtctctcagacgtactctcagtttggcttttatctgcatgactctattgaaaacttttttttttttaatagtgactttcacagtgccaacttcagtaattgattctcagtattcttttcagactcctggcagcattcgtcactgttgttcagttcttcctttttagaacactttcttcatttggcccctgggcacagctctcagattctcccactatttcacgggcctctcttgcttcgtcttttttggtagtgttttcttttcccctcaacctggaagcagtgtagtgtttatggctcactcctaggacctcttcatttctttctttctttactttcatttcccactgcctagctggtctttttcagtctcatgactttaaatagtatctataatgttgattaccaaatttaaattgccaaccctgacttttttcctgaactctgaacatgtatactcaacgtttgtcttcacttaaatgtctgctaggcatattacatttaacacgaatggaaacaatcccttgattactccagccactctgctcctcctgcatttgtccccacttagtaaataaatggctatctgttgctcagccaaaaaccctggagtcgcacttgccttctctcatttaccaacacctgacagttgatccatcagagagtcctgctggccccaccttgacagcatttctagaaggtacttctcataatctccactgctaccaacttctttcaagccaccatgctctctctttgactactgcaatagcctgctaactggtctctctgattctatgcttgctagactaatccctttaaaacataaatctggtcagtgtcacttatctcaaaaccttcctatggtttacttctgattcagagtaaaattgctttcctcactgtgactccctgctgttttcctgactcatctttcaccattctctccttggtcacttagttggcttcagttccagacactccaggtaccctggctgtttgttctttcttgtagttgccaaacacttccttggttcagggccattgcatttacttttccatctgccccagctgcttctctcccagctatccacataacacagtccctcatttcctttagatctctgttcagatatcactttgtcagtcatgtttgtcattcatgcccaccctatgtaaaatagcacaagcactcccatcagtgtttccacctcattcttcctatatctttcagacagcttatttaacttcatagaacttatcaccctccccactagaatggaaactccatgaaatagggacgtagacatttttgtcaattttaatattgtctagaccagtgcctggaacataggagatgttcagttattatattttatacaccatgatggtattggtacctagaagtcatattttattctaaaatatattatgactgttggacattttaacttataaatgtaatactgcaactaattactataacactccctgagacttaactttttgaattgtacataaattaagccaatttggcagaaagaaatgatataaacccttttgtttgattttatcctaggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaa
